United States Patent 7,868,149 (PLANT GENOME SEQUENCE AND USES THEREOF) - sequence listing, part 59

SEQ ID NO: 31969 - DNA, 633 bp, Oryza sativa
acatacagacaccatgtacgctagtacacacgtatacgtacatgaaaaggcagagtgtgcgcagtacatgcagtacgtgtcgttgtagccttgcacgctcgcctgcagccagaagcagcctacaaacctagcgcggccggccggcgcggcacgtgtgcgtccacgccatcgatcagttttctttgatggtggcagccaggtcgaggcagttgctgacgaggcggttgacgtggcgctgcgccccgggtatgggcgacgtgaggtccgggaactcgtcgaaggcttccccgcagtcggtggagaaggtggaggcggacgacagctcggtcatcaggtcgtcgtggctgccgccgctcttgatcgtgtcgcgcgccttctgcagcgcgtcggccagcgacgagtaggcgcccttgcacgtgtcgagcgtcgacgacatgctcgtgccttcggccttcaccgcgcgcgacttcatcacgtcggccagccgcttctccgccatcatggccttggactccaccacccgcaacgccgcgtccagcagctgcttcggcgtcatcacccccggcagcgtcgtcagcgttccgcacagcgccttgtagtgcacctgcatcatatgtcatgccaatgcacgca

SEQ ID NO: 31970 - DNA, 682 bp, Oryza sativa
gccaatttcatgtatgggacacgttgatatacgggtagtacaaagacggtgaggaccggaagtgatcgcgattcgcgagtttcctttgcatcgatccgtaacgtactccacagggccgaaaatgatcgtgattcggaattcgcaacagctcgttgcggtgacaaaccggactacataactgagttgccattgattgcgtattttgcgtcgtagatctctgtttcctcgcaattcgcaagataggtactctactccttacatccaaaaacttcttcatttctcattatctttatcctaaaatagtttcatctttcaaaagtcattccattgttgtttgtaaaggtgaaggataaatataccgaggctagataaaattgcattgagatttcttactttgatgataaacaaaattattttggttttaaaaaaaaataaacaaagctattttgaaatggaggtagtagcattgttgatgataaagcggtgacacaataggcagtaatatgttgctcctccactgtttcccgcgagagtgtgccattgtgcaagttatttaattacggatgacattttggacacgccatttttcttcatttccccccttctccctactgcactttacctgttaattgtaatgataaggagaaaaaggaaaagaaatcacagttatataggctctgtt

SEQ ID NO: 31971 - DNA, 1043 bp, Oryza sativa
attaattaggtcctgatacatatattagtcactttttttcgattcagatatcccgtcctgccgtccatccgtctatccgagtcgatcgtagtactacatggctgtcgctatacacacagcaaattaatttcttacagatggtgcatggcatcgcttgtgtgcattgttgatgactagatgtgcgtggttgttcaacgtcacgtaggtttagtggtacgttggatcgtgctaaaactcttctcgcttgcttgcttaattagttgccgacttgctgtgtgacctgacggtattttcattcgttttgtctcacaccatcatcagttatgcgcacggttgtctcagaggaattcgattcgccaggtgacaattttttggtgcgaaacgtaaagcactcgtgactcgttataaaggataattaaaagagatctgactctggattattggatacaccgtacatgcatagacgcactgtacaccacctagttttaccgagaccacacatcgaccgtaaaattaacgaactgaaacacgactggtattatacatacatgcatggacagttgcacgaacgtcaaccgatgaaagtgcgtgcgcgcgagctctcgctcagtggtggccgtggccggggagcttctccttgatcttctccacgatgcccttcttctcgtgcttccccgctgcatgcgtccccgtccccgtccccgtcccggccgccggagccgtgtggccagcttgcttctgctcctcctgcttgtggctgccgggaagcttctcctttatcttctccttgatgctcttcttcttcctccgcccaccttgcccgtcatcctccgacgactgggcacgcgctcatcaagtcagtcagcccatcgacaaaattaatcaagaacacaacgactagaaagagaagttaccgagctggagctggagctggatttgccggagcggcgcaacgtctcgccgagcgtcgtgtgcccctcctccctggtggtgggctggagctgcccggaggcgcccgtgacgccggcggcgctgaccgtgcc

SEQ ID NO: 31972 - DNA, 471 bp, Oryza sativa
cacagtcatgctgctgaaaactagctgccatcatttggcaccaacctttaaacccattttaccaagggtaacggccttacttaataaatcggtccaggccaaaccacttaaataaattggttttaaaatcgttttccccctacaacctgctttggcttccaaaaccaccttgaacaccacggataatgtgtcccgtaattgaaaaattcgttgcaccccttccatggcattatggcaagttgaatcgtttaattatcggcctttaaataatggcttaggccctccaaataaatgaaaaaaaaaataaaaaggtgaacgtgtccacttcaatcatgcttatgctttaaccccacaaaccgtggaaggctaatgcttgggggtaaagcgggggcttgcctgtcctgcatgccattgctatgcccgaaggctttagggaccctccttttaatgtactgaaagctgaaatgattg

SEQ ID NO: 31973 - DNA, 753 bp, Oryza sativa
ttgagcaatatgatattgaatttgctgaagactctgatgatgaccgtccattccctccacttactaataatgacaagttagcattagaggaatgtcgtgcgtttgagaaggtgtttgggaggaagccggacagctctgatttgtttctgggcagttgagtaccaccttccgcaccgtgtcatgcgacagttcgggaagaaacaagactggccggttgaggacatctcaactggagttgaattacacaagtaaatatttcttatctttgtttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccgaaaggaacgacaggtacatcgagactatacaccaaaatcatcttttctcagagtaccttcgttggctgcataggacatatagattgttcctccgccctacttggacggaagccgacatagaggatgaccgcgacttcgatgagggacggaatccctatgatatccggactagagttggatatcaaatggagcacgccccacttagagacagagtcgtaagttttcttgcatttgtcaaagttatttccatttgcaccctagaccctaacatatatcttctcacgctttcagtcgagagagctctcagggggctgcaggaa

SEQ ID NO: 31974 - DNA, 700 bp, Oryza sativa
ttcctgcagcccggtttcccccactgtttgcaacgtgaagctggggcgtgtgctcattgatgggggagcagccctcaacatcctttcccccgcagcctttgacgctatcaaggccccggggatggtgctccggccgtcccagccgattatcggtgtgacgccgggtcacacttggccgctaggtcatatcgacctcccggttaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcgccgccgcgtccaagcccaagggaggcgacgagaggcttggcacctccgcccccgccgtcccgaggcagcggatagtcacatgcgacgaggtcccggtcaaggaggttgccctgggcgacggcccgtccaagaccacacggatcggtggtcttctggacggcaaataggaagacgcgctcgtctctttcctgtgggcaaacgctgacgtcttcccatggagaccggcggatatgcccggggtcccccaggaggtgattgagcaccgtctc

SEQ ID NO: 31975 - DNA, 683 bp, Oryza sativa
actgaagtctcttcaaaccttgtttacttatgccatatgtattgagctatcaatttttactctggggcaaaggccaaaagaaaagcaaggacagcaaatgcagacagttaatcctacatggactaagaaatgccacttgttttagatgaagaagtgcctgtcaaataaacatattaatttttcacattacttgtacattaacagcttacataaatgttgcctcgaaaaaagatttggtctatcagataaatacatcgacctttgtgtagtcaattactctaagtataaatactaatgttacaaaaaaaaatatgtactatttgagaggttgatcatgtatctacagttgaaagaaaacatctaaagtgtgtgaagctgatattgaatttgtaatagttgtttagaaaacagagttgctggtgttacctctgagcgcacttctaaagcatatgttggtgatacagttgtcacaatattggaataaacaattccaccctgaaaccaataagaagcaaaaatataaaaatcatgacttttaaggtacagaattcaaaacaactgctatttctctattctataccttggcaacatttattcttccatgtgcattgtcttgcatcctgtctggtctatccaactgctcaacatcaaggccgcaatatgataaatcaggagcaggtgct

SEQ ID NO: 31976 - DNA, 895 bp, Oryza sativa
aggacaacccttcttcgctctgctgaagaagcaagacaaatttgtatggacacaagaagccgaagaggcattcgttgcactcaagcgctacctatcaaaccccctgtacttgttgctccccaacctaatgaagaattattcctctatattgccaccacgccatattccgttagcaccgtcattgttgtcgagagagagaaagtacaacgaccagtctactacgttagtaaagctctccatgacgtaaagacaagatatccacatatccaaaagctgctttacgcggtaatcatgacatcaagaaagctacgccactactttcaagcccacagagtcacagttgtctcctccttccatctcggtgaagttgtgagaaacaaagacgttgtcggccgcattgcgaaatgggtagtcgagctaagccagtttgatgtccactttgtgccacgaacagccatcaagtcccaggtactcgccgacttcgcagctgattggactatgcctgataacaaatcagacaaccaaatcgacaacgaaacgtggacaatggcgttcgatggtgcactcaacagccaaggagcaggggcaggattcatcttgacatctccttccggagaccaattcaagcacgcaatccacctcaacttcagagcgaccaataacacagccgaatatgaaggactactcgccgggataagagctgcagccgcacttggggtcaagcgactgatcgtgaaaggggactccgagctagtcgcgaaccaggtgcacaaagattataaatgctctaaccccgagttatccaagtatctcgcagaagtcaggaagctggagaaaaggttcgatgggatcgaggtccgacacgtatactgcaaggacaacatcgagccagatg

SEQ ID NO: 31977 - DNA, 605 bp, Oryza sativa
aatgccggaagagacgcgacgggttttcgctgaaacaaaagaaaacccagaagccaacaaggatgggtgagtgaaaattcgcgttgagagaatgaatacagccccgatggtgagagacgaacttgcaagggggtgggttaaacgaccattttggaggggaaatgagggtttcccgaaaatggttttgtttccccattctaaggggcccgttttttttggggttccccttggggttgggaggtggggcgggccccttcggggggctggttattggaagggccggcccggccccttggggaagaaaatggggaagtggttcttcctggtttctttttccccgggggttggcaaggcgggtgcttcccggggccctgttggggggccaaaaaggacgacccccttttggggtaaaatggttcccccttggggttccgcctgggccgttgggggcctttggaggttggttcttttagggcccggccgccattaataatgttaagaaggaagggcggtttggatggtgcaaaaggggaagatccctctgggaaataaggccggcttttacgaagttaagattcagcacccattggaccaatatcttgaag

SEQ ID NO: 31978 - DNA, 639 bp, Oryza sativa
agtcaaattaacatgtcacaatattcatacgtgtgatactacgcacgaaagtttgaaacagacgagcactcgatcgatcgatcgatgaaatcctgaccgttgatgcttgatcgtgtggatgtacgcccgatcagcctacgtacgtgtgatcggcggtgtgcaaattagtcctcggaatggctcgcgcattcacaaccagcactgggatgcacgcacgtactgcgttacacgtctgcattcagttgtggaatctttcatctaggaccttacttttgagatatattacattcagattcagttctttctctcctcctttctcaatttcttctccatggttttttgcgcgcgcattttttaaattgcgaatcaatgtaattttttataaattatagaaaatttgttttaaaaatcatattaatccacttttaaaattttttaaattaatacttaattaattatgtgttaatttatgcttcgtttacatgcttgaaggattatttcccaaactggtaattcttacttaccttagtagttaaatacatgactttattcgtatttaaatatattactttattcggttgagtttgactactatgtttttattagaaataacgtcattgtataaaaaatatagtattg

SEQ ID NO: 31979 - DNA, 843 bp, Oryza sativa
  unsure (1)..(843): unsure at all n locations
ttctggtcctcaaaaggcgcggttcgggggtagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgtggtagcccccggccaaccctgcacgctcgaggggggtgcggggttggcccgagcccgaaacctgacacccgatcccccctttaggggtagaagcgacgaaggtgttcgatgttccacgggttaggcaactctgtgccgtcacctgtggccagccgaacggagcccggccgggggacgccgatcactcgatacggaccctcccacattggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31980 - DNA, 98 bp, Oryza sativa
aaatccaccaccgccaaaacggcgaggaagcagaggacgatagggcggacgcggagccggaccatggaccgcagcgtgagcctcgacaccggcctgct

SEQ ID NO: 31981 - DNA, 549 bp, Oryza sativa
ttgtgatagggttgtctattggatcacctaggtttaggtctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgacgatgtgctcggttccgatggcggtgatgcggttgcagcagcgacggtgtcgacgacgaggcgtggcgcggcggtggacttcccgtcactggctgcgccccctcgatcggttagggtttatggggtggagtggcggcggcgacaaacctcgttccttgtgtcgttgtaccgtcccgtcctccacccctctttatatggcacagtgtgacgggggcccaccagccattgggctgggcgcccccgatcacggcgcgggtcaaggcccccttgatccgttgggctcaaggggagggagatccatctaatattctcccccttgatctcactaattcctttatcttttctattccat

SEQ ID NO: 31982 - DNA, 19920 bp, Oryza sativa
  unsure (1)..(19920): unsure at all n locations
aacggttaaatatatgctaaaaagtcaacggtgtcaaacatttcgaaacggagggagtatgtcgggtcctaatcgtgtgggatatgtatgatagaaggccgttgaaaaatgatcgataaaaaattaagaactaatttataggtaaaacttttgtatttactcatgatttaaaatccaatagtagtagcttttaaattttaaattttggttgtgcaggctgataaaatatcaagaaaacgacgagggacgtttttttgcacatgatgggtgtagacaaaaaattgtgaagcggagataataactacagaaaattcgagattttagcattattattgatttattgtgtggctcaaatgggagattagaccggagaaacaatgcatgccatggtcaagattgagcagagtccatggtctatatgcatttgttttttgaactgtggtctatgcatatatacatccaaagactactaaacttgtgttacacggttttgaacttggacaagtatatacaagcatgctaatagccagctagtgcttctagtgtccaagacacagagtttcgtcaccgtggagtttaattaggtctaaatttaggtcttcatggaacattccgttaaaggtgccttctttagaccaccttggttaaactaattttacaaattattacaatggctaaactgattaatctaatgttatatattttatctctttgagaaaactaaaattggaccgcattgcaagctaactagacgttttttttttgcaagctttctctattaattcaaaatatgtaggtcagtggcggatcgagaaaatcgatttattgatgtcataatatgtctattggtgttatagtatgctaattatatttagatcatgatgttatattatatggataagcagtttcgctataggttttaccgaaatttgtcggtgtcgcctgacactagatccgtccctaatgtaggtctcaaagcattctccgcttttcgtttttttccctaaaaagaacttattttgtactgtacgtggtttctttgcacttaattttaattcttttgttcatgttctattttccaataatcgcacccctaaatgtccatttttctctttgatttgatgatgactaaaatgtcttcacgtacgacttctactctcgtctttgatccatagctagtacacaaaggggacaagaagaagttgaataatccctttttgataagatgggtgaaaagttaagctgacgttgttgggttaggcgtgacagataaatgccaaacagagccgctcatttcgtaaagatatactacttgacttgaaatcacaagtacacaccaaggacaaagctagatggttagtgagatcagcagtcgagagaaaagacaacttcataagtgatattggaagataagtagtttgaaatctgaacctctgaacatggcatgaaacttcagaacagtttcgtgttgtcttcaagcttgcaaagactattcaaagttttcttaaatgaaaaaaatatattctggccttctggggttcatgagatcgaacggtaggcacggcacaggtgtgtatcatcatgcgaagatgatttgattatttgattgttaatcacgcttaccaagtgttcctgccattcagattctgttggaaaaagcagaactacttctcacaactttctgttctgaacatcagaacatggacaactcatgctagagaacatttgatggagttgcaggggctggagctttcagttgaacttgtctctataaaatggcagttgaatggggctgaaatattgcaactgaaacagatgattttgctgtgaaggtaaaggagtttaggaaactgaatttcatcttgtcagtgacagtttaaggagttcagtttgctccaacatcttacctttggagcctcaaccgatagtggctgcaaatatgtggagatttaggccgcgttctaaactgggtttcagctgtactaattcatcgtttaaagtgagcaccctttccaaactgataaacaatatgttttgtggtaaaactttatatagataagtttctctaaaaaatcaaatgaatccatttttaaagtttacaatagataatacttcctccgtttcaggttataagactttctaaacatctatataaatgtggacaatgctagaaagtcttataatctgaaacggagggagtacttaattaatgctaatggcttatattattttttctgcggctaactagctatcctaaccgctatatagagcgcacccttacttggctagacatcgcatccaaaatctttggcagaacgagaaaagatttggttctctgtagtatctcatgttcacttgccaaacaaggatagtgcagagcagtgatttttaacttctgttcttctaactttctctgaagaaccttgcttggaagctgaatgtgtaagtaggatgggaccaaatcttcagcagttaataagtttcagttaagcaattgattactagttgtgaaatcttgaggacactcttgccaataggtagaatgttagcttggaattggatggagcaacgcttcactgatgaaacctggttctcctcatgcaattctcagcattcagtagtaatcatcaatcaagctgctaaacagaatagccatggcagttactacctcagtcctaaaatatataaaaatctataatcaaatgagacattttctagtatcagattcgtattactaaaaaaaatattccatccgatactaagttcttatatattttggaacggagagagtaagtcggaatgcatcaaacggatcccaatgaaattgatccgaatctacgagagcgcaagcgaatattactacagaatatcaggggttacatgcaaaaagttcttcttcccattcccctgaaactgaaaaagatttggcacgaatcgaaccctccaatccattgcttgcccttttttgtgtcctccagcttctagaaacttctagaacccaagtaagtccaagccgccgccgccgccgcctacagttgcttgcaagccgcattggcccaggtaacacgcccgcgatgtgctggtcattctggtgttgataggaattcacagttttgatctctctgctccattctgtagcctccaggtttggcgctcaccacctgttcgacgaaatgcggcaagagggagcagatgtgcgcggcagccacaagatcaagaagacgactgctgatgtggaaggcgggggtgaatggatcaacgccctcccggaagaggtcctgcagcacgtgatgtcgttcctgccggcgaagcaggccgtccggacctgcgtcctcgcccggcgctggcgccacctgtggaaatccatgcctgctctgcgttccatccatggtatctgaacaagcacgatgtcaggaacctgaacaggtttatgaattgtttgattcgctaccgggaccgcagaatgccactagatatgtgcgagatcaaaatcggtgcttttggggagggctgtggtgaaccacaggttgactcacttatcagatatgcctctgttgcgcaaagctcggataatgaaggtcgaattgcatgagcacaacgataactttttctctagccaagctgcctcttatctcccagcgcttgacgaggttagagcttagtaatgtgccattattatgtggttttgttgattctttgagcttcccagcatggaggccctatggatgaagttctgctatatagacggtgagaagatatcgtctcagtcacttaaagagctgaccatgattgactgtatattttttcgccaatttcggatttctgctccaagtttggtgaggttggaaataactgattgtgtgggtaaagctcctgtgctggaaataatgccatctctagtaaaggcatttatcaggttccgagactctagagatatttgtggtaaagaagaatttgggggtagttgtactaatgctagctgtgataattgtggtgctaatggtgttgacagtggagattgtgtgcttctgaagggtatttcaatggcaaaaagcttggagttggtagctgaacctggtgcggtatgtttttgcctactttgtgcttaattctgttgttgtgtatgatcgactgtttgtgttgtgctatctgtatcgttgttttatttgtttagtatatgtattctgtaaattagcacaatgtggcttatgtgtgtggctaccgataagatatctttaatgtcatgctacatcaaggtggtttatctgtgattactagtataatgtcttgtgttgcaatagatcccaactaaaagtctgaaaaataaaatactacaaatgaataactatgctcaaatataaaacttacatgcatttgtgtatgagaccagttggctacctatgtatactcatctgcaaaaaaattacaactgagaaatctctaaatatttagtatttacaacaagattttcaagtgggggtgggtgtagagcataccgtcaccccgactccctcttctaagttctgaaagctgtgcactaacactatctgtaaggagcatacgctgtgcaatcatgctaaggtccaataatcaaactaaaattttctgaaaaatatcccggtgtactccggcaatagtcaaatactccgtatcatcggttattcagaggagaggaaagcactaacaaaaaaaaattgactagtcaacaggctgcagtcccaacaggatctctgccacgtgtctatccgactggcttaactccaaccgacagcagcagagcagctgcactccggcgaattcgggttaatctgcgtggacgccggcgtcagtcattgagcctgatacgcttcgtcaggccagggaagcagaggcggtgcagcctctgcgcgggttcgtcgtcttccaggctcggagggcgctcgtagtagagcccaactccggcggcattgtcgccgccgcgtcgctcctggaactgcacgctcggcgcgcgcttgacctgcgacaggtgctcgagcaccttccccttggtgacctccgtgctgctcgacctttttctcgccgccgtcgctgtcgacgtcttgtaatggagcttgttcccctggttcttgtacatgagctcgtagccgtggctgggtatctctatgtcgtcggggagcttcctctccttgccgacggcgaccgccgtctcgtagcaccacgcggaggcgacgtggttgatggtgtagccgccgccgccgacgaggagcagcggcaggttgaacccgcggaggaagctgacgcactccgcgtggccccgcaccgacagctccatgccgccgaggcggtcgccggagagcgagtcggcgccgcactgcagcacgatggcctccggctggaacacctccatggccttgcccacgatcggcttgaacagcgtgtggtacacgtcgtcgcggacgccggcgtccaggggcacgttcacgctgtagtgctcgccggcgccgtcgccgatttcgttgatggcgccggagcccgggaagaagtccttgtggggcgtgattttgccgtaccggtggaacgacagcgtcatgacccggttggagtccaagaaggcgttctgcacgccgtcgccgtggtgcgcgtcgatgtcgacgtagatgactcgcctgaaggtgccgaggagctcgttgatggcgagcacgatgtcgttgacgtagcagaagccggtggccttgcaggcggacgcgtggtgcatgccgccggaccagttgatggcgatgtcggaggcgccgtcgacaagcgcgcgcgccgcggcgaacgacccgccggggtagccgcggcagtacttccagaggcggtcgaaggcggggcaatcgtcgtcgccgccgatgccgtggtcatcctccgccttctgccgaagcgcggcgtcgttgaagtagctctccggggtgaggtcgcggaggaggtcgacgtactccggcgagtggaagcggcggatctccgcctccgtggcgggtctcgtgcggaggcggcgcatgtcgccgagcatgccgtagacgccgacgaggctgtgcgccatggcgacgcgggcgggcaccatgacatggtcgtcgctgaatttgatgtgggcgatgccggggtcgtagtagtagcacacccgccgcttcttgtcatcggcgcacgacggcgacggcagcgagttcccgccggtggccatcgctccaagttccttcttggaagatcgagatcgaacagaatgcagcaatggtgcagaaatctcacatggatatacaaaagggacacatgagtctctgtccgagtcggcaacgaaaaccgtatcgtaaacaaacaaactagctagtcgagataagttttaacaaccagtatgataaccaattgagaagtaccgtgtgctagttttctgtaaccaattcgatcaaagctgtatttctatgagcttcagcaagcaacagtgttagtattaattcttgcagacccaaagcacacactttcagaattcagataaggacttcagcatggacgtcgtcagctcgatcaatcatctgctagatctctgaacttctcagactgaatcctacacaagcacgaagagcatattagttcagataacctttggcatatataaaaaaactttgaattgcatgataagggactttgcagttgataaaagtatatactatagaaattattacatgctcccgattactaaggctctgttcttttggttgagttgggaacccatccctccggtacggaaaacgaagcagtccattagcacgtgattaattaattatttgctaatttttttttcaaaaatggatcaatataatttttttaagcaactttcgtatataaactttttgcaaaaaacacaccgtttagtagtttgaaaagcgtgcgcgcggaaaatgagatgggggagttgggaactccaggaaacgaacagagcctaaatgagctgtgttttctcctaacagaatcattgaagagtatgatgttgaaagtataggtataatgaatgccaaagtacgggccagttcaggagtgatgtactcaagtcgccaatgattcatttatttggtcatgcacaccagttaatggaatatatatgttcctcataattggacgcaatctagttgccattgttttaatgagtgcatccaataggtgcgaaatgtgcaagacaaactagacaataagatttgggtatcatattttgattggtttctagcaagaatgaaacgattagaagaagatatttgttncnngtccaacaaaaagtacctcgaggtaccggtatctcataatgcccatcatgcccaggtagatccaacgatcggaaacgatttggtaccgtgagataccggtccctcgagatactttttgatggaccggaacaaatctcttagaagaaaacatgaatatttgagacagtcttttagtaatcaaactagactgcatgattcattttaaagttttcgatccactcaaggagaaattactttaatccattcatcgtataaacatgaatatttgagaagtctgttagtaatcaaactattcatcgatcagccctaaagttacagttcgtatcaaactagcctcccgtagggtccctcgctagtaagtactagccgtgagacgtttggaggctaggttgaagggaggagggactagaaccttcattgcttaactaaataaaatagaatactatcacttttagtgggatgattaaactcctgagaattaaaatctaacttaaagaaataaatttaccaagacaagcattcaaactaacaaaaccaatcgtatcactaataagaaaaccttccaaggccagtctttgtttacttattgataagattgctggcttgctgtttatttgcctgagaggaaagcatctctcatgaatcgggctggtcagctgtttatggtaaaggtggttcttacagctgcacgcccacacctgtatatcaaatgattgatatggatctcccaaaaaagggttctcaaagcaattgataaattacaaagttagttttctttggaagggccagagcaggtaagtggaagcaattgcctagttacttggccagagtagctcgcctatccaatatggtggtctaggtattcattatgtaatagttcttgaatgatccctaaggatgagatgactttggctccaaaagaccgatctgtcaagaccttgggatggtttacagtttgaagtacacctcaatgtcagggcaatgtttttaattaccactgttactcttgtcggggattgcagcaaccaatgttttggactgatcgctggttatatggctattctattgctgaattaagcccctcttttatttgctcttatcctatcacaaggtgtggagactggagagtattcaataaaatcagcctacaaggacatttttgtctaatcaattctttttgccccttggaagaaaatttagaaatgagtgaaatacatggccggtccctaaacttgtgtggtggtgtcacttaggtccgtgaatttgaaaattacacgtttaggtccgtgaacttggtttaatgtatcatccaggtccaatcgtcctttgactgcgtttgaccaccaacgtggcatgtcacgtaggcaacacttttgctctcagccccctccacatcataacacgtcacatatatcttcttgtaactatatagtgacaccagaatcccaaaaaaaaaaaaatcctcaaatcattcttctccttgcatgtatagaaaatgcgatcccgattagcaattgccattgctctgcattccaaaataaccttatccttacacaacgggcacttgatcaacaccaccttcttccagcgacttcaagacgaggacgagcttggagaatccatggggatgcctagcatgcaagccgtattacgctgcctcccgctactaatccgaccgcattgccccaccgctaaccctgctgcactgcgctgcctcctgccgctaatctcaccgcgaggccgccacagccgctacctctcagcctccttcccctaacctcaccgtcaaaaccctagccgatttagggatattttgagggatttgggttgaaatgcactggacagggcaagttatgtgtgaaggtgtatgtggagggggctgagcacaaaagtgttgcctacgtggcatgccacgttggtggtcaaaggacaattggaccgggggtggtacattaaaccaagttcacagacctaaacgtgcaattttcaagttcacggatctaagtgacaccacaccacaagtttaaggaccggccatgtatttcactctttagaaattatgtacaccacttcactgcaaattctttgtttgattagcaatccttagttgatgtcggacggtggacaggatgcccaaataagaccttcctcacccggctgcttgtcccctttgtgaccaagcggatgaaaccattcaacatctcttgatttcttgggtttttgctcatcatgtctggtttgattcttttctgaagagaggtcactacggtaccagtgggttccctacctggtggcgacattcattgaagttggttgacaagcaacaaacgaagggcctctaactgatcaggaagaaccgcaatgggtgtgtttctgatggagagtcccctagtgtcagtactattattagggctatatcagaggaggctgccctgtggagcacagccggagctaaggagcttaggctgttggcttgcgttaggagatcaggtttcttcttggtcatggttttagatcggttgtggcatgtcttatgtaatatttgtaagcttgaactggttatgtacacctatatattagaggggggaaaaagaaaagaaactgacactcacatcatcagtaaccactgtgccccgcatgacacccttccaggatcttaggctcataaacccataacattcagaattttaatgtgaataagctttaattactcctgcacaaatctatgtataagattaagaactactacaactgtaatgcttgactctccacttctgaactgttgctgacctctgctgctgaactattgctgaaccgtaatgcttgcttcatatttataatgtaaatgtaatgctgaacgattgttgcaataaaattaatgcatagaacattctacatttttcttcgtatatatgggccatttggccttttcatattcaaccaacatttctagatataagaagatatactaacgagagaattaggaagattcacaatatttaagttgcaaggatggattttcagtatctcaaacctggatagtgattttgtcaggagaaacgccacaggcattcaagatcttgaaaactttgtgaacccattcttcattccttaaacatcttactttgactctttcaaggttctgaaactggaccaattgtccaattgaactgctactttcttcaatttccaccatatcttcatggccctagagcagacaaaatatatcttggctcaatcaatcatggatgataaccgaggtaagtaatcactatgaaattagaatgcatataccttataaagttgaagagtgagcttctccagaattgatgtttgttggagaaagcaaccaagagcgcagaaattatgcccaacgacccatccatcaagaagcaaagtctttaacttgctgaatgtggggcaccatgtcaagtcttgcttcaaaatacaatgtacaaagtaagatggaacatatcattttaacatacaacacgacatgaaactgtacattggaatggatagaccttttaagtaaattcaggacgtaacaaaacaggcaataaggatctctcgagtctcgacagacatagacatattctagtcttaaaaatactgattgaagtcttgcaaaaattaccagagatctaaactatctagtgttccacctgataccagaagcataaaaaccataaaaatgcaattattcacccacccacccacacaaaccaacttgcagggatgtcctcaaataggtacaaggtaaggcaggacagaaatccatgataacatacaacaaattatgttttgagtataaagctaatgaatatgaacacacacgtaccatcccagcttcagctactaattccaaatttgcagcatttgacagacctctgaaaaacttatacttgacactgccatcaccgtcaggatcaccatcacaacaaacacatgtaccaggatcatatctgcatttccgacaaccccaagacaaagtcccaaacttcacagatgctgttactagcaatggcatgctttcaagcaaaggaatcgagccgtaattatcacccaatcgtagtgaaatgagacctgggacagaaatacgtgtgctcatctcgaagttacatttggtgacacagagatgctttagtgactgggacaccatcttgtcagtggaaattttgcatgattccgccgggcggagcggccgagcggagcagcgtcgccgctgccatcggcccttgcgccctcttccttttctcttctcctctccctccccttgagcccaacggctcaagggggccttgacccgcgccctgatcgggggcgcccagcccaatggctggtgggcccccgtcacactgtgccatataaagaggggtggaggacgggacggtacaacgacacaaggaacgaggttagtagcngccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccaggttagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaaggaagagggtgcaagggccgatggcagcggcgacgctgctccgctcggccgctccacccggcggcgcgctagagaaaaagtgggcgcgcggcagcgcgaggtcgccggccatggcgcggcggtgcaagggtcgccggcgtagatgacgccactcggcgcggccgcacccgcccgcaagagagaagaggctagggtttcggccggccggcggctggggtcgggtttttgtccctccgatcttagcgcccggccgtccgatcgaaaccctagcgatcggacggccgacggcggccgggccgaaagcggcccaagtggggagcgcgcggcggcggctttcccggcccaggcccaggttgcggccttgggggaggggagggggcgctcgcccgcgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaactttgaattgtttttgcatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcctttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacaattgagccaaccatattgggctcaatcccagagtatgacactgtctctaaatacctcgaaagtataaagagccagtttactggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcctgacttcctgacagtgatcatggcaaagaaaggtgagaacattattacatttgtaaagaatctcattatgattggttattctagatccacatggtggatttattctggagcaactattcatgtgtgtaattgtttaaagggattccgttcaatgaggactacgcaaagaagtgaaagatccattagagttgctaatggagttgaagcaaaagttgaagctgttggagattttcacctagaactcgcgaatggcttcacacttttacttccagatgtttttatgtccattctttgcaaagaaacttgataataagtgtatccaaattggattctgatagatatgaaatggcaaatgtgaactatggtataataatcaatgtattggtcttgtgttgcaagatcagctttatttgttatctctttctgagaatgtgaatgttgtgtcctcgttgacaaaagaaaagaaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccgtatgagctatgaatcctccgtgtgtggggaagtcctgcaaaggataaagtatttaacccaaaacagtaagctgccattttattggctattctgaaagatcaaagggtcatcgtttctactgtctaaacagttatacaaagtttgtagaaacgagacacgccatcttcttggaagacgaaatgattagggggagctcagcaattcgagaaattgatcttgaggagaggcgggtgtctatacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagctgcaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaagttttcacgcaaagagaaggcattgattacaatgagacttttctccagtctcttgtaaagattcctttatgattataatggcactagtggcacattatgatttggaattacatcagatggatgtaaaaacggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgagagacctccgtgaggcttcatatgttttgggcatagagattcaccgaaatagaacaaagtatgcattgggattttctcaaaaggcatatatatagaaaaggtgttgaagaaattcaatatgtacatatgcagtgctacacctgctcctatagtcaaaggcgaaaagtatggggcatcacaatgtcctagaaatcagtatgagctcaatgaaatgaaaataaagccatatgcgtcaactgtaggaagcctacagtacgctcaagtgtgcacacgacctgacttggcatttgttaccgggttatttggcagattgcaaagtaatccaggcctagagcactggaattagtaaagattatttgcaaagaacaaaagcctcatgctgtcttacagaaaatcagaatcgctccacatagtggggtattcgaattctgactttgcaaaagataatacaaagttaacatcgggggatacatgtttaccctggcagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatattagatggatctccctccccttgagcccaacggctcaagggggccttgacccgcgccctgatcgggggcgcccagcccaatggctggtgggcccccgtcacactgtgccatataaagaggggtggaggacgggacggtacaacgacacaaggaacgaggttcgtcgccgccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcacaaggtcctccaatgcaggtaagcttgacagatcgtcaatgaagttagtctcagtcctattacgtttggtgatgcaaagacgctttagtgactgggaaaaaatattgtagggggtggaaatcgtacagcaattcatctgaaggtcctccagtacaggacagtttgagaaatcaagagcatggttgtccagctttacagaccgaagctgtaaggtggtcaagtgtttagagatgagaggcatgctcaattccagcggggctaaatgttcagattgaacgaggaccctgagcacccgagccttgcacatgagcgcatgcctgatccatagttcagcatacttgacctcgtagatacaaggtctgggcatcatggtaggccagtatgtgtaggtctggaactcgagctcatcaagaggcaccgggtcgcgcaagagaagaagattgttgacaaacttgttgaacctctccacacccacccatctgtgtctgatgcgcagcacgggggcggacctccaaaggttgcgccagcggcgggagagcagacacgtccacacggcctcgtgcgctggtaggaaggagagaacattgtggaggatctcgtccgggagggtgctaagccagtcttcgccgctgttctcctcggccgtgagtccctcgcgtctcctgccgccgtcgcgcctcgtagccattccgtcgaacaggtggcgagcgcccttgctgcgcaagagcagagaaaggtgagacgtccaaaaaagccatcacggaacaaagagaacaaccgagaagacacactcgcctcacctcagtcgccggaagactcgctctccggtctccgctgccgccgccgccgcctggtagggctcgtcgcggcgtcgcccgccgccgctgatcgatggagcgccgagcggatggttgtgctgtgtgctgtgtgcagtgtaagcttcacctctcaagacttaactgtcaatataagcccaaggacagaatacggcccatgtgtgtcagcctcgagtggaggcccaagacctggatatggcccacgttagtaggcctagagtggacgcccagtttatctcgggcccaagacagtccgaccatgaacagcataagcaagacaggcctagaccagtagaaacccaagattgatttcagcccgtacgttctagtaaattgaaggtctatattgtattcctcaacatgttccatagtccgatttgctgttggctccctataccgtaaatccgtaatacaagcaacaacaccttcctcctccacatcagtacaagttcaatttgactccaatcatcttgggaatatatttgtggatggttttcattcgacgcggcacctagtgctgcttacgtgctactacaatcaggaaggaaaatataaaacaagttacacgcataggccgaaatgacaagagcacatgggcctgaattaccaggaggcgctgtttcaccgattaaatcaaaaatgttttactaaatctttactattataaaaattgaatatgttttttctggttctttgatatgccatctgtgtatgagtctgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaaatccagtcccccctctcagtgggcaaggtcctccttttatatcttaaggggataccacatgcaccatttctctcttttttgtggggacttaccccaccttttcataaacagacggagacttgtatggttgccgtccgaatgaccttctaatgggacggcccatacctacctccacttccgccggaagcaggcgcgacgtggaatcgtggctgtctgctgacgacatgaccggtattagaccagtcacgtcggtcattcttgtccaccacgtgtcagcttagcaatctacatgctcgcccttcttcacacaacatcttgcctgtaatggtttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacattcggcgtgacacgctcagccaaaccgcaataaatgtgggtaggtg

SEQ ID NO: 31983 - DNA, 14188 bp, Oryza sativa
  unsure (1)..(14188): unsure at all n locations
ggttaggtgagccccactgtgctcacctaacccatacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtacaaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccattttcgcgcatctgtgcgagatgttcattggggtgcgcccatctcttcggctgttccggtggttcttcactgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgatcgcctggcgggcctgcgatcccaggggctcacaggggccatggtgtacggcgactacctccgtcgtcggattgcaccgctccagcgacgcgctcggggcgcctgggagtacaccgggtccgaagacttcacgaggacccaccagggagtgagatgggactgggctcctgaggacttcaagatattggtccaatgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggggtcgtgcttctgggcccgcgacaggggcccggggagcagccgccctgccgacgcccgggggaagaggaagcagggaggaacacctcccccatctcctccccgagggggcggggcggcgcgtgctagtaacaggcgcccggagggggccgcgccaacatcgcagcccgagggggagcacaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgtttgtcttctggttttttctttcgtttcagcgagatcccgtcgcgtctctcccgccattccaagtccggccagtctgaggccgaggatccggcggccgcagaggccctcaggcgggaatctgaccggcgagaggccgcggatcgcctacgggaagccgaggaggccgcccaggaggccgcccgggctcgccaggccgaggaaaccgcttgggaggaggccgcctgggcccgccaggccggggaagccgctcgggaggaggccggatttcgccaggacgaggcgatggcgacttctgaggcagctcgcgacgaggccgcgggcgcgtcgcttgggcccactccctcaggcgacactcaggcgacaacttccggggcagctggcgacgaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgagggcgccgtcaccatccgggaagcaacgctggcggcgcacgaggctgcctgcgccgaagaagagttcacgctccgcctccgcgaggacgcgctcaccgaacgggagcgagctctcgagggggccgaggccgcggcgcaacagctggcggtcaacctgtccctccgcgaggcagcgcaggaggagcaggcgcaccgcaatctggaaggtgcccgcgccgagagggccgtattgaaccaacgggccgctgagcttgaggcgcgggcgaaggagctggacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgagatagggcccggcatgctttgggacgccgtctcccgcctagattgcgccggtcggcaagtgggcctctggagagggcggaccgtaaagtacgccgccaaccagggaggcctcgcccagcgcctctcgaagatggctggggctctccaacggctccccgaggagctcgagaagacaattaagtcatcctcgagggacctcgcccaaggagcggtggagctcgtcctggcgagttaccaggctagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagagaaataagaatatgcatatgttgtagcccccggccaaccctgcacgcccgaaggggggtgcggggttggcccgagcccgaaacctgactcccgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccggggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtggtatggtctgcagggcctgggccggctaatggatttgcttggcgtggaattgacacgctctacatcgccggaccaggttgaccgcatcattaagagctgtcggctaatagaaaccctggcgaaaagctttaccaaccaaggtgcgcgaggcggagtgggctccgcattcgccttcatggatatcggcaagaagcacaacgccttgttcccgaggaatgcacttcaagaggattccattagccgcgcgtcgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcaggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcactggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgcgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggtggccttcccacagtggcttcggggccgtcctgggggtcgggggctcctggcgtcgtcggaaaagcgggcaaagggccaactccggtcgtcaggggccttaggcctccgttaggctcgggggcctcttcttcctgctctttcccgggtcgggtcagcacagggttagcctcggggtcgaagggcgataggtgcggccttcccacagtggcctcagggccttctgggggtcgggggctcctagcactgtctgacaagcgggcagagggccaactccggtcgtcaggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccatccaggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgtgaggcagggggtaagaatccttaggacatgccttgttaaggtcggtgtagtcgatgcacatccgaagcttgccgttcgccttgggaacgaccaccgggttcgccagccactccggatggatgacctcacggatgaatccggcttccagaagtcgcgccacctcctcgcggatgaaggcttgacgttccagggcctgccgccgcactttctgccggaccggccttgcgcccggccgcacggtgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgttgcctcggggtggcgggggcggaagcgccaagcctctcgtcgccaccctcgggcttggatgcagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggctttgatggcgtcaaaggccgcaggggaaaggatgttgagggccgctcccccatcaatgaggacacgccccaacttcacgttgcaaacggtgggagaaaccaccatcgtgatctgccctccccgggcaacgcacggtgggtggtcggtctggtcgaaggtgagggcaacctccgaccaccgcgcccgacacgtcgcctcatgagtaggggccgtggccagaagctctcgcttcatggccttgaagctccggcgagaaacgtgagcacacgctcccccatcgacggtggcaatggtggccccaggctcttggaaacctaggtcatcatcgccgtcatcgatgtcctcgtcgggggccttctgcttggcctcacttcgccgattaccggaaggaaccgccggggatttgccctctcggcgctcctgcctcctctcctcctcccacttcctcgtccgctcagccaaacttttgactgcacggcagtccgcaaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtttggggctccttggaggcgatcttttcaagcatgcggttgtgccgcacaccccccctgaacgcgtaaatcaccgcgtgcgcagggatgcatggtatggtgttgcggacttgacagaaccgctgaatgtacaagcgaagtgactcatcatcccttcgctgtactgcgtgcaagtccgcttcctcacctgggcgcggatatgtgccttggaaagttcatggtgaactgttggcacaaatcctcccaagagtggacaaacgcgggtggcaagttcattagccaaccccgcgcttgtcctttcagggccatgggaaagaaattcgccatgaccctgtcgtcaccccgggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaactgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcacggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccgggggccctgggtgaggttctaagctcttggtctgtggaaagttcgcgagagtgaaatcacacaagacacgggcgatgtatacaggttcgggccgctgagaagcgtaataccctactcctgtgttttgggagatctgtgtatgaaggagctacaaagtatcagccagcctctcccttgttttgggtttctaatctggaaaagtccaatcccccctctcagtgggcaaggtcctccttttatatcttaaggggataccacatgcaccatttctctctttttttgtggggacttacccccccccttttcataaatggacggagatttgtatagttgccgtccgagtcaccttctgatgagacggcccacaactacctccactttcgccgggagcaggtgcgacgtggaatcgtggctgtctgctgacgacatgaccagtatcagactagtcacgtcggtcattcttgtccaccacgtgtcagcttagcaatctacatgctcgcccttcttcacacaacatcttgcctataatggtttaggatgaagcctggcatatatctgaccaggactaacgtgccatctctgggaggtaacacgctagctccagctggggacgagcgcctagaagccctcgtcctgacgggatggggcgaggcgtgcatcagatcgcctgtcgccacctaacccacgatctgaccggtctgtgactggtcacagaccggataaacgagtgcactgcactgcgttacatgcggcgtgacacgcttagccaaaccgcaataaatgtggttaggtggggccggctgtnctgacctaccccatacccggagcaaaaacccacaaggggtcggggcccctgggccggcggggccaaggggggtgcggcccaaccccctcggggggactaagaggagggcgaatgcatcaccctcgggcccgacgtccctcgggggtaccaggccacgtatgcgattgtgtctgcctcaaacctctagtcatgatactcctgatcccatgtcaccgacaacatgcatatagaagttaatatgaatgtggatgcatattaatatgttaagtcattcataacgtgtgtttcatatgaatgtagccaatactagaatgatttacattatgaaatagagggagctaataattaattaataatgtactaaaggattgctctattttccgtgtgtaccgttccggttatcaataccagcgcctcgccgcctacagagcgtctgggggaagccccccgtttcacccctttctcctcctcctcccccaaccccaaatcatatcatatatcccagccggagttgtattgacaatcgacactttttttttccaattttccttaaaaacacacacatgcatgcactgtaacaattattaaaattcttaataaaagtgcactggcatatgtgtttttttaggaaaacattggcatatatgttgactacggaagaagttcagatttgaaccctaacgcttgaagtcatgcaccatctaatatgatatcacatcagagatgttcaccgcatcatattaactttctgtggacgtatctcataatcactggtgctagcctccaaacaaagaacagaacgcacagcggagtgcaaaggggcccaccgaagatgaccaagtagacaagattggacttcaccaggtcgacggtgatggggaccccaatcttcgcgagcaccgtgatccccatcctcctctgcagcacgtacgcgcagatcagcatccgcaccacctccctgttcctgaacagcagcgtgccggtggtgaagacgcagacgcccaccgccgtggcgcgggacaccggggccagcaccaggtacaccccgagcgcgaaggccaccagcaagctcctcgtcgacttgcgcatccacgacagggagtgcttgaagtacctgtgccggatcttccagtccaccgccgccgtcccggcgtagatcaggctgaacgtggcgagcatggagcaggtgaaggccaccgtcacggcgtacatgaacgcgtcgaaggcgtacctccccgacagcgccggagagcccgcgacgacgacgacgttgccacggccattgttattattaccatcgccagccgcgtagccaccgggcggcgagaaagccgccgcgaacgcgacagtggcgacgaggacggagccgacgcccaggatctgcgtcgactccgtcattttcttggactcggcgatctcgtctagcttgggtacgtactgctgctggaagtgatcgcgccggatgttgccgctgagggctttcgctaccaccagggaccaaagtatccacgttcgtgcgttctgcatcaacaaattactaaattagatgcaaaatcatctctaattaaagggacttactatgtttcagttgattggttatatatgagttggtttagagactagagatgtctataacaagggtaattttaatatctctgagaaggtactaagaggtaccatatttctatggtaaatttaatacttctaggtattaagtaaggtactaaaattttgatatctcaactgtaaaattccccctatataacaattaaaaaagaaaaaaaaatatccaaatactcctctaaactttagatagaaatacttctacaccctaaactttaaaatcagatctttgcaaaaccattcatattactccctaaggtggttttgtatagttatttttatctaatttttatataaattggatgagtttgatcacatggcatacatattggacacacatgtgtgtgtatgtgtatgtatgtaggtacaatggtacatacgtatgtagacagctctattaaatggagaggcaagtaacattagaatttagaaattaccagtcaagcgaaagtgatttaccgttttgtagttaagcccagcgggaatggtacaccttgagaggtcagccggagtgaggccgtcgttgttggcaagatccaagcaaaccctgcgattccgcagcaggtagcagaacacgttgaggacaccgctcgcgaccgccaggtgcagcgcggtgttgccgtcgtcgtcctgcgcgttgaggatgggcgtcgccagctgagagccgtcccgcctccgcctgtcgtcggtggcgaatcccacgatctcctccctcccccggtcgacggcgacgtggaggaaggtcctc

SEQ ID NO: 31984 - DNA, 2147 bp, Oryza sativa
tactggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaaagagagaaatggtgcatgtggtatccccttaagatataaaaggaggaccttgcccactgagaggggggactggacttttccagattagaaacccaaaacaagggagaggctggctgatactttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccaaaccggcaaaggggggcctgcgcggtctcccggtgaggagccccacgctccgtcacatgtggacaataataaaatgatttacattatgaaacggtggaagtattttttttttcaaaaatgaattaatttgatttttttaagcaacttttgtatagaaacttttttaaaaaaaacacaccgtttagcagttttaaaagcgtgcgcgtggaaaacgagggagatgggattgggaagggggggtgccgaacacacccttagtagcatcagagccacaaggtggacagtggtcccgtgctagtggtaggggcaaacgacccaactatatcgactagttaggatgacggtgaatccgaaagcgggcagccgcagagataggaaaatcagcggggcaagggcaccataccgccgcctgcttaaggaggagatgcgggaaagggtggaggtcggctaggagtagagatggcaatagagacccataacccgagacccgacaggtttttactctattagaagctaattgttctaactcttatacacatgggtctactaacgggcgaaaactcttatctattgggtacatggctatgggtccgttctttacccacccgtacccaccaacctgtgggtgaaaaaaaaccgttgattgagtcaaactatgagcaatataagtatcgatgactactaaatcatagcataaaactcatttcacatcttaagtattgttctagtctagttatatgaaattgttatttgatttcttgattatgtaatgtggttgtataattttttttcctcacctttgaacgctaatgttaattaatagtattgttgctaaagaaaatattgatggtttacaactctaatatggctaattatagtacaaaattataaatgctgcaagtcaattatatgggtatgggtatctatacccgttacccacacgggtgtgggtatagggacgattttgtatccacgatggatatggatatttaagtgagaatatttaaacatcacgggtgtgagtatggggcaagctaagagaacccgatggtatgcacccattgccatctctagttaggaggcctcgttgacatcattcgcgccttccggctagctggcggggccagattgacggtattggtggggcagattatggctagacgaggggagttagggtgtgtttagttgggaaaagaaaatttttgggtgtcacatcgaacgtttgaccggatgtcgaaaggggttttcggacacgaatgaaaaaactaatttcagaacttgcctggaaaccgcgagacgaatcttttaagactaattaaaccgtcattagcatatgtgagttactgtagcacttatagctaatcacggactaattaggcttaaaagattcgtctcgtgatttccttcataactgtgtaattagtttttctttttatctatatttaatacttcatgcatgtgtctaaagattcgatgtggtgtttttgagaaaaaattttgaagaactaaacgggcccttattacatggaacaaagaaatttgatggccaggcactggtgtcggcatcagagccacgaggtttggagtgggcaggagcagacgacctgactagttaggatgcagcagtagatctggaggcgaggagccgcaccgagacggggaagctggcctgaggaggagggcgggggttggggggggaggggggg

SEQ ID NO: 31985 - DNA, 19842 bp, Oryza sativa
  unsure (1)..(19842): unsure at all n locations
ttttttgttccatgtcactctcatcgttgagctgtcaatctgccccaccgccgctgtctatctagcctcaccagttagccggtangcacgcgaagggcgcccggaggaggccggctaggcctccttagcgcgccatccgcgtgcattccggctaactgttgaggctagattgacagcggcggtggggcagattgacagccaaacgatgagagtgacatggaacaaaaaaattcgtggcaaaatccaaaagatttctgaatggaatgcaatttatattaaaaaacctatgaattagatggcaaatagtgaaatttctcacctgatcatgacaccctgtttagaaatatgactatgtttagatgggactaaaacttttaagtccctatcatatcggatgtttggacactaattataaatattaaacgtagattattaataaaacatattcataatcttggactaatttgcgagacgaatctattgagcctaattaatccatgattagcctatgtgatgctacagtaaacattctctaattatggaataattagacttaaaaaatttatctcgcgaattagtttttatttatgtaattagttttgtatatgtaattagttttgtaagtagtctatatttaatactctaaattagtgtctaaatgtagagactaaaattaagtccctagatccaaacaccaccgtagacacgaatcaactaataccgtagcacacctagatgcagatgcacctagtcatattctctttctcaacacatatctgagcacctctgttggcgctaccctccaaaagagaattagaacgcacagcggagtgcagaagggtgcaccgaagatgatcaagtagacaatgttggagatgagcaggtcgatgccgatcggggctccaatcctgagcacgaccctgatccccatcctcctgcgcaccacgtgcgcgcagctcaccatcagcaccagctccctgttcctgaacagcatcgtgccggcggcgagggcgcagacgccggcggcggtggcgcgggacaccggagccagcaccaggtacacccccagcgcgaaggccaccagcaggctcctcatcgacaagcgcatccaccacacggaattcttgaagtacctgtgccggacattcatctccaccgccgccgtgccggcgtacatcaggctgagcgtggcgagcatggagcaggtgaaggccagcgccacggcgtacatgaacgcgtcgaaggcgtaccgccccgccagcgccggcgcgccggctgcgacgtagcctcccgggggggagaaggccacggcgaaagccacggtggcgacgagcacggagccgacgcccaggacctgggccgactccgtcattttcttggactcggcgctctcgtcgagcttgggtacgtgccgctgcaggaagtgatcgcgcctgatgtttccgccgctgagggcgttggctattgttagacaccaaagtatccacgttcgcgcgttctgcagcaacacgagcaaagttttacccaattttgattagcttaacgatgtagttctctccttccggtgctaaataatatttgacgctcttttaagattcgattaaactacttttaaaactttggacatcagtttcatacaccaacaaatttataaaatctagagtataattcataaaatccctgtatatttggtctaaattgtacgaaaccgtatgagttttatactgtgttgcgcataacagcatgtattatggtgctatagtttcatacacttttttctaatctactatgcatatgaattttatgggttcgtttatccatcaaagttaattatattttattgtgctataatattaatagttaagttagttgacggtgtggttttctaagaactagtttaaattctagatttgataaaggggctcgtatttaccgctatttatttttttagtggtaggtggcgtttccatcaatagagaggacttcatcaatctcaagatataccgactcagtcctgaagatgctcacaaaaatagtgtgtgcgcgtgctatgggtgcctatgttcgttccatgtttctaacaaaaatacaatactacaagtatattcgtactatttttttttcaaaatgcagatttacatgatttgatataaaatagtttaattgttgtgaatttatttttaaaagaaaaacattattaaaaagggcctgatctaagggcacgtacaaacgtgtataatagcggtctctctttattgccatgtaagtaaatttgataacgtggaagagagagaggagagaaaaaaaaagcatggttgctatacatgacaacaggtaagagtcaactcttaacttttattaaagaaaattttgttgtatgagggtggagaaaagaaaagaagggtagtaaaaaaatattttggtacgttaatgattaagagttcttgttgtctcaactattgtaacagtatattctttaaataatatgtcttacttaaaagaccatatcggacactatttttgtacatgccctagtgaggtaaaagtgatgtaccgttctgttggagtaaagacccgctggaatggtactcctggccaggtcagccggtgtgaggccgtcgttgttggcaagatccaagcaaaccctgcgattccgaaacaagcaccagaacactctcagcaccccggccacgaccgccaggtgcagcgcggtgttgccgtcgtcgtcccgcgcgttgaggatcgccgccgccggaaaccccgtccatcgacgtcggaggcgaatcccacgacctcctgcctcctccggtcgacggcgacgtggaggaaggtcctcccgcgggcgtcgcggaggccggcgcactcggggcacttgtcgagcaagagggcgacgagcctcaggttgccggcggacgcggcgacgtggatggggtagtcgccgtcgccgtccggctggcaggccaaggacgggtcggtctccaggagaagttcggttggtgtccggcggcattggaacgggcacggcaagaggagccaccggaggagtgagctgttctcgatgtcgatctttggtccgtccgccgaggcggcgaagtggagcgctgtgctgccggacgcgtcggcttcgccggagagcccggcgttccattgcattatcttttctgtcatttcttcaatttatggagaaaagcgtgagaaaaactattactccctccgtcccaaaataagtgcagttttatactattcacattcaatgtttgatcgttcgtcttatttcaaaattttttatgattagtatttttattgctattagatgataaaatatgaatagtactttatatgtgactaaatatttttaattttttcataaattttttaaataagacgaacggtcaaacgttagacacgaatatccatggctgcacttattttgggacggatgtagtattaaggtactactgctaccgtgctctctatgagatgatatgatgttaaaattaattacaggagcagttaatttactactagtctctaacccgtacattgcacaagttacgtttggatatttctttaagtgggaaatctaaatggagagcattcttgattttgtcttatggcacgacgctccgccagccatccatccgcgtcttcatgttgtcggagagataggcttgcttccattgcaatggcatcaaagcgaggaaccttcgtggcgtcaggtatcgctatacaccaccaaccatcgaaactaaatattggttacacgagtctattctttttctaatgatgacttatatattttaaatcatatattattttcatttttgtttgtaccatcgtgctctactcaaaatatacgataaaacaaatttaatatttaatatattcaaacatttaaagtaatttacttaatttcaaaagtaatttagtaaaatcgtagaagtaacttagctctgcaatagaggtaactatctaagcattgaaagttgttatattgatcaatcaattgatgttgactgagacacggacacgtaaatattatattgacgaagagtcaaagaaatgagaccacttgacaggaaaagaggacaacatactatctgctagttatcatgtcgattcacgtgcatgctactgaggctaacatgtcattacactagtataatgtttttttatagaatctttgatgacctatatatttttagaccttatattacttttaagatccattttgctcaaaatatgtgataaaatgagtctaatattgagtatatttaaattatttatttattttcttaactcctttagaagtgtagttacttccaataatgtgcactatgtagtcgtgtccttttcaaatgtattgctagattttaagctcttgaaaatacaaatttccagtcacctaaaattcaagccctctacaaatcgagcgtctgatttcctaaaaaaaaaaaatcagacggtctaacgtttcaattgaccgatgactgaaatgttgagtagtacatggtgaaacatttaagaatttgtgaagcatagtaagaacacatgttgaaataggtcgctattacgtatgaaacaatgtgttttattggtttgaaacatattttttattaaaatataatcatgcgatatcttgttataaagatttaattataatgaatattatattatgtttggattatatattggataagtaatttagttgaaaaatatttcaaagattgctacaagcctatatgcatgaatggaatgaagagagagcaagtatatggtagaagagagagtaggggtagttatgtccgatactttaccagccacatctgaaacgtcatgctatacaaggtgaaaaaaaagacattgaaatatttatttttcatgtgtaatacattaaaaatatatgttgaaacatgtcgcattacgtatgaaacatttagtattaacggttataaacatatgattatattttagcaaaataatcatgtgatctcttattataaaaaaaattaattgtaacaaatataatagtacgatcggatcgaaaatccgataagtaatttaggaggaaaaaaattttgaagatagccacatgtatacatatatggataaagtggtgaaaaagcaaagtagtatactaatatggcagccatatagtagcttagttgcgcccgattttctttcctccaatcgggttaccgataggaatcattctcatctaaaattgcatatactcttaagcctaaaattatggtggcacgtgcggaacattatttctttttaactatagttttattgttatattttttttcctattttcttgtctaagtttgaatgttttttttaaaaaattgtatttttttgaaattgtaagttcatgtaatgcaattttgtaatttttggagtatgccttgtttaagtaagtaatagtggagtgatgagaagaattacatcgaaaactcactttgattattcgaaagagtgtaggtcaattttttatgctacaaggcaagaccacctatctaaatataaggctaaagccaaattatttttcgtcatttattgatctcttcgacggaagagggtgtcctaaggcgcactaacgtgtgctttgccctgtcataccagaacttctgaatcacttaccaagacttctggtattcctgtagtggcacgtcattaggtatcgttgagggttgcaaacgtagtgctagatgtgttttgggatggacacatttttatgtcaacaatagggaaacacatggagtcatggttgtataatttgacttatcatggagccgaccacctatattagaacgcctatagaaatacaatatttatagaaactgttgtcttaacttggctgcacgtagaacaggtgcctgcatatgagccccccccccccccccccaaccaaaagtatagaagcagattttataatgcactatatcaagtaaaatgagagagtgtcttctaaaatcgttttatatagtgtaaatcatgttaatcacacttcacacgtgcacatacgtttttaatatgactttagtgaagccaagaggcacgccaaagtcaacctcttggcttgagcttatgccaagaggtgcatttgtcgatgtgcttctgtttctttgatcgtgcctcatcagagtgtatttgtcgatgtatacgtgtgggtctttcatatgatctaaattgatcgtgcggagaaaatgttttcatccctaaatagttataaaaaacaataagatagccaagtatgaaatatattactttacaaatatgtaaataaaaaaatcaacttttgaaaattataaagaaacaaatataaccaggaatgtgtgttaactatttaagttgaatttgtttcttttggtattagttgtaagagtccaatttgatattacgagtgacatagttcatatcaatctatgttaatatatgctgttaatttttttaagaaaaataataactatttagatgatatataagaaatatatcccatcgagaaatgaaaaaaaaatcaatcttcacttgtaggcacgtacctgcgccgcgtaggacagcagcgtgcagggcagtttggccggccggtccagaatacgagagctcgtcgcccccttgctgatgcaggagctccgcgatgcggtcgtgccccagtgagatcgcctggtacaacggcgacatcccgtcgccgccggggagacaggcgagccgcggatgcacggccatcaggtggccgacgaggcgctcgtcgccgagcctgacggcgtcgtgcagggccgtctcacgccggccgttctgcttctccagcacgtcggccaccctgaacctcgcgccgccgggctcctcgtcctcctccatcgccatgtcgaggaggcacctgaccatcgccgcgttccccgccctggcggcgcagtgcagcggcgtgtcgcccctcgcgttggcgcgatccaggagggccatggcgctgcggtagatggtgcgcgcgcagctcaggaacgcttcgctgtcgccggaggccgccacgacgtgcagcgcggagtctccctgcggcgtcgtcgccacgtccaggagcagcgccgccgcggtgggtggctgtggctccccggccgcggcgacgtggacggtgacgtggtttggcgccggagcggcccccagaagtacagcctccagccactcgcggtggccgccgcgtgcggctctgagcagcctgcgatccatcgatacggggtctgaatcaaatgatgattaggatagaacattatattgcagagtggctgtgatctagacccgtttggtatgttgcgattacttataattaacatgtcagagatacttagtcagatgctttaaacaacatacgagacttgctggaagcggctagcactagcacacggtcatgcgtgcaaaaaccatggacgtacgaaccagcggatcagatcaccttgtcttgcattgcatcccgtgtgccgggtgtgaccggccggtggcagagccagcatcgccatcaagtctgtgtgactgtgtgtgtacgactataaccttcttctcttttagatatattaacatgttatttatagtaataagtttgaatttataatgataattacaatgtaaataagtgtgtgtacgacatcattaatttcacaagaagtgtagctataaagtgctatatatctaagccgtaatatatggtaatgatattatacttcaaatttatttatttatgtttttttgtaaaatcataggaccctaaaccctgcacatacatttaaattaggggaacgaaagatctaaatgaggattatgctgaaagagacttggaaatgggcatgagcctaaattaaccaaacaactcgtatgaggagcaaataaaaaattaaggcgtgactcaaggagagatggtacactgaaaagaaattttttgatgcaaacaaaaggtaaattagaaagcttaaggtattgcgttcttcattgatggaaatattacagatttcatggatgccaaactcaataagttttgtattttgatcgtgatgcgaagccaggaaagaactcaagaacgttcagctgataatgcaaagttcttctgttgaacactgccactactacagatttgattttttcgtacgatcaaaatagattttctcatacggagatcccacccgtttatattcagatgtttgcgaaaatcaacatttgcccctcggaggggtgagggggaaccgcaacgcggcaaagccacggtctccacaacgcggccacggcgttctcccgcatgccgcacgccctcaagttgtcagagagctattaggccatttacaatgcaaagacgtggagttcagcctccacatgctagctcggagattcctctccacctaggcacttttcactccctcactaggaacggggagccaaagtaagcattagaataactaacagccacgattcatcaccgttattagatcagcataaaccaaacaaaacaagcagatgtgatgcgaccgaggcagctttattcaacttgtccagaaccacttctctaccgactatcacttttgcatgggtaaaattaactaggtaccacgggttgattgtacagtatttctcaatgggacagacatgccgaaacatcaactatttcccccactctcactactctccatctcaccgtctttcagaaccttggcaaaatctggcgttggagctgtcaaacatgttagccgtcaggtcccgtctcctccatgtctacagccacaagcatccatgccctctcctactcactgcacatcaataacagtttaagaatagtaatattgtggtgaaaaggatgctcactgctcaggcgatcagtgtacaaaccttgtttagagctcatccttgagaggctcggctggggccgactctgccttctccttcgcctgaccagcggtttccttgttcttcttaatgaagtcgacgatctcgtcggctgtcctgccgctttcatagggaaccatctttccactgggggtgacgaagtacagggtggggtaaccttgcacatcgaactcgcttggcacatcgttcgcagttgcatcctgcatacaaggtagcaaaatagtagttagatgaactgtacttgtgataggaaagaatggatgaataatgcactcaaaactaatggcaccacccagatagaaaggaaattaccatcttagcgatgacaacatccttgtcgcttttaagcgtcgtagctgcctcatccaagattggagccagcttcttgcagtgtccgcaccatggtgcatagaattcaacaaggactgaaacagaaaacagcaaataaatgagagctgcaaatcaaatagaggctttgccagcactgataattgaagaagctacaaaaaaatagcaaacttgcttttgaccagggaggaatcagtcgctcacaatactaatataagaactaaaaatcatctcactgaaaagattacgggggacaacagtatgtaccgtttttgccagacttgaagacaaaatcatggacgttatcagcgaccacaaccttaacaggctcgtcgttgacctcaggaataggttcagacttcctgaatggagacaatttaccatcctaaaaatagaggttttgtgagcattgtgcaggtaaacaaatatcctaaaattacataaatagtaacaaataatcacaattatattttacaagtataaaagactacttacaaagtattccttcaaccaagaaacaatttggtcaggctcaacgtgtgccttcaaaaatttcttggactcaccatcctggatgatgatgagtggtacctgatcctccctcagcccaaagtactgtacagtgacagatttaaagttagcatcaagtacattaataattgtttgaaaaaaattataagaaagtgaggtaacaaacctggaaggcaccttgactggcctcaatgtcaccaatgaggaacttaatttccttgtccttgaactcctcagcagcaccataataaactgacttgaaagactcaaacggtccagtggagaagttcaaaaatagcatagcctgcatataatttggtaacgtttagtgtcagtcatcaacaactgcaaattactggcataatgatatacggagtattaaagaacaatatttgaatcactgcgtttaatagtgagaacttgcaaatatatgaatggagaagggtatcagatattacagtctaagcaaagtctatttgaaacacgagaaataaacatttaaattgactattaatatacagtatcaatcaactactgccagctgttattaaaagaatggagcttttcagagagcaaggaatgccaagcgcttaccttggcagctgagctttggaaaaatttcagaaggtaaggatggttgtcagggttcttgtcaaaagtaacaactttaggggtgctgctagcatcaatgaacttctccaaagcagtaacatcaaaatcctgaagagatatgcaaacaacacattattgacaattaaccaaaataatgccagccaataaaggctgtgacaagttgtaggaaacatagtggccaaatgaatagttaaaacaatgaagtttgatatttgaggagttatataccttgctgtcaacaacaagctcatcaaagggcttgaatagcctaaccaatggtctctcaactgcagcatcaccgcgtggaaggtggttggcatgcaaggtgtggccaaagtcataatcagatctcagcttctcagcaacctctatgaagtttgtatactcagtgccacttaattctgagaagattccaacctatttcaattgctcattcaagtcagcagtcaattttaaagcatgaacagtcggaacagaaaatataagttggagaatgtgtcatattgaatcgaggtcttacaatgtagattttcttgtcatcaataaggttggttgcgtcttctggtgacttgatctccttggaagcaggaccaacctgcttcttcaagtattcaacaatgccctcagcctccctcgggcccttgtattcctgaatgttcttgccctggttcctgaatatcttgagtgtcgggaaaccctggatctcatacttggtagcaagaggcttgttcttctcgtcgttggcatcaaccttggcaagaacaatcggtggatcgtgcttgcttagctcttgtgcagctttctcatactgaaacagatcaagcaaagaaaattaatacatgggatcaaaccatttaatccaaaatgtgaaaatgtgctgttaaggaagtgatccaactgtacagaagcatacctctggagcgagcttcttgcagtgtccacacctgcgaatagggtttatccaattagacacatttagaacaagcattggttaaattttgattcagataacacaatagcacgatgcacaagcataatttcataaagaatcaacattgaagtacaaaaacaaaataatagtgaataattgaaccaagactacaaagctatctggatttaaaacctgtgtaagtgaaagaacacccgaaattctcagttgcaaccctgatacagacaccttataactcgaaaaaccaagtaaccaactcactcaatctaaaccactgaaatctgactaggagaccaggcatacacatcacaaacaaggtaaatctactacaatttacagaatcggctcatccgcagtcacaggtccacgcacaatcgaatcggcgaatcctatccgaatctaagactggatcaccaagatcgagaccaacaaacgcatcaattcggcaaacaccgagcctcacacgcatcgccagcttccccaattcccgcatctgaactgaagtcctaaaccctccccaaacctcgcgatctaaatcccccccccccccaaaaacccacctcgcgagatctaacccaacacgcacagctcatcaacaggggggccgtagcagagcagagcagagcacactcaccacggggcgtagaactcgacgaccatgaacgggtgcttggcgacggcctcatcgaagccgtccgcgtcaagcgtcagcacggcctccgccgccgcatcgcccccctcctccgcagccgccgcctcctccgccctcgccgccggcgccgacagcaccacggcgagcgcgagcagcagcgagatccaagccttcgagatcgccatgaggaggagacggagagtgtgggtggctttcggaatttttccctgagacgacacgcttctcacacgggttttaatagggcggagtacgcgaggggggggtttaccggatcacgtggaccaagtccacatcgaccctgaaactgcccaccgggccccaccccgcggactccctcgtggacgcggcgcaccggagtcacgagatatttacaggtaacatttgcgatgaaccccctgtacttatcatcgtcaaatcatccctccacgaggctgagatgtgctaaaactagaggtaataaattactaatatgcccctgatgaggagtgatgtgtaattaagtggaattaggggggcgaaagtggggtggtcccgagggataaatccaatcctgtgacttcaaaaaaggcaggggaattaacgacggccaacgccacgtcaccgcgcgccccgactacgtacacgtacctgtacagccctcggccaatgggagggcgccacgtcagctctatgacatgtcccggagccctgatttgctccgcgcccccaccagcgccacgcaacgcacacgcttccaaaatccggatccgggtaaattaggcggcgtttttactgctctcggatacgataaaagctgtgtagtaaaataattctaatattggcctcgtgtcgcgcgtgattgctgacgcggcgctggatcgagctcgtttgcgttgcggcagtggtgacgtggcactgttgaactccgccacgtttcaccgggtggtcccgatcggatggctactgtttttctttttctttttttcaaatcgatgactgttttttttgctgcgacttattttaaacttgtcgatcacgagaatgtgttcacgttcacggtcatatagataagagacacattttattgtttcgagagacatttatagtcacagatggcagatccggcgatgggcgaatttatttcgcatcccacctcaaaattttacaccatatcacatcaaacgtttaaacacatatgtccacgagtgatactcgtagaccgaatatagagggtattggggtacgttggtacaaggatctacgtaatacgacatcaagcaaacagagaacgaggattatactggttcagaccccttgatagataatagccctaatccagttgatatgggattatatgatggaaaagacaggttataaagggaacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggcggtttccaagtagaactcggagacatcggaccctacacgatacattgacgacccagtctgtccgagtaggattctttccatctgtaaactccgtgaaggatttacttagttatgcgcagaatgtccatatacgcgcagacatgccatatcgatatgtgacgtatatcgaagggtaaagggtatacctaacccgtaaccttgacagtagcccccgacttctgcttaaatgaactcgtgtaaccaatcgcgacttctggtgtcgaggctgttgttgttctcggtgtgagaactgtggagacaggacatagccgagaacaccatgtgaagcccaacggtcatgagcgaatttaaactgaagtgagaaagactgccgcgcgtaacggaccaagaaatttccggcggtcatctctctcctttccttgaaatttgcaccgtcggaagtgcgtttatttaagagagttttggggatccattttgaagtctgcctgttgtgaagaaaccctccaacctccaagcgcttctcgtcttttccgctcccgcaaaaccctagctcatcaatctcagtcctttctccggcgatctccagtcagcgatggatctcggcaagtcctcctccaccagcgcgtcgctgaataagctacaggaggatggcgcccctcccggtcgtgggaccatggagagagaagaaggaggtactgaaccccagcttgtcctaggtcgcatggttgcgatcgaggactacattctctgcggttttctccctccgccttctgaatttcttctcttggttttgaacttctacggtctttctttgctccatttgaaccccaattctattgccttccttagtatttttttgcatctttgtgaggcctacattggggtagagccttttcttgatctctttcgcttctactacgagttgcgttggatgtagtccaacagggtatctggatgcgtcggattccgactccgggatggcctgaagtcgcgttatatccccttccagtgcccttcctctcatagcaaatggcggacgaggtggttctatcttcagatagaaaattcggatcctgtctttgttgttcctgaggaacaaccagacaagatttcgtcttggaccgcaaagcccaccttgaccccttcccttcagtccttcatcgatgttatcgacgatctccgagtacgaggtttgtcggggtatgaagtcgctgctgacttcgttggtagacggatccagtcgctccaggctcgagcccatctagcctttgactattctggaccggaggacacgacccaggtttctcctcggggtatctttcttgcatttaccctgacttgcttgtgtgcgcgttcctcctgacttatcgaactttggttctcgattcacaggtctgagcagcgaagccgtgggacgtcgtgtcggccaggtgatgatcagtggcccaacgatggcgagcaatgtccccgttctcctttgcgagaagggggcggccgaacgcgacgctgccatcaatgtaagtgtactcagtaggccttctgtgtttttcttccgggatcgccttatgacttcataaagcgtaggctctccctctgactgatatcatcgggccgctcatggaccatcaggtggcggtgtcactaaaagagaaggtcgccaaggaggcgtccgatgctgctgctgtcgctgccacaacaagtggtggcgacgttccaaaaaaggggaggaaattctcctctgtaatcggacatcgtcgaaaggcacctaccccctcggtaagttctcctgtcatttgatcacgtagtcagaatacttccaccccacatcatatcgattgtactccaagccttggacgcgtctcccctgcctccacgacggcagcggcttgtgacactcggcgagaagtgagtgaatgaatttgaggtttcgtgatttcgtcgaactttgtctgaaccacagccttcttgtagggcggcgcgggccaaggcggcgcaggacgggtctggagggacttccagcgcgtctcctgctgtagcctcgacggatgtcgtggtcgtgcccgggagccacgaggcgacaccaagcggcccagccagcgatctcgtggctggtcatggttcgccggctgccgtcctcacctgggaggagctccaggttgagatgtggcgcctcctcgaggctggtgctcgcggcattggccgcgagatcatggaggtgagagcggcggcggcgtcgtcgtcggcgaacgagcgcgccgaccggctggcacacgacttggcggaggctcgtgaggacctcaagaagatgaggaaactggtggccgggaatgagcgacaacggcaggggctcgagcaccgtatgtcggagctcgagaacaacttatcggaaatccgtggctcgttgcgggtcacctatactggtctgcaccagctcgccggggaatgcggtatcaagtctaccatccccgcgaatcccaatgagttctcgctgacgtcttctcttgcggagctggcggcggcgatggaggagattccctccaagcatgcggccaggatcggagaggagacgtccaacgggaactacaccggggcatgccacgtccttgcgtgtgtgaggctggcgcaccctgaactcgatctgcgggagatcttggaatagggggcggctagcgacgcgcataaggatgtgatggaagaagtcggtgatctgggggagtctgttctccccctttttgaagagtaggattttgactctcttgtactccttagacatgctgtataaaactccaattggctccaaccgcctttgtgcgtgcagtcatcaccttagtttgctttagcattttgatcttgagtactttttttgtcccttgtagagatgttgatgtcgaggatgtccagcagcgtgggcagcctgagtcgccagcgatcattccggctcttgcgtttgagccacacgcgtcgccggacgatgtagatcagattttacccgcgagaatggggatggcgatgacttccttaggttagtggtctcttcatccctttttgctcctccgacttgatcaaccgtgttctcgaaagaggagtgcagcttgacttagtcgtttccatattgaacagatctcgagagtgcgcttgctggcaagatcgtcgtatccaatattggaagatgaaatttgaagtagcggagctcgagagaactatgctggaagtaaagaaagagcaagctgtggaaacgctttgaggttgtgaggtatggttcaacttgtacttgaagagttgctgcacgtccatggccaaggtttgtagagagctccgagtaccccgtggagatcctgaggagtcggcggccggatacatatcgtggatgaatggggcgtgtactcagctcgaaggcgtcggcaaacgcattgacgaagccttgaagcaggaatgtcgtcgatcgagccgatatgccggagggcacgtgttggcttgcctacgagatcatcgtccgcgacaggacctcgagtttctccatgaaggttttgctcgttctcggagaactacggcggagatagaccacctggcaaagtcgatggcgccgttggcggagaaggtcttctagtctatggactggagttggccttcttggtagtctttgtaccctgtgatggatatcttagggaaaagtgtaatatagctttgaacttgtgtaaaattgtaaggggtattttgtgaaatagaaaagaaatctatcttaacaaatccttcttactctggatatcgtgtgtaagggtgtgttctcagttcacgactttagttagtcgtttgagtcgtacactctctctagcccccagccttgtcatcggaggatttttctcggaggataagcctcttggacctttgacctgccttggttgaataagcactgatcctagcccccagccgtgaagttggaaagtgaatttccgattacgcggcttggttaatacgcacggcgagaactcttacacgaccaggtcttacatggtctttcgtctctacaggatctgacaaggccttatcggctctgggcgtccccagtagaagatcccttaggttcatcggaggccttctcaagatgacgtaaagggacatggggataggtttcaacgctaggtgtcatcttgttaacaaccaaatttggtaacatcggcatcaggaaagaagattagatcgaagcaaagtcggaggcagagattgagttcggaaacaaagcaggaatcggctggagtccaaatcggatgcgattggcatcggctaggtctgagtcggactaggtaagccgatacagccgattccgacaatgcagcttgatgtatgatatcgggttggattgaggtgcttcaaggtgattgccgcacatggatagagtcctgagaagtcaattgtatctattaattagggtgttttatgtaatctccttagagatacgattgggcaaaagtctgccgcaaagacttgtggtatcctagagtttgataagatagtagtcgtgtctgttatggacatatcttgtgattctcgggtataaatagacccgagccctatgtaacttttaacacacacacacgttcaatacaatttcggcgcatcgccacccttttgctttagttttgtttcgatgagttcttgctttcaggttgagctgcatcggtttcgatcttcaacgagaggtaaaacttgttatgacggcttgtattctcgggattagtgcttccatctttatgacactctgatctcgtttatgtaattcatcgagttatcatatatcttacataatctccggcaataccgctatctaatctacaatcggctaacatctgtctgtagagggtagccgattaggttagatatcgatgttgacttagattatataaggtatccaccactctatgaaacttccagcgacttgattgtctagatattgttcttcttttcatacttaatgttgcatcagtcgagtttgatctattaagtcgtgcttagaatatcaatctctaacatgccttctggttgccaattagggtagcatcggagtttcagccgatcttatctgatctaactatatttgctctatatgcttcattgacatattaaatctgtcctttatgtcaagatattgctgtatctaagtatattagtcctttgtttaatatattatgtctgttttaatatcctgatatagagtagtattggagtattagccgatacatgctagatctatctgatcggctatgctataaacatatatagccctgttattaatatatatttcgatctaagtgatttatactgtctcggcatggcgaccgatctatcccaatcactcgatttaagtatatatcgatataagaactatatattggaaatatctacagccgatcgaatagatttagttctttattgtctatttacaactgccgatcgattcacatatgacatcggctcaaagataaatgttatgtcatcggcacctagccgatcggctatcatttatagatttaaccacggtttctttgcctttatttcttgttgattacgggatcaaatcaactggcacgctagtacacccgaaggcgagctttggacctacactggagttaagcagatctcccaggcctcgtgttttctgtcaacacatctgggtaagggatcatcgggtaggaacactttgattgtaatatgcgcctaaaaataggctccattgatactgtaaggtgtcttacaggtgtggatgacattgactcatacatagaatttacgtagttggtcaatattccaagagtttgccaactcgcgaccatcaccgtctgcaatttttaatgcgcctggccgcaaaacttgtgtgatcgtgtaaggtccttcccatttgggtgagagcttgtttcgccctacttggcattgaacccgtcggaggacatagtcgccgattgaaagtatgcgtgctcggatgcgctcctcgtggtagcggcggagagcctgttggtaactggctactcggacggcaactcgttcgcgatgttcctcgagtagattcacatcgacgtttcgctattcctcctgatcctcgtcggaatacttctgtactcgtgtactctgatgtcgtagctcgctggggagcatggcctcggagccgtacatgaggaagaagggtgtttccttgttagacgttgtcggtgtggtgcgtacggcccatagtactgatgggagttcttcgacccattttttgtcatgtgacatgaatctgttgtagacgcgggtcttgatccc

SEQ ID NO: 31986 - DNA, 7597 bp, Oryza sativa
tgcggttatcagtctgaatggcatcttaacatagcaaaacaccccgaacggcgtgatgaatgctgtcttctctccgtcctctttcgccatgctgattcggtggtagccagagtaagcgtcgaggaagctcaacagctcacagccggctgttgagtccaccagttgatctattcgaggaagagggaagtgatctttgggacacgccttgttgaggtcggtgaaatcgacgcacattctccatttctcgttggccttccgcaccatgactggattggctagccactctggatgaagtacctctctgatgaagccagctttgagaagtttgtcgagctcttctcgtatggcttgtttttggtctggtgcaaatcttcgcagtttttgctttactggcttggcatcgggtcgcaccatgagtttgtgctcaatcacctccctggggaccctcggcatgtcggacggttgccaagcgaacacgtcagcattgtcgcggaggaaggtgatgagcacgaattcctatttctcgcttagtgttgccccgatcttgacggtcttgtcagggttggcactagagagtggaacggtcttgatcgcgccgtccggtttcggcgtcttgtttgtcttgctcactttcttgggtggctcagttgtggcgggtgggctgggcatttgctcgaccatgtcgaggctccacttgtcgcattgtaccgccagctttgtgttcccttgaatagtgattgttcccttcggtcccggcatcttgagcacttgatacgcgtagtgggatgtggccatgaacttcgcaagtgcagttctcccgatgatggcattatacgctgtatcgaattcagcgacatcaaaggtgatctgctccattcggaagttgtttgcttggccgaaagtcacaggcaacgtaattttgcccaatggtttggacgaggattggggagtaattccatggaaggattgatcggtgggtgtcaactcgcttcgcgaaattcccatcgcgtccaaagcactggcgaagagaaggttgattgagctaccaccgtcgatgagaacccacgcaaccttgatgttccgaatagtgggttcgaccacgatcggatagcgtcctgggatgacggcagtcttgggatggtcttcttctgaaaattctatcttctgttcagaccacttcatcttgtgtgcagccccctgccatgtcgaacagacttcacgttccactttcttgtattctcgctttgaggagtacgctgtggaacctccgaaaatgtgtgaaacgtggaggttagagtctggatatgctgtgtccgattcctgaggagccacctccgcatccttctcgaccacgcgtactcgcttgcctttttcaaatgccatgtgcttctcgagcgactttttgaaaacaaggcaatcttccaaagaatgtctgtctatcttgtgtatggggcaccatgctttcttcgtgtcgctaccttgtgggtctgggcgcttgggagggttcgcgtattctgctgcgagaacttccgcttgagctttcattttcccacttttgcgatttttcttcttgcttgactcaggtgcgtccgtggctggtttcttctctcccccggtcttcggcttatcgttcttgcgtctcagtgcatcatctgcgtgggcgcatcgctcaacaatctcgaacaatctccgagtagttgtgatgcgtcttgcacaactcctgggtagtatagcgatctctgacaccagacttgaaggcgcaaattacagaagcatcggtgatttcggggattgtatttctgcactcgttgaagcgccgaacatattccctcaaggattcacccgagttctgtgtcaacgcatgtaggtcgtcttcgatcgcgtggcgcttgtaagttccttggaagttggcaatgaactgctggcacaggtctgcacacgaagagatcgagtagggcgggagatgcatcagccatgaacgtgcagagccttttaacgcagttggtaaataattcgccaatgcattgtcgtctgctctggcggcgtagagtactgtggagtagacttgaaggaactcttctgggtcggtgctcccatcgtacttctctattgctccgggtcggaatctctcaggccattggacatcacgcagggaacgactgaaagctctacacccagcgctgggggcggtgggttgtcggcgatcgtgtgtccttcatggatgtctgtctgatgatgaggatgaagaagaagacgacgatgacgatggatcgcttggttccggtgtaggattacgaggacgtcggctaggttctcgagaatcctttcgccgccctcggttgttgtcccggcgtcgatctccgtcgtcctcgtcattatggcggtgtccttgaccagtgtcaccctgcgtccgcctctcgcaatcatcgtgatcgtggcgatcgtggcgattaacacggtctcggtcttcgctcgagcggccctcccgtctttcattatcgcgatgtcgtgaagagacgcgatgccgggagcgatccccgttgtctcgtgtgcgtcgtgcctctcagcggccattgaggtggtcacggagatcgccggtgccgcgaggtggaggggtagctcgatggggtgactcccactattcgggattttcgccattggcaccgccagttggtggctattccgggtgtgctgcatcagcggcttcttcgaacgcgttgctgaggttggttactgattcccgtagctgttctgtccactgtgcgagatcatcgtttagaacgggatcgtaaggggtctccctcagtattgcgttgatggtcctgatgtgctaggccggtgtagccacttgattttgtgcttccgcattagcgtgtgctgacgtgctggtcccgtcgatagctaatacctcgcgcggcgtactcgctttgatgagccatagtcctcgagtagatgcaggactgatggttcgggtgaactgatgtcgattatgccaacgaatcgatctgaaaccagcgtcgttccttgttccttgtcttcatctctaagggatatgcctaactgctggaccttaggggatgacgtcatcgtggcgctgagaaagaccttgcagcttgagaggtcgtgattctttgtcttgtgaataggacaatagacatcacaggttggagaaatacgctgaattccacgctctttgcaggcgcgaatttcggcgcggacgttgagaaaaacccaacaggcgtgcaaagtgtgtttcctggttttgtggataggacaccaggaccttgtcgcttcggaagttattctcgtcggctcgtggctcttgtctgaacgacaaggtttggccgcattagaatccttctcgagctcggatgtcgtcaatgttctgttctccgcttcggcgggaggatccttcgacagggagtcgtcctgggttgtatccactgcgttctcatttccggtcattgatggaccagctgagatcggcatcgtggtataaaccgggaagacgatttcgccgacttgagtccacaccagcattgttgaagtaggaaatccctggtggaggttggtgttgacgccgttgtcaacgaaactggatgacatagtagtagaaccttgagcaccaagtccccctacctggcgcgccactgtcgacgagtgatacccgtagaccggatatagagggtattggggtacgttggtacaaggatctatgtaatacgacatcaagcaaacagagaacgaggattatactggttcaggccccttgataggtaatagccctaatccagttgatatgagattatatgatggaaaacacaggttacaaagggtacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggtggtttccaagtagaactcggagacatcgaaacctacacgatacattgacgacccagtcttgtccgagtaggattcttttcatctgtaaactccgtgaaggatttccttagttatgcggagaatgtccatatacgcgcagacatgccatatcgatatgtgacgtatatcgaaaggtaaagggtatacctaacccgtaaccctgacaacatacatgaaatattaaatatatgctaaaataataactaattgcacagattgcgactaatttgcgagatgaatctttttatcctaattactacattatttgacaatgtggtgctacagtaaacatttgctaataacggatttattaggcttaataaattcgtctcacaccctatataatactcaatgtgacacgccaaaactttacacccctggatctaaacaccccctcaaatttgaacaatgtaagagtagtactccttcccaaaatataagaatttagaactggatcggacattttctaatactacgaatttggacagcacgtcccatccagttctaggtttttatattttgggacggagggagtacatggcatgaagcatgatgcgtgtgaaatggaagaaaaaggatttggtacaattgctttcagaaagaattgttgcacagagttgatcttgcacatggtaagtcaatctttgcacggacgttgcttctatggaagaaccttgtgtgtacttcttacttggagaaaacaacttcttcaaaccaatcctgacttgtacgtagttcttcaaaccttacaacgtgcaggtccattcgattagggatgagctaagaggttaggcatatgatgtgaaaaaaaatcggatgtacacattgcgcgcgcagtagaaggaggggatggaaaaaagacgattgcacttttacaacagtagagactagagaaaatacgaagtatcacttaaacactttcaagacatgtgaaatcattctattgtcctcttctagcttcaattcatgttttcaaaaaaacttttagtcaggtcgccttgtccaattgttttcggtacaagaaatgacgacatatttatgtgcaaaccacatatacaattcagacgaacacagggatgattcatcttttgttctcttccccaacgacttcacatgaatcatatgcctttgtaccagctatatatgacttgctttttatattgagaataagcattattctcatatctccttttccttttctttttcaggtttgtcctcgtacaattgtaatgtccaaaggactggaaaagtgcagtaacagaaaggtgcttcacaaactgaaaagttgaaagccatgtcactgcactacgtctgacaaaagaacaacagctataggtatttggcatttttattggctactctataaaaaaagcacattaatatttgtgtcaaagaatttaatttctacccaagatttataggcagagggcatgtagctccacataatggagctcagatgatcaaatacataattacatagtccttactacatggagtctaaagaaatatatatatatccaagtagtgcagcatcatgcacggccactacttattagaaataaaatgaagtgaataaagatatgcttctgatgatgccaccggcgtgaaccgagcaatctttcatgcagattttcgcctccacctactcccacgcacgcacgcaatgagcaatagttggttgctgacttgatccgagctttgacaaattcagtttggaactttggatgaatctgcaattctgacgacaaaagggaagggaaggacaaaaaggttttactttaatcttctttcactcaatgtctaaagtgattttcagagacatacaatgggctttatatctttcttttactcaacatctaaaatgatattcagagacaacacaatgggcgaagacctgtatttatctctgctctgaaagactgaaacagtctctgctccagctacgaagactgtatacttgctggtcatacagatccaggatgtgtattatttgcaaattcatcagaaagcatgactcaaccatcacacacactcacacgtaccatctgtcatctctttcgatgatatcattcaacagggtgacaaactgaaaacaaagaattgcaagaaagattggaatgaacacaacaggatgacccaggtatgatgatgattacagaaaactttcaggaagataagcgagccaaacatagaaattgggagataaaacattgttgcatgattcacaggttctcaaaatgattaacggcatacaaacaacacgaagatctagagcttcaaatactacttcattgtagaatggaaaaaagaacagtactcgccctgacctgagttgaggatagaaattgttacaatcgaggatagaacagtactcgccctgcacctaaattgttacatgcttgtcggaggatgcctggtacatgcatctacgattttgacgagaagaaatgatatttagacatagtactatatcatcgtaattgatgtccttgttgcctgctccagttcttcaaactcagcgcctagcgcttcgcttcctgctcttctttcggctgcccttgtcatcagaatcactgtcagatgcagatgcagattcggagtcagattcagacgatgctgatgatgaggtttcccttctgtgcctcctcttctgctgcttcctttgggtcgccgcttcttgtcctccgagtctgaggagctgtagcttgagctacttccagaagaatattcagagccggtaactgatgattcactgtcagagtcaaatacagaagcctcactactatctgaatcactccgtgaacggtattttctcttgcttttccgtttgcttttctcagacttctccttcttcaactttgctttcatcagcttcctttcctcttccttttccttctcaagatcaggattctggaactgataggaaacaggagcagccgtcttcttcagcttggggttcttgagctgctgtgtcctcgagggccgcgaaatgtagacccgttcgttcttgcactcgtatgtccagtgcccaggctgaaaacacttctggcactgggtatatgcgccaccagaagaagaagaagtttgcgcagcttttggtttcactcccagtatcacagccttctctgtactcatcagatacatctgtctcttggcctccttcctctcctgccagcgcgaaggtccctcttctttctgcccataagcattgacattgcgggcagcggctgcagcagctcgctcggcttgagttctgctcaatcccttggcagcagataaggcctgtgcttttattctctcagctgcagcctgagacttatcgtcatttccagacatcttgggctcacccaacaagaatcaaatcatacaaaatcagcaatattatgatcctgtaaggaaaccaaaatacatcaatagagtaatttgggtaatgaaaaataacgcaaacaataaataagctttctgctataccaaaatcaacacattgatgcaggaaaaaaaatctggcacataatatttttcgttgctataagaacaacatctacttatca

SEQ ID NO: 31987 - DNA, 15243 bp, Oryza sativa
ctggaccccccccccccccccaaaactttattccgtaacaaactgctgctattagtgctagggttagggcaaattaagagaaaagcttccagatctaggagaagagaagctagggtttaggcgaagacagatggtgcgggggtaggaaggtgcgtgtgggttggtgctcaccggcggcgaggatgcttgcggcggaaggaggcagcaggtccgcctcggctgctcgccgagttcgatggagatcggcgcaggcgaggcggcgggcgaactcacgaggaaaagagagagagagagagagagagaggagcgggtcagaatcgggagaggtgaacgggtcgggatgtgggggcgagcgatgatacgtgggccgttaatgggccgatcactatgtcggtcagtgatgggctgatctttatgtgggccggtgatgggcccatgaagtaaataatgatttgtactgatcctaacagggtaaatttacggtgatattagacaaccatgcaaagttttattgtgagatataaaacgaagaaaattagaaaaaagaaaaaacagaaacaatgtttttattttaagattctttaattttattatgcataaacggagttgaggttgtttatttacatcctacctacatgctctgtgtgattctttcagaacttctatataaaaaaatttccacaagttcctgatttttgaacatgcgtgcaaattagagtataataaaattattatttcttgatatcatatgatatagaagtaccccgcaaaaaaaaatgatatagaagtatatttatttgagatccattgccataaatggtcccaatacggaacccatttctgtttctcagaagcatgagcccttaccccaccctagcagaaaacacatacaccattctcagttttgtcaagattttggaggtctattacctgcagcgagactgaattctacccgggaaatacttttttttttatttattaaacacgcgaaactactataaccataaaactgacagctttcaaaggccatgtacagttttctccacactgaaaaaacagtaaagttacaccacttcaaattgcaacctgaactatgaatattgctgccaaatggagtaatatatacagcaaaggaaagtaggagcatgaatggaaaaggaaaaaaaatgtggcaaaggttccaaaaaaaaaaacatcctgactacacaacacacaacccattatgatcatgactgaatgtatctgatatctgtgaattctaactgtcgaatgcacaataacaccttgcacaccaagtaattcccaaggtaatgaaatccagactgaaactcttatttgatggtatatatcatctctaaagccgctaaacctgtaaagccaaatagcttggcaactcctcaaagtgcttccctagcacccattggtcagcgagtcctgcggctgttggctggtttagatggagaagacggtttgttcttagcgaaatcgacaagatccttgaaaagagaatcttcaggtttggtctgccgtgatgcggtcggaactgatgaacctctctcattctcggtattcctctgattaagcgaaaggccttctgtttggctcaccagtccattgtacccggcaccgttgttaccactaggaaggccgtgctgttgctcgaagtactgctgtctttggccataccttgctggaggtggcggtaaggaacctggagcttgcgcttcccatggagcttttggaagatcttcaccggagtctccatacttgttagcatttgaagacgaagaaaaaccagggatagctgttgggtttataaaatcatcatcaggtagactctcctgcctattgacagcaggacgatttgactcgctcataggacgagaaggcatagagaagctgggtgctgcagttgggtttatgaagtcatcagacacactttctgaccggctatcataacttggcggcggattcgtttctgtttttgaatgagacggcgcaggtatattggctggggcagttggattaataaagtcatctgatactttttctgtcttgtaggagtcgccactaagatagtcaacactgcttgcctccgtgaaaactggcctctttgatgatggtggcggaggaagaagtgggcttgggtaaggcctttcactttttggagcagaaggtagattgccctgtgctgctgtgccatcccttgcagacctacagaacatatatttgtacatcagatgacaaacctaaccagaccgggaatcttggtatcataacatgatccgcatcaccaaaacattttcttaaaagcagtcagctgatgttgccacaaccatccaaagcttaaaatagcaatagcatgtatgaaaaataattagtaaagggtactaatagggaaaactaatatagcttgcctgcgggaaagaacagagaactcgtcttctggctcatcgtcttcatggtgcacattaagaagtggggaaaatgaaaccccagtaggcctaggaggggctgttcctcggtttacattagcagcagcaggagctgggcctgaaccgggaggcactccctttgcgatgtcatcatgacgctgaagaacacgctgcagttcatcatttaaaccgagagcttgaaatagaaggctctcatcactgcagaggatacaagacaatatgtcacatgacaatgtgaaaaggacatggaaccaaaatttcagagtaaaagaatagaacatacccagtattgctaacaaggtccatgactcgaccttgataagatcggcactgcccaacaaggtcaacaatgacctcctccctcacaccctacaacatgaagcgcaattagacagaaatttagagaaaaagagcataggtgggtggaatggtggattcaatagttaaatacagagacgcatagagacatcacactagtgcaagtttggtcataataaattaaaatattagggcacattatttttagccagataccagagcaagttctagaaaatacaaaagcttagaaatccctctttaattattcttatgccctcagtctcctatgctgctaaacatgattccctctgaacaaatggaccaagtaaaatagttcgcacattcctgtaagctgatgaggtaacatggatgaacaaagatataaatggatattggataatatactagacttcaaagcctagcaagaaactactttgtcatccattacacatagatctgatcaatgatgggacatgtaatagttacatcctcttctgtgcacaattcacagatacagctcagctcactacatgtgaaatatgctgtagtatgatcatatgaaataaaacacatgatttatgcataatttttttcatgggaaaaacaaaggtctagaagacatgacaatcatattaaagctcttaaaagtaaaagaaactacagaagagatacaaggattatacaacactgcactaaattttgatgcttaaaaaagtcacctcagggtgcctgtggtccaaagcatttaacatctcatccaacacatccacaattcctcgagcactctgaatctcacttagactgtaatgcacaaggagcaagaattaaaggtggattataactaaagaatttcttctgcaaagatggtgaaataaattgataaacacaattgaagtattcaggtattgtttagcatgattatgaaactaaactgtcacaaggcaataagtagaatctattttggcacactgacaccgccatattttgttgttagaaataccactataagtatgaaattcttggaaagttgcatggccctagttctatgaatgtcttgcctgtaaggctgtaacagggagacaaacaaaattactattaatgtaatgcatcataattactttctagtatgctttagagttcaggaatgaggacaaccaaggatagcggcaactgcaaccatcagtaccgaaggttccaactttagatcagagatggcgtacttcaagaaagcaattaatcactgaccacttttttcccccaaaatacttgacactccatagttgctaccaggtatttttccaatatcacacctggtgggcccaaccggaggttcagcttttttttttttttttttgcccctcaaaactactaatgtgttctcagtgactaggaaaaaacaagaaagatctggagcctgatagcctatatgcaccgtgaaccttctttccgtactctccagttgtgctgagcggcaagtcctcagggttggagccttggaggcacacaaatcgtccagaagcaacttggacactgctttctgctgtctgatgcacaatttcagcagaatagagatactttaatccaggagcattttcgaaatttaactaggaaacattttatagccttgggaagtttgcttggctaatgggtgtcatctatagaggaacagagggagcagaacatattgtgagtacgattccactcctaaaacatgcctagccatttaatgtggttgtaggctgatcagtatttctgataggaacatgtgtttgaaacttttcccccacaagtgtgaatttacaaaccaggccatgcttgttccaaccaaagtaggttattctaaagagaatgggaaaaatagaacaaagcaaggcataaagaaacagcaaaagtaaatggcattaagaaactatggatgaatatgacagtactgcttgaagtgaacaagtaaataaggaacaaattttgcattagaacaaaagaacacctcaaggcaggtgcagaaggggcgctagattgaagagaagcttgtatcgctgcatcttcatagctttgacctggaggtggatatagatgtggttgcctcaatggttgagtttgaggaggtgtaaacagtggaaccgtgttctcctcacgaggtggaaaatcaacaccagcattctgcacacaagggcaggatatcttgttcatggtttggacagaaacagaagcaattgaatattaactcaaaagtaaaaacgttgaagatctaagtttacattgaaacaaagtgcagaacagattgaagttgagtggaacagtagtcaagtatgagctgtgatagcacaggataaataacagatgagaaaactggaatgaacacaagtagacagtaccctgagttcttggtaagcagcgtgatactggggatatctgccagatgcacctccaaaagccacttgccatgtgtcaatcaaactcaatattttctcccgaacatttaaatctggctgaaatcataaattggcaatcaaatacagaagcataagaatgtaggaactataggaataagtcttggctggttggtcttggtcttgtggtgccttttcctgcttttcagctttctaggacagcatctctactttcagtttggatgctctaggacagttaggacagcagtttgttgagatgctctaggacaatatgttgagatgctctaggacagtttgttgggatgctctaggacagtatgttgagatgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtagccattgaagttctaacatctggtatcagagccacactttcctgtaggctaaacatctcttgttccaccccttcccaagctcggttgagctctcagccaccaccagcagcagcaacaccggctgctcctccttcccctttcccttccccctctccacgcagcagccccccggaggtgcgccatgtccgacgttcggtctcggcgttcggtcgtctcgagcactcggcgtcagcaggacgccgagctcgccgcagcagaagagcgcaggcgagcaacggctcagaccgctgcagcagcagcgagggcggccagactggcggcagcagagttggcagcagccagggcggaggcagaagcagaggcggcggaagatgcggcacgtgcggcggaggtagaggttgagaccttgcgcagcagcatcaacggctccatcgccggcgacatcaccgccgacagggagcttgaggagcttgcaagaggtagggcacgggagcgggcagagcggtgggcagcagcccacctccacggcggcggcggcggcccaagggaccgcgcgcccgccgacgggaacccagacgggcgcgggcgtgccggcggcagcccggagcccgcgcgcggccctcgcaggcagcgtggctctccctcccctgaccggcaccatggccaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggcgacgtcgactacgacgaggatcggcgggcactggatgccctcatcgctgcagtcccgcccgagatgcagttctcgctttcccagaagcggactgccaaggaggcctgggacgccatcgctgcggcacgcatcggcagcgatcgcgcccacaagtcaacactgcaggcactccgcaaggagtgggagaacctggccttcaagccaggtgaggatgttgatgactttgccctccgtctccacactcttttgcagaagatggtgcagtacggcgacgacacctacgacgaggagagagctgtcgagaagctctttcgctgcgtcccagagaagtacaagcagatcgctcgctcgattgagtctttgctggacctctccacgatgtcgatcgaggaggcgttaggtcgcctaaaggtcgtcgacggcgatgagccacagcctctctcggggcctatcaccattggcgggaagctccatctcactcgggagcagtgggaggccagccagagtaacgggaggaagggggagtcccctccctcgacaggcggccgcaagccgcgcaaggcgcgcggaggcgtccagctgcggtgggcgcgaagacgcgccgagggtggcgctcgcagaggtgcccagggcgacgccgctggcaaccacaagccggcacgagacgacgcctgccgcaactgtggcaagcttggccattgggccaaagactgtcgacagccacgacgcggccaggcccacgtcgcacaggtggaggaaaagccggctctgctcctagcacacgccagcatcgagctatcttcagcggcaccggccgcaacggctttcctccacctcgaggagccgaaggtacacgccttcctcggcaacagctccagcaacgacaaggctgatgggtggtacctcgacaccggcgccacccatcatatgactggccggcgggagttcttcaccgagcttgactccagcgtccgaggctccgtcaagtttggggatgcctccggcgtggagatcaagggcgtcggctccgtcaccttcaccaccaagtccggtgagcacaggctgctcaccggagtctactacatccccgcgttgagaaactctatcatcagcgtgggacagctggatgagaacggctcaagcgtgttggtcgagcacggagtcatgaggatttgggatcgccgccgtcgccttcttgccaaggtaaccagaggcactaatcgactctacatcctcagcgcgcaggtcgcacaaccagtttgcctcgccgctcgtcgagacggcgaggcgtggcagtggcacgagcgtttcgggcaccttcactttgaggccctgaagcggctcagcgccaaggagatggtgcgaggcctgccgtgccttgaccacgtggagcagctctgcgacgtctgcgtcctaacgaagcagaggcggctcccctttccccagcagacgagtttccgagccaaggagcggctcgagctcatgcacggggacttgtgtggcccagtgacaccggccacaccaggaggacgacgttacttcctgctgctcgtcgacgacctctcccgctacatgtgggtgatggtcctcggcagcaagggagaggctgcggacaccatccggcgcgcgcaggctgctgcagaggcggagtgcggccgcaagctacgcgtactgcgcaccgacaacggcggcgaattcacggcggctgaattcgcgtcgtactgcgctgatgagggcattcagcgccactacaccgcgccgtacagcccgcagcagaacggcgtcgtcgagcggcgcaaccagacggttgtggggatggctcgggctctcctcaagcagagggggatgccggccatcttctggggagaggcggtggtgacggccgtctacatcctcaaccgctcgcctaccaaggccctcgatggcaggacaccgtacgaggcttggcatgggcgcaagccaggggtctcccacctgcgggtcttcggctgcctcgcgttcgtcaaggagcttggccccatcagcaagctcgatgacaggagcaccccaggggtgttcatcggctacgcggagggctcgaaggcctatcgcatcctcgacccggagacacagcgtgtgcgcacagcgcacgacgtagtgttcgactaagggcgagggtgggtatgggacaagacggtggacgatggttcgactctgacgtacgacgacttcaccgtcgagtatgtccacttcgagagagctgggggagtaggcagctcttcttcaccaagcgtgtctaccccagtccccgagcctccatcgactccgacaccaacacaccctcgggccacggcttcgactgcgacgagctcttcgccgacaccaccacagccggcaaccccacgcgccccagcaccaacagccactcctccgagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggtgaccagcccgtgccaggaatggtgcctcgcgacctggaggcgcagttgcaccttgcgtgcgacgacggtgagcctcggtctttcgcagaggccgagaaacacgcggcatggcgtgccgcgatgcagtcggagatggacgcggttcaggagaaccgcacctgggagcttgttgatctccctcgtggtcaccgcgcgatcacccttaagtgggtgttcaagttgaagagggataaagccggagccatcgtcaagcacaaggctcgcttggtggcacgcggtttcgtgcagcaggaggggatcgactacgacgatgccttcgctcccgtggcacggatggagtccgtgcgactccttgcgctggctgctcaggaaggctggggcgtccatcacatggacgtcaagtcggcgtttctgaacggcgacttgaaggaggaggtctacgtgtaccagccgccgggattcgtgatccccggcaaggagggaaggtgctacgcctgcacaaggcactctatggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcaaggaggagatgaaggccaccttccagatgagtgatctgggcctctctccttctacctggggatccaggtgtaccaggacgactccggaatcacgcttcggcagaccgcctacgccaagcgcgtcgttgagctggctgggctcaccgattgcaacccagctctcactccgatggaggagagactgaagctgagccgcgacagcacggcggaggaagtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacattgacaccagcaagagcacgagcgggattctcttcttcctcggcgagtgcctcgttagctggcagtcaatcaagcagcaggtggtggccctgtccagctgcgaggccgagtacatggtggcatccgccgcttcgacccaggcgctctggcttgctcgactgcttagtgatctcctcggcagagatactggagcggtggagctcagggtggatagccagtccgctctggccctggcaaagaaccccgtttttcacgaacggagcaagcacatccgggtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggctcaactttcccacaagacgacgcacaagacttagggggagaatgtaggaataagtcttggctggttggtcttggtcttgtggtgccttttcctgcttttcagctttctaggacagcatctctactttcagtttgaatgctctaggacagttaggacagcagtttgttgagatgctctaggacagtttgttgggatgctctgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtaaccattgaagttctaacaggaactaggaaagcaatagttggccactgaatgtgagtataatcctcacctttttctttactatcttaaccatttcacttaatatgtctcgctcaatgatttgctggtaaacaacatccccacagtttttgcttagagtctctagcacctgaaaaggaagacaaacaaacagaacaaatcagcacattaaacaagacatgactgtgcacatagaaactatgctctttgtttcctaaatctggaggaagcacaagaagtttccaaaatctggaagaagaacaagaaataacttctaaatttgtgtagctagtgaagacaggtgaattcttaaatttaggaatgaatcgacctaaaactcacattgttaaaacaaaaaaatcagaagataacacactgagtatcaatatacaaggactcttgaaatactcacataaagcgtcagaatttgcacttttgaattcttgtttcccaggcgtttctttaggagcttgagtgtatccttggcttgtctgtacttcagcaaacatttatgagcatgctataaaacatgacaaaccaaaagttgtatggggacattgaaaataaatcccagaaagtatttaagacgaaacaattatgtcaacaattcaatatacaaaactcattatgcaatgtgcatcactcaaccatgaaccgaattatcaacaaattatagcaaaatgtcttaaattagtgtggcatcacatacacagattttaatgttagcaaatgccacagattataaaatgtaatcactgcctggagagacatataaaccatattggaagttggaagactaaaagttattgaagctatatatcacaccaacgtacagcagagtagagaaacaaagttttttttttctctcgaacacgcaggagagttgcatatcattatattaagataaaagagttaaaaaggactcatgcatgcccataacgggaacaaaggctataagaactttccaaagaaacaacaaaaaactacaccatgacttagcttcatctctaacatcctgcatgacggaattgaaattagctgaaacctctccaaagacacatccacctatgtttccaaatcaaccaagccaccaacacaactaatgagttaaaacccttgcgatgttgcttagccactttctgcaaagcttaaagccaccacatggtgaaaacagtgtcatcgggaccttatctaaggtgctgcaagccaaccaaggacaaaactgagaaccatacacttcttgtgaacacacataaagtgagcaagtgctgcacattctcctccttttgattacacaatggatattgccaagatggtcaacactgcgatgggccaatcggtcagcagtccaacaacgatttagcgaggctaaccacacaaaaaaattgccaaaaggccaaagctcaagttttccaaacttccttccacggctcaaataacatgcccctgatgagttttttttttggtgtgtgtgctctcattgctgatatcatcatggcaaaaagtgatgtcatacctaaactgcacctcaacaacaaatgacaccaactcatcaccaaaatcaggggcctccatgagattatagctcaactaaccaatcacaaactatcatcaattattgagttattctgctctccaaaccaacaaccgtacaacctaagattccaaattcctaataaatttggaagaaaaagactgaatatgcttttccaaaaaaatacaaaacatatagcaatagacacagaacaaactagccaaaatcacagattcaatgccttatagaagcagcactaaaaccctgctaaatttaacgattttataaacaagcctaggttaaacgagatacaacaagcaagcaagatcacaacacataaaatgtcagagatgccacgataaccctactaaatcactcacgggttgaacaacatagagaactacctaggaattctccatcctaccatatgatagcaataacaattacaaacaaatcaaagaacctaaacaaaaagtctcgaacagaggcatcatcgagagagagaagccagacccgggatccatgttgatgatgtcgcagagctcgatgttcaccgcccaatccggcccgatcagcatgtcgctcgtcgccctctccgcgcacgccacggccgtcgccattttccccctctcaccaccaaaaaccctaaatcctgcaaacaacaacaaaaacaaaccacccaaatcagcccccaaattcccacctttccgcacctccccaacgcccccaacccgaatccgccccccaaaaacacatcttccaccccgcaagaacccgagcccctcaccgaatctgagcgacctcctccccaagattcggcgccaagaagcaccaaggcggcctcttttcaccgatccggaggtcctggccgcgcctgggacggggaggagagggagagatgcgagcgaactgtaggattggaggaatttcggtggctcggcttggaggaggagatgaggaggaaggagaaaggttggagaggagggtggtagactagactaggcaggcagcaggaaagaaggaaggaggaagagaagggaacgcggccgtagactttttctttgtttagttttcttggtgtgaaagtgagggcctgcaaaattatattttgtggtgctagtttggaattgtgagaaaagtgggatatcaaagtactccattcgtcctatattagattgtgagtttttacttgtaatgtttaactactcgtcttattcaaaaaaattttaaaattatttttattttatttgtgacttactttattatctacggtactttaagcataattttttgtcttttatatttgcaaaaaaaaattaaataagacaagtggtcaaacgttgcaagtaaaaactcaaaattccttatatagtgggacggagtaatactgtcatctagcagccccatcatttggaataagccaaacgacattttaacgaataaaacatgatttataaataaacttttatatatatgtgttcttaacaatttaaaagcaatggctgaaaaataaacttagatgaaaaaacctcaaaccaattataaattcaaggttgaaaatttgaattttagctactaagtattagtataagcgaaaaaatgagactatgatgactgatgaggataggatcgatttttctttatattagatcttgaattttttttacatgggtaaattatgtattttggaaaatatatagttatgttgtgaacttctttgatgtcatgaaaaatatctttttttagaaactctcaacggttgggggtacatactagatagatttctactatcggaaaaaatacattcttatcaacacaaagggtcattaagtaggatctttgcatgaatgcttactaagtaagcaagttctacattttggttgcgtatatggttgatatgaagttacataaaagtgcaatgtgaaaaccctggatgaaataattatataacatatcctatgtaagtcattttcactcattaattatattatccttgtgagtctattttctacacattcacttttttttcttccatttctcataaaaatatcaacacactatttaccattagcactaggcgactttgttcctcttgctacttctcttataaggagagataggggatatttacatgattaaatgtgcttgttaatatgtcatcgtatgaaatagttgcgacattttttgttttgcttgcagtgatagacttggggcattacttctctgttgcatacttttcacaaacaataggaacatttcaaacttttagagaaagtatctcatgttttttagagcatcaaattgttcattgtgtcaaatttatatattactcgaatacacaagccaaaacaattggttttatgtacatggctagaaaattatactccatccatttccaaataactgacaattggcactattcattttaaaccgtgaccattcgtctttctcatttaaaaagtataactgaaaaagcagaggaacaataatcggcaggaatgcaagtacaaaaataaaagattatagaacacagtaaatacaaaaaatgatagtttgattagaccgcgagaaaaactcaccaatcggataagagacgtaagctcaaaggaaatttttcaacaagtttgagttcttactaat

SEQ ID NO: 31988 - DNA, 2932 bp, Oryza sativa
caaattaaaaacctaaacggttaaaatccaccctttttgcaaggggctaaattccacttagctccacacatcgcattaccaaacattaattcacatgaaaagcaactccatcggctcaactaatctgttctttccgttccattacatatgaactaatattgatcaaggctaaaaagcaggctatatttttatcttacattaatttgtttgtagtaggtatcatgcgaagcaaaactatagtatacatatgctcatgggacgctaggaattgcacattgacctaaaaaatattttaagcctgaatctctattgagatcttgtcattgattatttggggccatttggttgaaacacagcacaactttgtcaagaaaggcaattcataaaagcaaaagtaaacaagtgaactggcgcgtcatcatccacaaatctctgttttaacttttaattagtacgtaactaacaaaaaccaaagaaattattacattaggacatgtacagacagaggaatagtacaagagatgtgagactttcagaaagtacaggaaatgtgttgcaaataaaagatctcagtgccaatgcagggtgtttgtcctctgtatttttatgcattcctttccctctctaaataatctctgtgtgtgtgagccagtcatagtggtgcacattgcacttttcactggtgtcatatcgtttcatgcatcttgcactgattttatgtatgcaaagttggtgtttttgcatcattgcatgagctccttttgcatgctgatgcttgttgtataagcagatcactacagaagctttatatcctcttcctggatgtagcccacttcttcatttgcatcatgttctaatcttcagcacctccatttttgcttttgtttttcttgaagaaaccatagcacccaattctctttctgcacaaaacaaaagaatgggtttgttagatcattttctgaattagatatgttctagtagtccctagtgggaagatgatgattagaattgctattgctgaattaatagcacaataggtcatcaaaaggacataaagcatttgtgcaatgattaggattcaggtgacaagaagccggccttaattaagcttttggaaaaggaaacaaaaccacttgggagaagaaaaaaagaaataaaaggaaagtagccaacatgaagaaagatcctacaaataatttgtctgatcataaattggatgtatgaatgattggagtccatgtggcatccaactgtggccaaatctattcaagaccctacaaatatgtcatactagtctgaaatagtctatctgatgacctatttttaaggataactagtgcaacccacaatattgattactaatgtgatgctaaaaacaaaaaattacaaacaacaagttgaacatatatactccttaaacaagcgcaaccattgacaaacaacggccatatatagaattttctgaaactgagaaaccaaacattgtctgaaactcatcacaaattcagaagccaaactaggagtgaacaaaagactatgtcaagtcatgccccatttgccaagaagactttataggtagaatagattgactgctaattaagttagattgtgatgaaacaagatggacttgaagctatgactctcactagccgtgttgaccaatctgcctccaaacttgatggcttcacactaacttactcaacggggcagtgtaaattgttgggttgtttttagcagcctaagctgaacaattttttcacacttgacgtatttgctgacagagctatactttgatccagtctattaccatctccagactttgaattttgtatgtggttatgtgtgagctcttgacctcagatttttggaatttttcaaaaagttatcttctagaactacttatttgtctcattcatctgttggaaaaatgggttcttgggatggaactgctagctggcaggaaaacgtttaatggcagaaaatcttcagcatatggtggaaatacattcatattattattgttgtttttcatttaatgttgaattcacctttcttatttgtgagggaaaactctataaaaatggagattaaagtgtactgactgctatgtgcgagctattgacaaacagtaggattttcaaaaaggttaacttctagaacaactgttttctccttcatttttggggaaaacaagttttctcaggatacaaaactactaattggctggaaaaaaataatggtggaaaatcttcagcacataatagaaataattcctatattatttattgtttagtatcaaaataacttttcttatttgtgagggaaaactctacaaaaatggagattaaagtgtggtcattgtttcttaattttcaatattttaaattgcgattctgatctcaagcgattcacaaagaacccaacacaatctaacagaatcaagaagagcataattttttccccaaactacaactaaataagttccatcaacctaagttagcaaactctgttctccaacttttttaaaaacaaacagattttgaaataagacaccattcctaaaacccaaccaaactcccattcgagaataataaaaaagagatatgcaaaaaaaaaaagatccaatgaaactaaactttacatctagaaactgaaataatgcacaattagcaagtctaaaataatttacctgctcctgctcctggttgtttgagccttcgggttgccgccgccatggccatttccgatgctgctgctgctgctgcttccatggccgccgctgctagtgctgttggtgctgctcgtcctgctgctggtgccggcctcgctgaactcgccgcccttgctccaccactcctcctcctgcagctgcgcctcctgcttcttcttcttcttccccttcgtcttgttcttcttgccgccggcggcggcg

SEQ ID NO: 31989 - DNA, 4776 bp, Oryza sativa
ccttccctcgccgccatcgggttccccagcgggctccgcatcctaaccctctcgaactcccctcctcccccacccaccgccgacgccgacgacccctggaagttgaactccagccgccgctgccccgacggcggcatcggcatcatcccgacgccgagagagagagagagaggttggaagagagatggagagggagaggaaggtgtaataatggcgatgtggaggaggaggcgaggaggcggagggggagaagaagaggagagaagaggagaggagggaaagcgatggcgggtgggtgcaagcaagcaaggtcgttggtgagagatttaaaagcgggatttaaatttggagggagtacattacatacaaagctttaaataataataattaaattataaacaaactacactgtactttgtgtatatacggcgtggcgccgaactgtacatcacagcaaagctgctgtacatctccgtcaggtccataccgtggattcgtggagccattgggttcggaatcatctatcataatatcattatcgttacgtgatcttaactttatattatcccgcacgacagtgtttataaaagtagtgtcattatggtagataatgtgaacccgatggactaatggtagtatcttcacctcccgcacgtaaaacgaagggatctattatggtattactaattaagtattagttaaaataaactttaaaaatagattaatatgttttgttaaaacaactttcctatgtaattcttttttaaaagactattgtttagtatgtttggaaaacgtgcgcgtgaaaaacgaaggagtataggttgggagttgtgagtgacaaactcagcctaaaatcttcataaacccgagacaatggctactgttcacacctctcgtattaatatgtaagatgtgtgcagtggtgaaatggtgatgtgttcgctaccatgtgtgatcacgtctgagtcggatgacgcataattcgtgatatattaaaattttgttattatgttaatagatggcggtgtaagtgattggtaattaatgcgagtgattaaaataaaccaagggtacatgacatgagtgttgaaatgtttgctagcttgattgttgcaatggcgtttaatcggtgttgtaggatccaggggggtgaatggttggtatacccaaaaaccgaaaacttttagtggaaataaaagttaccctcgaaatcgacggaagtcggtctgaccgagattgatctgccggtctgaccgaagcgtagccgccggtctgactggtgttgatcttccggttggaccgccctggaatccctgctgcgcctgttgtcgtccccggtctgaccgaaggtcacccgccggtttgaccgccgccttgccgccggtctgaccgccgatgtgtcgccggttagaccgccgaaacccggtgaaacataaattgaagaattctaaaagtagatgacgactttattgattctctctgtatttacgaagtgcacaaacagcactccttacagaaatttcgactaaactcaaaaccctaactcaaaactcaactcaattgctttcaaaagcgataccgggaagcctcatgctccccctctatttatacccgaggcaggcaggaaccaaactcatactaggagtcctaaacaccttagaaaaccctttagtacaagaaagaaactttacataaccaatcgtaccaaatttggactccttccaaattcgactccgcatcccatacacacacaatacctccatcgtatgccatatggaatctccatcaaccacgtgcatcaactctagcctaagtatcccgcataatctctgaccaccacggacgtcgtcttatccccaagccgactcccggtccatcaccgcaaatactctcccgagacatcgagtcacctacacatgaaataaataaagaaaccatattccgagaccaagctatctccaacttgactcattagtagcaaacaacagtattacatacgtatagtatccatctagaagccataatcatgaaataatcacggatatccaaacaaacaacccgaaagcgaaactgacacagtgtcggccggtcagaccgcgggctggccggtccaaccgctcgattaccgccggtctgaccggcatacacagcccggtctgatcggtcacatgaaataatgaatcctgcgatcacctgtgaatccaatcatctccaaaccacttcatgaataaattccaaataacaaaaccaataatctccaatgcccaattattcatcacagaataataataaaaaacacctttgattttacaagtgtgagtgctttactttgttgtaacaggaatgctaaaaaaataggatcctgtttctcctaacccctcaagctggggtctggggaggcatgtgctaccgccggtaggtccggccgatgagccactaggcaccattggtgtagcctcctacttatcctcatctttacctcaactcaacttcggttgccatgggccacctcctttatgttctctcacgtcgctagtagtggtttgtgtgtgcccacacgagacacgaccataggtctaccaggtgtaccactgcctccatcgttgtacgataataccacataccccgcgttgatgttacatggttgtccgatgataagtaagatctatatggtggaactaactaaaccttcacaaactcaagacagtggccacggttcacacataacaaaaatatgtgagatatgtgcggtggtgaaccggtaacgtgttcgttaccacatgttaaaacgtctgagtcggacgaggtgtgttttatgtagaactcataataagaaattttcttattatgtattctacatgtcagctgtacggttcttttttcatttgccacgtgttaatgtaattctatgaactagttagtacgtggcaaataggtggcggttttggtgattgataattaatgcgagtgattaagaaaacctaagggtacacttggatttattgagtgttgaaatgtttgcttgcttgttggtggttaatcatcagtgtgagtgctttactttgttttaaacgtgatagtataaaattgtgccattttcatgacagaggaactgttcctatccattatatttcgtgcagcccctaattgttgtgatactttagttcattctgaaatgtgatacccatgctatataaatatggcattttcatgacgctgaaactgtactgatcgatcgattgtgttcagcccctaattgacacagcatgcaattaacagctcgatgaaagcgattcagtgtttataatttgcagcatagttcagtagccatccagatgtctggcacgtgcttagaccgatggagaaaaaactgacatgatggttgctacatgtcttgagctgttacatctcacaaccactaaataatccgtggttaatcaaaatactactgctgcctttgttccataatatatatcactgtcaaacatgacacgatgtctaaaactaccttttaacttttagtttcttacacacactataagatgtagcaacaaaaatcataacgatagaaaaagtaaattcaaatatcaattgaacaatattatttcttaaaaaataaaatttaatttgtattagactaattttcagtcgaatatttaatgagttaaatctttataaatctgtgacagagagagtagcactcgtacctatctcagattaagcaagacatcaactaaattattataatctgtaacttgtagtattagatctctcttaagtttatagaatataatctcaaggattacgagactaatattttggatgattagaatagaattttagtggcacagtaatcagtcaattttcttgttcctttttgtctgtcactgcatgcacaaattgcacatataaatgaacagtatgagagagataggagactttgcaggggggtcaggaagtcatgggtttctagatgttggtgataatttgcaggtggttgaggagccactggggactctagaatgaaatgacttttgaaaaacgggtacaaatattttcccgtgggggacgacaaggcttctctttcgatgggattctaccttttctttggtttcaattcacagcgattgtagtgcttttttttatgtaaaagaggaaagaaaggttttattatttatgcggacgagatgtctttatatgttttctcactgactagcggaccgatgcaaatctatgttgaatttttaggtcaatgttttcgttttcggaggatcgatgttgggtgaattataagattttttataaagaattatgtcggtaaagctgttgatgcatgcttggagtagaacttgttaatcagctgtctgattgtaatttgcattcctcagctccttttcttagttttgtcttctcaacactcaattcaccatctagaacaatcatgcgcacgcatggttgcggtacattaatataagttgaaaattaatactagttcaattttgttcagaaaaaaaggatagaagaaatgttgcttcaattactatgacgatatcaatctgccacagaagacagaatctacacgtcgttttcagatatggttaaactattccacagcacaaaactttgaaatattcagatacaagtacaattaaaacaactgaatatatatatatcttgagtgtctcattttcaatgaacaaatcgtcagatattcattattagatacagatacaggtcttcagaagatatcaaaagcgaaatattatattatgg

SEQ ID NO: 31990 - DNA, 649 bp, Oryza sativa
ttaatttcagaactaattttagaatgaaaaaactaatttcagaactcgcttggaaaccgcgagacgaatcttttgagactaattaagccgtcattagcacatgtgggttactgtagcacttatggctaatcatggactaattaggcttgaaagattcatcttgcgatttcctccataactatgcaattagtttttctttttatctatatttaatgctttatacatgtgtccaaatattcaatgtgatgtttttggaaaaaaaatttggaactaaacgggcccatagtctcgcgcgcgcgcacacacgaacacacttagtacacgaagtagtagcttgtatgcttaccccgactaagctgctgatgtcataattaggtttgcaaatggcaatgacgtcaggatgacatgtcacatgtcgcttgtgggcatatgcatgcgagtgtgggcggaatataatgcttgtccaactagagcccttccagaaagctacaatttcaggactaattctataaaaaatgatgaaagaaattactattttttttagggtttgtttaaatggatgccattttaaactataccattttaatagagttggtaaatatatgcatccatttagtttcttgccaaactttggtaaatacataagaaa

SEQ ID NO: 31991 - DNA, 2734 bp, Oryza sativa
  unsure (1)..(2734): unsure at all n locations
nnnnnnnnnnnnnnnnnnnnnnnnnnnnnnattaaggacctaggagtatgacttatacgctccacccgaggggtagtctacagacggtctagtaccagataagactctgagtaaaacttgcttgcacaagacttgcaattcaaggcgtggtccattgttcaagttgtgagtaagtgtagcttggagttctaggtggatattcaaccttaatcggtcttcatcgaaccgctagtatataaatagtacattggaaaaggcaaatctcagtgggattttgagatttggtgagggattgttggaattaatagatgggctaaggcccattcgaagattagttctttggaaaattacaaaagcccacctcatgggatggcatgcatgtggagtttagtaccaccttgcttattctaggagagggggacctctttaaaagggaggatgccctcctagccacttgaagcatgtgtggtgggagaagaggggaaacacgcgcgcgcgcgcgctcactcgcctggcctggcagtgcaggcggcgcgcgtgcacggcgtacgcgtcgaatggtccacaaaattggctcctcacccttgcgcagatgcagcctccttttgcagttttgttttgctgcaggaaattcagatttgttttgttttggaaacattccgaaaaatccggtgcgtgaaaatggcgtggagtccggataagttacgcgcgacttatctggttcggtttacgcgggcgccctgatcaagcgacctaactctatacaaaccgagccgccgccttcacgcaacatacgcgaactcaatctagggtttgcctcctactctgtactgcatcgtggctcgtagactactccatcccgctcgccggcgtgcatcggcgatcaggagagcaggtctccggaacctctaccttcgacgtcctacaccgggagaaggcggcaataaggtttttgggaagcgcttcgcgcgactgctccatgttcgtccgtgacggctcgccttcctctccgctcgcgtgttgcgcgccttcatcgacgcccgcaaccgcgagtagttcctgccgagcaaccggtctttccgccacttttgtacgtgttcgatatgttacgcatatttgatctgttcatgttttactgcttagtttacatgtgtagatctaatgatatgatcatgctagtttacatctggaatatcatgatttatttatggaataaattaaatcattatgtgcttataatttcaacaatatcgaggttgataaagtcatcgtaggtaaaaaaaagaatggtaagcaagaaatatgagctttgatgtgctttgatatgcaattttttttctacttatgttttagtaatttcactgttgacacacccatgttgcagagtgagttgatgggaaactaaactttctacctgaggacatcccgaatgtatacgtagttctcgtggacaacattacgcttcttgagaaattcgcgtgacacttcctacaaattaaaatgttcagctaatgatgcacatatgtaaaacttgttagttttgttaaccctagatcaattccattaagtgtatctttctaccctttattcctctgtttctttttccggtgccactcccactacataatgaggctaaatgatatagatctatttatatacttcactttaagatatatgtgtactatgtagcatatcatatctgtttccgctacataattcacttatataagtctaagaacatagcagttcctagcacgtatgtgcgagcttatggatgattataatgtacattaatttcaatattatcatgtgagttaacggtttacataactaattctgtaagcaatcctagctattttaccttgtgttgatccagattaattcatgtatgtacatataaatgtaacaaggtatatctcagtacatttttctactttgttctagcttcaacacctcgattgagtattaatttctctaagttaaattatcagtgttcgtgaacgcgcaaaaggttaaattccagtgttaattattttccgtcacatacatcacaattaagttcttaatttccgcattgggtcaaataattaccacataaaaattcaacagaactctaattagattattatgctactttacaacacaatcgttgtcacttatcagtgattcgatcgagccatatataactatatatacagagcgctaaatatgtcctcctcaataattagctagccacgacaattcgccgcaaatatgttaccaagtcatctcaatttggtaattactaatgattaaattcattttccatgttacatcagcgcatcagctagcatatacaagttggcttaggaagaatacaaaactggaactatatatgatcaagaggtcgatcaaatggcgtcacactcaggatcatttttcagacgatgtgcaagcttaattatttgatgactagaagtctagctagaaccacaccaatcgcaaaatgattgaagcattaaaatatagtaagttactaactactctctccgccccacgatacaaaggattttgagtttttgcttgcaacgtttgaccactcgtcttattcaaactttttttgcaaatataaaaaacaaaaagttgtgcttaaagtactgtagataataaagtaagtcacaaataaaataaataataatttcaaaattttttgaataagacgagtggtcaaacattgcaaacaaaaactcaaatt

SEQ ID NO: 31992 - DNA, 13958 bp, Oryza sativa
tatgggacggagggagtacatgctctctctaagtagataatacttcactttaaaaaaaaattgtgatcgctatattctattataatatatataaatatcaatcaacaaatgaatttattgaagtatattttaagattaaaatgtagatatgcatggtcttcatatttttaagatagatattttaaagattatttatcatcacattttctaaattttgttaacaattttatttaaaatgcgaagtactatcaatttgagaggagcaagtatcgattttttttcacgaacttgcaaaatgattgcacatcagtatattatattactccatctatcccaaagtaagtgtagtttgcattgtttatgtctaacgtataaccgttcattttatttaatgtttttatgattaatatttttattgttattaaatgataaaacataaatagtactttatgtgtgactaattttttaaatctttttaataaattttttaaataaaacggacggtcaaacgttagatataatatagatatttatagttatatttattttagaacggaggtagtagaagaaattgagttttgttcacaacgtaagataccaaaccgcaatcgttgccggttacaaggaaatgggatctaggcatctagcggaatagaaaacaaacagcaggagcaagttacaagtatctacgtatcactcaggtttaggtttataaagtgggtggtcctatatagaactccctttatattttaatatatgatattgttatcttttttactaacgtttaatcgttcgttttatttaaattttgtgtgtaaatataaaaatattcatatcaaacttaaagaacatttgatgataaatcaagtcacaataaaataaatgataattatataattttttaataaaataaatgatcaaacgttgtaaaaaagtcaacaacgttatatattaaaatatggatgtagcatttccagagaaaagcgcgtagactacgtggaagaccatccgtgctcctcgttgcaagtcttgtcaaaacttttttaagtagatattagcatctagtcgtagataattaattaagctgggcctgggaagcttcgaaaaaaatggctgcacttggaaagtttgcgtggttagtggccgcccatatcactatatcatcagtgccgatatagtacatcgaaaagggcaaaatcggtcgaaaaaaaacaatgtgcgaaaaggtgcaaacagaggacgaccgtacaccctatatatcgtcagtatcaataatatagccgacatgcttggatggtaattagactagccacgcctcttattacttaacaattggttaggttagtgcatattgtgtgatggtaggccataggcactaggcagcggcacggcatagaaaatacagaaatatgtaaagtatttttggcacgaagtctattggtcatgtaaaaaaaccaatcctatctataaatctagacacatatatatccagattcatatctagaattaagaattatttttttcggagggtgtagaagtactcatgctgctgatcaatattctctgattggttaacctatgagtcggctatgactaataacccgtagatatattgaatgaagcgatatggcacaatcatcattttgtttatactggttacataccacaatagcttattaacaacaaagaaataatttacaaataaaacttacatgcacgctcttatcaatttgagaacaaatgctgaaaaataaaccacgtaaaggaaaaaaaaaggctaaaatcaaatctaaaatatggttttaaaatctaaattttagctgcggcttgtaagctaaagggtaaacaatgtgaccttaacattttactggtaaaagttttatgcatgttaatttgtggtttagaaaataaggcagaaaaacattccacgataaaaccctagaaattaagttttaaatttaaattttagttgtacctgataatctaataaacagatgataaagatcacacttcaaccgtgaataccgatgttgcgtgtcagcttaatcacttttacccccatagtgccaaggcaagatatatggtactgactacagtaacattgtcgaatcatatcacaacacatacaaacatgcagacattatatgggcagcatccagcatattggcaaccctacacgtacaaggaaaggtatatatcaccttatctagatgtccctctttgtgcaaagccatattcattcactccaatcattatacctaatatttccactacaagtaaaggcaaatactccctctgttttcattggtcagccacctagctcaccttcataactcaaaatagctagactcctggtagcgatcagaggaccccgtgaaatgttagtacaacacatcgaggtacgtggaggaaacatgaaaataattgacacagtggagacacatgatatggttctagaagataagatgagtaatgggagtgatcgatcatcgatccacagttacacttttttttttcgaacacgcaaaaaatttacacattaatatattagaagaaaaatagtttttattacacaacgcaattggctagacagacctatgccgttgttacactagcacattctttcttcataagcgagatgagtatatttctacataacaacaattttagaactctaaacatgcaatgtaatagttatatcattagaattcaatagcaattacttcgctaaagcgtaatatctactcactccatcaaaaaaaactcaatctagaagtggatgtgatccctcctaaagcaacgaatctggaaaaaggtagtacatatttattgtcctagtaggagtcatattttctcgtagttgagtgtttttttttgaacggagaaagtatagctattcgttttggtatagcgtaataacggtcaaagtgtgatcatgctcagtcaaactaccaaaatgttgaggacaggagatcggggttatccagcaaaaccaaccaataaaatcgcagcttgctcgatcgatcacatgcatggacagtgcagaggtgtcccgggcgagtcaaggaatttcccttctgggtccagacacccgcgtccacgccatgcccgggggcaggccggtttccatccaaatggtgtggattcgttcggtcgtcgatctcgtccccgccggcctacggccgggggtgagcccccatgtgccgtgctcggacctgcctctccgagactctgatctccaggtctctcctcgtttgcatgccggtgcggttagctgctgcgtctcccatctcccgaaaacggcgaattgtcccgttccagtctctccttgtttgtccatctgcccctcatgtgtcgcggctgttggtggcaaacccccttggcttcatctacgtacactacccaagggattttcctgtaccacctgaaaaaaatactgtagcaacagggtgtcttgctccttttttatttttttttacctctgttcccctgaaagaaatgaggggaatgtgatagttggtctctggatgataatctagtttgcttaattattacgagtgtttccacgtttatgttcatgtttcgtcttttccgtcggagatgagaatgcttttagatctatgtatggatcttgtttggattgatacctaaggacatatataaaggtagaatctaatatgagctatctatattaattaatatcactagagactatccttttacaatggtagaaacaataaaatttctaaatcattattgcactaaatatttttttattatacttctttccttttctccaacctcatgcaacaaactttccgttaataaatactaagaatcgattctgagctgttgtcatgcgtagcaacgatgtttctcttttcttccctcttattcttccaggtcataaaatttacttgcatgacaacaaagagagtccgttattggacaccatagtacatgctctaaattctaaggaagggttaggagtaatttaacttcgtttttttctcatgtcgaaggagattgtcagtctcatttttgtctaaacaagatctatgaaataagggctaaattgaaagaagaacggttttcctactttccagttgtagtgcgcaaacgcgcaatctatcaggtggttattcatgtcaaacatttttgactagttgtcgtatcccaaagtagaaacgagtagctttgctttgaaaaattttcagctactgcgtcaaacattggataagtggaattcttccttactgtctagactttgagcgaatggaaaacgttgaataagatggaagagtcgtgtacaccttatcaagtgaatgagtcatatcggtggttgacatgggtatgtcgggtgattttctctttatcctcgtcctattagtcaacattttcgaaagatttcgcgaactaggtattgaaatgaaacgtacacatatatgctaagattaggggtggatctaggaaaaaaaattagagaggctcaattatagagtttcttcaacctccaatcatttagggacctttagtttattatttatggtgaaaaaaaatcaaagaggtgctcacgggggtatccatgaatcttgtgggtgtaggggggatccacgtcgaatcagcccctggctaagattgtgatgaatacatcaagatgactagggtcgagtttagttccaaactttttcttcaaatttccaacttttccatcacatcaaaacttttttacacgagcaattctacggtccttgaggaagtaccatgaggtaccaaaattttagtgtaaaatttggtacctcatagcacataggtaccaagaggtaccaaatttacaatagaaaaaatggtacctcatggtacctcctcaaagaccgtaaaattgctctttttacacacacaaacttccaactttttcgtcacatcgttccgatttcaaccaaactttcagttttagcgtgaactaaacacactctggtagtacagttctatgggacaaattaacaattgatatataagccctggcatcatatattgatgccacaaaagaacatagcgataaaacaaaccatgacactaaacagtccgattaataatctccagcacacctgaacactgataccaaacgaacagctttttttttcttttaccaagatagtgtgaacacaaagtaagctaaccccgaatgacaatgtacagtcccaagttacaggcttccagagctggtaagtagcagcagtaccactgcatggcttcccaaatcaccaggcccggggttttcatgtcctggcggtaagcgtggttatcgcgtagtaaccgtaataaatcgtacgaaaccatataaaattttaaaatattttttaaatttatttaaatttaaggagattactgaggtttttcttttatcgtaccccgcggtaaccgcgatcacagtttaggaaaccctttgcaaaaaaaaaaaaaaaaaaaaaaaaaactcactgccacttgcttcaagtgctccgctgcgttctacatcagctcacgcagatcagctttcaatatcatcatcacatacacttattaaccaaataatgtactacggagtactcactaccgagcacattaaccaaaaagtctccgtttgacattgcagtagccttacaaaatcaactgtgtgtgccgctatcattcggaagcatttctcggagcattaaaggctagattttatatctcctaaccaattgggactactccaatattccagtcaccctagggccatgtttagttcacctctaactaccctcaacttccaactttccatcacatcaaaactttcctacacaaataaacttctaattttttttccaaactaccaacttttctctaaacttctaactttttgcagaaactaaacacagcctagatgaaagagaaaacagccgaaatcgaatgacctgttcactttgatgctattttcgaccatagcattttttggtaaaattatctaaaaaatatctacgtttagtttgttgccaaatttagtaaatatataataaatcatgtcaaaattttagcaatattatcatcttgtaaaaagtttagcaatactaaaattgataaagtttattttggctacaatataaaaatgccctaaatcaacgagctaaagatcgcccggcacgtgatcccgccgcgagccgatcgagtcatcgagctcccaaccagaccgtgcagggcgcaactggccgtcccggcctcccaactccaaagtcaattcgcctacactcgccgcggcgatttccttgatcaacgactagtggtcatcactgccgtcaattcgctcgccatccatccccatcatgtgggcacgccgccgcccgccgcggacggcaaacacaacagcatcattaacaacttagcattaactaccacgttacgtcaagcccggagacctccgcgttattactacgagtatttatgtgctatatactcctcctctctcaatcccctcggtcgcatgcaatacggagcagatgggggttaaaaaacgccattggcccaagtggtttcgctgcaacggttttgacttttatatgacagcggcggcgaaaacacgcgatggatggatgcgaccgagcccaaatgtgggagtggtagtcgtgaactacaagtggtgggcactagcttttattgacgagcaataatactttccataggttacaacaactgggagaaattcagtgtcgggggaaaactgaaaattcccagtgaaaaatacgggatcgatccgatgccggctgatggaatggatcgatatgtgatcatccgagaccatcgggcatgcacgcctcgatccgaggaaaaaaaaatggcgccaaaagattacaagaaacgaaaggaatctgctactgctgctactagtatagtgtactgtgacgtagtaatgtactagtatgtgctactactggtaatagtaatggacatggtgtggttttgttcttggcgattatctctcggccttccggtcggcgatggacggggtgaggcggagcgcccacttgatggcgagcgggcagctgacgctcctgacggggacggcggcgcggcggagggcggcgttgtcgccgccgccggtggcggagtcgacgaacgacctgaggcgctgcatggcgacgtcgagggtcttggccgacatgttggcgaagcagacgcggaaccagccgggctcgcggcagtggcacgacgacccgggggagatgttgaggccgacctcgaacaccaccttcttccagagctccatctcgccggcgaacgaccggctccgcatcaggtggctcatgtccacccagcagaagaggccggcgttgctgggcaggcacccaatgccgatctccctgagcccgtccacgagctggtcgtgccgctccttgatccgccgcttgttctccgcgacgtagctccgggtgaagtccctgtcgccgagcagcgccgcgaggaggtactgcgtctgggacgacacgaggccgaagctggacatcttggtcgccgcggacacgacggcggcgttggcggagtagatggcgccgacgcggaaccccgggaggccgaggtccttggacaggctgtacacgacgtgcacgcggtcggacacgtcagcgccgccgccgtcgcgcccggccacgacctcgagcgcgctgacgaagcccgcgggcggctcggcgaacgccgtgccggcgtagatctcgtcgctgatgaggtggatgcccttggcggcgacgaagtcgacgatcgtctcgaggtcggcgcgcggcgacgcggtgccgagcgggttggacgggttggtgatcagcacccccttgacgcgcagccggcgcttctgcgcgcggcggtacgcgtcgtccagcgcggggcgcgtcacccggaacccgttcgcgctcgcgcagtgcacgggtacgatctccgcgccggtgcgccacttgaggtcgcggtcgaacctgcatccacccatccatccaccgttagccatgcgccaccatgcacgttgtcgcgtatggtaaaaaggtgtagcagcagcggcagtgccagtgcgtaccctgggtagtatggggtggggatgaggaaggcgtcgccgtggtcggcgaggcagaacatgagcgcctcgttagccgaggtggcgccggcggtgagcacgatgttgctggggtcgaacaccaccttgtaccctctctgctccgacatgaaccgcgccaatgcctgtgcaatccacgtgcgcatatgctcggggggttagccaactgtaacttttgacgaccgtgtacgcgaaccagagtacagttgatttaattaattacatttttgaaagccgggaggccgtggtagtcctggaacagcgcgagctcgcggaagacggaggcgccgccgccctctcgccggaggccgagcgcgtgggggttcttctccagccactcctcaagcaggtcgaacgacagctgcaacagccaaggcagagcaaccatgtcgtcagagacagtgtacacacatgtacaagtgtgtacatgcaggtgtggcacgcgcgtgtgcgtacctggttctcggcgaggcccatctggatgatgccggaagggttggagacggggtcgaacgggtttttctcgtactcctgccaccccaggaagtaggacgagtcctggccgtggctgttgcacccggccttcttggacagcagctgcggcttctcctcggcgaccacttggctcaccatctccaactctccttttttctctctctaacagccgatcgaatcaatccgcttgatgagtcggagcaaaaatctgtgagagctagtgtatagctcgaagaacactggagagacctgagctgctgctgctgctgagtaggagtagctagctagctggctgctgctgggtgcctcccaaggttggacgagctgcttatatagaatctggtgaggagagagagagagagagagagagagagagagagagagagcggctagtgctgtgatgtgatgcgagtgacgtttttcttttttttccttctgcttttgctttttgttaatttctcgggggctaatggaagctcgctctaaccgcgtgtagtacgcgactgccagtgtgcttagcgtcagtgaggggagaggttaacgtcgggacagcagcagagtgaggtgttactgcacgccgacagggatgccatgccatgccatcgttctcctcctcgtcgtcgtctacggggatggggttgttaaacgcgaacgaattaagaagcttctccttctgctgctgctgctgctgcttcgaattcgacccgtgagcaggggatcgtgcgttccgtgttgcttgccggctgggcgagcttaactttgctcttgctggggccggcctggccgatgctcggtgtcgtgctcgtgcatgctgctgccgaaagggcttctcgcgccgctccaattttgcggccgagtaatatgttacgctgcttctttttcatccaacagtggaacacgtccatgctatacaatgacatctgtaacaacattgtttgtttccttgggtatttatatgtgctttacagttaatggctgtgcatatggttttcaggaacaaaaataaatggctgtgtgcatcgtccagcacatgggctccacgcttgttcagatgtgccctgtggcgccggccgtgggctctgtagtctgttcctctgttaattgttagtattactgacatcataaaaatgaaatcatttgcatttggagcaacgattctctgttttggatagcaacaggtggtagcagttccaactctggctgatgtacgtacgtaagtatgttctctctcctgttgaggtacaatatgtatttcttccttctctcctttttatccccaggtcgcacaaaagtagatggcgatgatacagtggcaactttgatacaaatctcagaaaagtagatgacgatgataccgtgacaactctgttggatagtactttgcatcaaggctgaattatctgtaaactccacgtatggtggcgcagtattagatcctgaggataagttgtgggcaaagccccttttattcctgatgagagcaggtggatgtagacaagtagcgccgactattcagaaaacggagtccgtatcagaggaggggacgatacgaaaatggcagcctgctaccgagtgctctcttataccttaccagatgcttccttccttagcccgtagcgtttgttcctttgccttttcttttagtttcaaccattctagtttttcagaaatgaaaaagaaaagatccggccaatcagcacaggcctcgtggctgtgttatgatgatgggcaggtccattcaggtgtggactcttgttggttgctcaactcgggctgtgtttttgactatttgcactcgtcttcagaatgtttatcccatcctcatgtgttggatcaccagaatatttttgaaatggacgaagtacttaattaactgacagtttaattggtctgaccaattattagtagacgtgagataaataagtaccaccatgccacttgacacccaaaagaaaatctctattagaaatggagtgcatatcactatccattttctccctggtatgaggcccaaaggtagcaaaaattgggataagagccataggcacattgccaatgaggaacaaaagggttacaggtatgcaactggattatattcaaatcattgcaagatctattcaaatcaaccatgcaaatttacaatgtcacttcatgctttattggcatgagtaggatctaactgtagggatttttctttttcatactaagtttagtttgaagcaagagggcaatagggcatcatagtttgtctgcacatatgacagaagtaaaattagattcccacatacaagtagatacttgctcactcaattattctgcaatcgggcattggctgttttattaggtaagacttttctttagtcgatagtgcataattcaattaatgtcaagttgcatctcagcaatttttttccttatttaatgttgccaaattgtccctcgtagccaatcaaatctatccgtccggttcagtacatccatggcagaggagagaatgaaaattaataatcgcggcaaatttaaaaaagagagaaattagtatagcggtgcaaacagagaaaatacaaatttattttaaccaacaaattaaatgaagtgattaaaaatgaaaaattgcaccaaacaagtattcccacctctttttagtactccttccatttcatattataagttgtttatctttttctagtctagtgtctttaggtttgtttatagaaaaaaaattaacaatatctaccccactaaattagtttcattacgtatagcattcaatatattatggtaatatgtttttttagaaaataatattatattttttataaacttggacaaacttaaaaaatgtttgactagaaaaaaagtcaaaacaatttataatttaaaacagtaagagtaattgacaaggttgattttaatactcaaatttgttcaaaaatattttatgttgttctgttcttgtgttttttatggagaaaaactcgggaatgtatgacttaaggccatgtttagtttttctaaaatggcaaaaattttgctgtgttggagcattttttaccaaaatggatttaaacacggcaatttggcatttatcatttggtagtatagagtagtaaattttactaaaaaagtgtgttgggagccgtgctctctctatctttactattaaaatgacaaaactttaccatacatctaaatacgaactagcaaaacttaaatgccaaatcttttgccaaaaaaatttgccactagaccggataccgttatgtcattccttaaatattttatattattcttattcatctgccttctgcggagattctttttgttttgcatcgtactactttcatagttctgcataactcatgctacttacgaagatgccttttaaaattaaaattttatgtgataaatgtttaaaggatagtattaacaaagaataatttggctcggagaaaatgtaatagtagtatgagatgttatttctatatgaaaaataagactatccatcatttattcttgaagtgtcattatgcaaaaatttttttgaagagcaatacatatttctctggtttgtattcttcacatagtatatctcatatattagaaattgacttgtgggtattgataaaaaaaaccagcaaacttattctcgtaggagcatccgttgggctttatgattgagcagaaattatatagtttttgacaaatcatcatttatatcttatatgcatgttcttctcagggcaatgtactgactccggttctggtctcaattataaaagtgtgacgatgataccaggcaaacaaaaattgcatgtcacgaacttgagtaaaaggtaatgcagtttttcgccaacttcaaatgaagattcatatacaggattcaacaattaagaggtttatttaggtgttggcgatcattaatttgtgtttgcttcagtttatctaggtgtgttttataagacttgttgatgtgccattattattgagtgaatttgtgtaatatttagatataactcgttgagcaaaataccagaattttatttcattatcttaaaaaaacagtcaaagttggtataacttgttcaacgctgtcagttttaaaaacggggataaggtatctcagatcttgtgctctactgctctctcattggagcaaagaggttaaagaaaagcttcgagatcccccaaaaaggatcatgctcatgtcctcgtataactttataatgacatcgtgacagaaaccaaatgctactactacccaaaaaaaaaaaaaagagcatagaggtggggctcaacatgcttcatgcgagtttatggtgtttgtacagtagtgtacagctacctgggcacctagcaaagggcagaaatccgttgacggccacaagttttgcgatggcaaagctcattggtttgaaggtgcactaatgcacaaaatccaggattcgtagctaaaagacagcgattgaccagcagcgagtccactgccagcggggatactatacgaagttgtttgggacatgattgtcttaattgggcggtgctttgtttaagttaatctatcttttgtcgcttcacgtagtatttttaatgcaataaaaggctcccttcacatttcgtctttgatctttaatcatcatcgatgacccaagatcacacctaatggaggcggtggatgctctttggttggaatctgatggagagttggagagtggagacgaccctgttcaatttaatatctccaatgtttgcacatatcatgtacggaatgcataccctaccaaatgctgctatttacacaaaaccccggatactatgatttatgtttaatttgtaaaaacccacatgaactttaacatgtactcccttcttctcaaattaattatcatataagattatgcaccaaaaataaggacaatttaagtcacattaatcaagacaccatgcacattcttccgcaatgcatgcatcaattaaaaccccataccaattacaccctagcatgtgcatattctcccatactgcattaattgtattccgatggaatccgtatccatatagttatatggtgatcaatttgagaaattttgaattatattacatgatgatcaatttgggaaggaggtagtatcacataaccacgagtatttaggtgttaagctcttattaaaccgtaatgttaatcaatccatcttattactgtagcaaaataaaaattaatccacgtagaatactacaacatttatacgacaaacttaaaaaaaagctatatatttcagatataattttggaacttataagtattatatatttaaaaaataatagtggtagtgtggttttataaaattaaaaa

SEQ ID NO: 31993 - DNA, 3798 bp, Oryza sativa
ggggcgtgggcgacgacgtcttctcttgctagttgctactgatccgtgctcgtaatcgtacgtactgcccgtttggtcgggtacatgtacatgtactagtacgtgacatcttgcaatccctaaaagacttttttttttggaagaaccaaaagatagtgaactgcatgagtggaatcctataggatagttaacttgaatctgcaaacatcttaccaccaatcgggagattcagagtttcattatatgcagatgttgttgccctttctgtcacccctacatacttaaatcttttcgcttctgtaagtgggatgcacatttatttgcaacactcaaaagtttctgtaatttgctgatggatataatatcactattataggacatcctttaaaattaataatttgcctgagaacattttcggttcgattggagagaaaaattctttaaaaagacaagaatgcccctatgaccaaaatcttttaacctatagtgctggagtgaagatgaaatatgatgcatattctaatctatttgaaaattttatctctctaacagatcgaaagtgtcctataacatattactatttgtttatgtcttttagccatcacacgtttttacaatattcactagtaaattacataatctttgagtgacctatagcaaaaattgtctttaaaaaaaagagagatatacccaatctcctgcaatgaactaaatgtagaggcacgctttacaaattttcctggaaaggtatcaacattgtcatgcaaatatctagtacattatcaaccactgactataaaggtatcaacattgtcattgcctctgactataaaaagctgaaaaaacgattatcaaccactttttgacaagtttggcttcaaattagctggatggttaggtcgcttcttcacatcgtctagcagaaagacgctagtaaaatcagttcttaatgtcccgcctctctgataccgggtccacttacatctggcagcttttataggttataaactgctctcacaaactaacacaaatcttttctgcacactttgtcctcactcgtgcgcacttgggaagaatttcctgatcggtcgcccatcccaaatctgctccaagctaagcatgcttaaccttagagttctttcgagatcggcttccggaaaagaagttgcaacttgttgatatgagtattctattaatcctattaatccctgggccgggatgtcacagcaagagaataggctggattagaggatcctttctttggagaagtgatgacccacaaaatgtcagtggaggccacttcttgattaattggttccaatggaaagatcccgaaaaaccatgagtttatgaatattccctgtgataaaatagacaaaactttttaatgcctgcaccttgatcaccgcaagagatggagagaaaattaaattatggaatgattactggctgcagaacaaaagaccaaatgaaatagctccatctcttttcaagatctcaaaaagaaaaaaacaggagacaaacaatgtttggctctccacactcacagtcacatccagcattgaggagataaaccaacttgtgactaggaggcctcctacaacaagttaccttggatccaaatattcaagatgacaaatgtggaaagggactaccaatggagaatattcagcaaagagttcttacaaaatgcaattccaagaattgattactcacaataattgcaatgcctttcggaggcaaaagctcaatccaagcacaagttctttagacggctcataatacatcaaagagacactcacgaccgataacttattaggaaggcattggccctgcgcatggatctgtcgcctttgcaacgaagctttttaatcgacggatcacttgctcaaagaatgtgaattcatggtaaatgtatggggggaaatgccaatgagcaatggtttgacacaacacataagcctcaatgagcaatggtttgctctaaccaaactcaagccatagaacatgagaaaggagtggttgggggtccaaattacaacttggtggttcatctagctagagaggaacataataactttcgaggacactagccaaagtgaagagcagattgcttttacaatcatgcatgaattaaacgctcacagtcaagcacatagaaacaactaattctagcacaacttttgtttatggcttctttttacgggacaccagggggagaattgctcacttgaatatattacgtcaaacggtcttacatatggcaaagcttttagctatgcaaacacaggagccctggaagataagagaaaatacacaaggaaaaacaaggaagcgaaacatgacaagaacacaaccaacccggagggcactacatgtaacagttatgtaaaactattaaacttattttccccttctacctataaaacggcaaaattcctacttttcacctcaaaaaaaatatttaacacgaatcagctcacttcttgtgaaaatagtaatttaaccttttccttgatgtgcaacagttttcccgtcacagtacaacttcaattcaaattggagatttttaatttgcggctatacacgcttcactgagttgctttttttcgtagatagtgttatctttttcgtaactactgtacttttcctcgacatgtgagttatttttccatatgtcattgtcacaggagtgataatatcatcaaaatggcaatcttgcgtacttgacaaatcatcaaatttctctaaatcaattcaaaggaggcatgtatgatttgcacctttttctcattgtgacattgcttcccaacactaggccattcacattgtgggtttgtgcgaggctcttcattttggagccacgacaacggctcaaccaaacccgtgctctcaggaggcttctcgtgtccaatagagagcacaattgcctcgtcaatgcaaggccacttgtgcttgatgccatggctcatgagccacattgggcgaggttgtgcccaccctcctacatacatgtggttacaagcggttgggaaaaggtaggagcttgtcgacaccttcaatccatgttgcacggagctcatcgaaggcaaatcccaataacatcgggtggtgtggggagagattgcggcgaccatagaaggggcagccaattaggagtccatagaggggttatagggagtagggatgtaaactaggaggaacataccaagagggtacaaaccaagactataatattgattgtgttgttggatcaacatagagcttgcacagtctgagttggcacctatccatctcatcacagagctcattggtccacactatctcgattttcgctgcttaaggattgctcaacccacgccaccgaggagcatttagcccacattgttgtttccgatcagtcgttgtcaacgctttaattagatcaaccactgagtctgttctcatcacccgatctacgctaccaccaagcccttgtctaatctataccactaccaattcatcatcgtcatctaagagggagaggcagtgacaatgaaggtcgtcaccaaagatgtgagaggtggcaggaatggccgaagaaggggacaagcggtggttaaagggaataagtaagggagtgaacaagtgaggagagtctaagtattatattaatttgtaaaaaaacaaaaaaaaagtgaggactagaatagaaatgtgaggagtcgatatgaaaaattgaagctatcacttaaagtcggcatcatgagagagaaatgttcagatgtgtagcctcatactacggagatattttaacta

SEQ ID NO: 31994 - DNA, 7627 bp, Oryza sativa
caaatgtataagatataaatcacacttgaagtactatgagtgataaaacaactcataacaaaataaattataattacgtaaattttttgaataagtcgaatggtcaaacatttgagaaaaagtcaacggcgtcatctattaaaaaacggaggtagtatatactttatgtatatacgtataattttctatacatatatacagagtttgtagagtttgtatgtatgtatataaagtatacatacgtgtgtgtatgtatgtatgtatatttttttaagtatgtatacatttttttatgtataaaaagtttaaatatataaactttgtatacatacatatacaactttatatatgtacatattaaaaaaatacaaaagaataacgtatacaaattttgtatacatatgtatgtaaaatttgtataatatattcaaaactttgcatacatatgtatacaaagtttgtatatgtatatattaaaaataaaaaatccagaaaaaaactgaaaaacaaaaaaaccgatagaaaaatacaaactaaaaaaccggtcacgcgtcgccacagggaggtccccccctctctctctccgcgcgctacgtgacgcgccacgcgggggacggtgtgcgatcatccgctttttttcgttaatgtcttaaaagtagcaaaaagttaaatacccccgctctttgaggtcatccctttttgaatattttaaaatgcgtttgtacatatatgcttcttttaactcattgctcgccatcgagagatgaagggagctctgtcatcacctacctcaaaagggacctgcgtggttcgagcttcaagcattgatgctgttgcaatctttatcttgtccctcccaaatttcaggagaacaatcgagtatcgacatgtatgcttaacaagacgaagtcaaccccctctatcacacaataaatacatgtacatgtaaacgaatgatactagaacactgatgttacgcggctagttaccaagtcaaggtgtttttattatctcctacactcgaagtttcgtagtacgaacttgcaatcaagtggaactacgcaatcttatccgctattcgcgatgtaaaagaacaaagtcagaagttaacaaagattagtactacaatttctaatgtaccatcccgtgtatgagctcctgaatcttcggaaatgttcaaaatgttaccgatcactgctcgatctgtactcgagtagctgcacgtacgctgggttaatttgacggcgaattcgtgaagaaaccacacaaaacgcgggcgagtgaatctcgataatcagaggaaataaaatgacaggaagaatatggtgagcacactgcgttatcatttcattttgacaaatcttaagatgtcaaccggcgcaaattccacggcgtgatggatatatacagcagcgtggcctccattgacaacggggcatttaaattttgatgtgagaccaccatgacctgtaataaggctagctgtaggagtaatataataatgcttcagacctataataaacataagaataaacaaaaaataaggctgtagttgttttctgatcagaggagatgccatgccgcacggcctctgttgacacaacgtctctgctggtacatgctggtgtaaacaagggtgtgtttagttcacgctaaaattataagtttggttaaaattagaacgatgtaacggaaaagttgaaagtttatgtgtgtaggaaagttttgatgcgatggaaaagttgaaagtttaaagaaaaagttgggaactaaacaagggccaagtagccttgtactggctgtactatctatatctatttatctgtctatgagaaatattcattaagaagtattaaataaggaaaaaacacgcatatttaaaagttctataaatttgtcgataccaaatctgaagtccaacataatttcatttaagagaaaaaaatcaatttcatatgaatagttccctcttactattcactataaatttatcattttgttgctcttaaataaagttgactttgaatttaagattttaagatttgatgaaaatatatttcaagcttatacatatctctagtaaagattttttttctccatctatctatttatctatccttcttccattttaaaatataaaaatttataggatttaaatcatgattcacaatataaggaattttagcactattcatattactacttgtctcatcaaccattttgcatttaattctttttccatgttacccctacccaccctcccatctccatccatttcatatttattaaggagcattaaagtcttctctctttaaacatggtactccctccattccaaattgatctacatctagtttttttttgaggttattcttaaatgatctacatatttgtgttcatttattagagtctattcgttatttgtgcattggagtaaatggacattgatgcatgcatccatgcacacaagtatttataacccacatgcaatatcttgatttgctattggctagaaaatattggggatggtgcatgcattgagtttgttgctagagtaaatatagtatgagagagttattagcttttcttggtcttggtgtagctatgaaatatgtagatcaatttggaatggagggagtatgtgctaaaaacccttatgcacgatcttagagcaggtataatagtaggctattagctagctgtaaacatattttaatgagataaaagataagagagaagagcagcaggctataaatctgtagccagctgcaacacggactccaagacgcaatgtgtgtatgacaggtgggaccatatattaatagtatagtaagcaactattatatgaattggctattagattggctatagataaattagagctaataatgggctatactattaaactttgtcttatgcgcgttcatgaaaaaacagtgcaacagatggattacctcatgcaaaagaaggctactttcatgcatgtttaacaaacagtcacgtggattcaaaagctttaacgcatgcacaatacaaatacactcaactcatcttggaaaaaaaagcaaatagtaaaatagtaaaagacttttggatggagaaagtataaaattgaaaacctgatcatgatcaaattcgatattttttttcaaaaaatactaagacaacgagattactatttaataaaattcaaataaatttacgtgtaaaataatttagataatttcgtattggtactccctccatctacttttgatagtcatatttttaaatctaaaaaaattatttttgataggcatatttcaatccaacaatctatcattttaatgattttcttaaatttaatgcgtgactctctatttctccacacaagattggctacatggtatcgagaaatgtaaatattaatgaatcgtttgtttacgaggaatgactattagcatgtttaaatggatgataaatggaattacttatctttgatctatgtgccaatataaaatatgactatcaaaagtaaatggagggataattagctgaggcaattatacgtgccaccttaccagttgtaataatttgtacgagccaccggtgttggttcttgggcgtcgtcgctcactcgctctcgtccgggacgggtactgaaccttcatctcgcggaatcagtttcgcgaccgagacatggcccccctctcgttgacccatttaaaggcatcgttaacttgcaaaaccgaccgaagacattgtggcccatgaatgcctagttgccaacatggcccctcacaacacagggatgccgagtcaaaacctgcgtcgtcgatcgagtccagttgagaccgggagagagatggattatgcctacctcttgcgttttgaatgttcgttaaatgtatgggaataaaatttgaaaatatactgttcattgatctttctttcagaaatatactggatgttgtttgattagcataaatataccatcgaaatcgcggttagaaaacgcgataccgaggttcgctacgggaaagcgcgatatcgccacggtatcgcattaccaatgcgcgagagcgtgacggtctcgtgcgttgaatgggcgaggagatttgagctggcggtgtcgcttgttggttatgcgatatcgacgcggtatcgcgtttccactgagcgagagcgccacgtcataccgatttgggagcaacagctggagtggtgctatcggtctcgcttattggcagcgcgagaatgggatcgctaccaggtttagacgcgcgagagcgcgggcccgcggtctcacacggccaaatcgcgagagcacaatcggtatcgctctttcagagcgcaatagcggctgtggagtgggtcccactggatttttttagttgggagatcgggcagccgcggtatcgcactgtgggagcgcgatatcgctcggagggggggcgcggtctcgcgcgttggttttgcgagaccgaagctgatgtgacactgacaccctcccgtcaagcatgcactcacgcattatcaatacgcacgcatgcaatcacactagcaaaataatggaacaagtcaatagtaaactgcatccgaaaaagtttttcaattaagcggtgtacgaagattatcatgaaataagctgtacaccccttaattactaattgctcacgcgtgattaatttatttttatacgaagttttctatgtaattaacttaaccttaacaccattaaggcaagtactatagtctcccatatgttacccctaagagtgccacattagattgagtgatgaggtggaggagagaagtgaggagagagaagataagctacctctaaattaagaggcaacatccacacaaatttcaagaaatatgtgagagtattagagaaattggtatttgtgtattagaggtgatacattgtatgagttgcctcttagttcatgagtaaataaaatagataaatttgaaggtggtagtcacatctaccatagcacttgcccttaggcgcgcagtggggctcacctgaccgctctcgcgttcctctagcgcgagaccgcgccatcgcagtcagggggcccaccgctctcgtgttcctgtagcgtgagaccacgtgggtcgcagtcgcaacatttgcgggggcccaccggctcgctctcgcacttttagagtgcgacaccgtgcgctctcgctattcggcaaagcgatatcatagcaccgcctaggccaccgcgtgcgctccgtcctcgctgactgaacgagcgatactgctctcgttctcgcgcctcaatcgtgtaagaccgcggtctcgctcaacgaaaccgcgacggcggtatatttttgcaaatcttcacgcgttcggtattttcttgcaaattctacagaaaatacgtatatttctaaatttttttcaaatgtatggagcattgaagacatgaatgtactcactccgtcccaaaaaaaatcaatctaatattagatgtgatgtgttctagtataatgaatcgtgatagaggatgtctgaattcattgtatcataaaatatttcatctaatacttaattcttttattttggaactgagagtgtacacatttaataccgttaattttcaataataagtaatgtagtcatcgacaccatagtgatttccttaaagttatgttggtcggatttttcatatgctcataaagataaagtgtgtatgtgtgtgttcgtccaaataaagtgtacatttctaaacatgaatacacatatctagtaccgcaatcttctctctgatattcttttttctgggagaagaagtctattgctatctcatgtgcgactggggcatgccatgcatacgcaggtaaacgcatcacaccggccggcagtatcattccctacaagcgatcatggtggcccatgtgggctttggggcgctgcagcatgggtgggtggggtgccatcccatgcgaggttacgcaggaagctaaaggcggtaggcacccactgctgcatccgtagtctgacgcggaccgacggatcaagtcgacggccaccaccacacgccgtagtttgataaactcagatcgcaagcgccgcgccgccgcggtgctttgaatgcgagagaatttgtcgtaccgcgcgcgtaaatgcggcgaccgctcgcacgtcgatcggccagaagccgtcaatgtccagattcataattatacgatgagtctgatagaaaacgataggtaaataaatgataaaaaataatagattaataatagaagacacgagatttaatatggaatatttttcttaagtaagagagaaaaaaccacgggcatcagccagcaaatatcttcattatatcaggtgagattacaacaccgaatgacagcttacgtgtgcgattgaatttgaatcacaaactcaacagagtcttaatccattttagattaaagtaatacgtattttagaatggagagagtacttggacacccaacgtgcagtgctgcatcctccggggctgcgccggggggcgggggggggggggggtggcggctgccctatccatcgccggccggccgggagaggcagcgagggaacacggggggtttcgccgtgttccgcgggggcgtgcagggtggtgtacccggccgcgcgcgcgtatactctggacaggctcaggtgacgggttcccctactccctgcacgtccttgtgtatgctttgtcttgcgcccccgcgccgcgcacgtcgcgatttagggctgttattagtactactacgagcaatcgagctcgatgagaattcgttcttctcctggtgcgtaatgcgtgattttgctgtttctctgtcgccgtcgcgtgattttctcttgcggcgatactatggtagagaaaatgaagtgaaggccccggcccatgggtgctatgggcctatggggccacgacagttcgattcattcctgaggtgtaaagcccagtagccccagcttgtttcgatttagcagttttcagttctagagagacaagttgcacacgtagcacgcacatagacccatcgcggtatttacatactacatttgtcccaaaatatatcaatttttatctatatataaatatagacacatagttctccagatttataaccaaaaatgtttatattttaagacggagggagtatgttgcaattttcggttaatgagatttatttgtttatttttttaatcaaaccctaactttcattactcattagcttgggaaaatatacagtggaaacctgaaaacgattgttagataaaaaatagacgcatgataaaaaaattactacatgagtatatctgcgagtaaaatttttagtcgggataacgtggaagaatctcagacgtccatttttcgatccgacggtagttttcaggtttccactgcatatgttgtttccatcgcatattttccccattagccgagatatcctcaacaatccattagccgaggtgtcctccacaaccaagtatgtaatacatgatggtatagagacgagcactgttcagaatctgccaagcacaaggaccccaactcagcgagtctatggactatcatatttccttctattggcttatactccctcgatcccccgtctctaaaaataaaggattttggtgaga

SEQ ID NO: 31995 - DNA, 7426 bp, Oryza sativa
ccaaaatcccttaattttagagacgaatagagtaactattaactataactataactatagtattacgaatctggacatacctctgtttagattcattgtattagaatatgtcacatccagttctagattcgttttttgggggacggagggagtatgcttcaattcccatatcacgctgctgctgttggagagatcataattagatgataaaatagccacactgaagtatggaataagaaactggatggatagaatgaacagataaaacgacccatatatgttaaaatgggcctccaagatgataatgcatcaccgcagtccatggcccattaaataggcggctgcattgtatttggattcacgtttgagctgcagtgaaacttgggaagttaagtgataaaatagttaagcatgtgtttgtttgaaaagatatttttagatgggaacaaggttagatgagagagccagagaaggaatattccaaaaaaaaaaaggctggatgagttcatccacaaaattagccggatgaagcatctcctttgctagtcttaatcattagtaattagtttgtgatgattaatatattttgttactcattagtttatggttgtttcttgttgtggcctagcctattttcaattacacaatgtctactgtccaccttaaagaccttaaggaggttacttttttgcaacattgtggttgcccttcaacttgttaagattagtgttgatagagaaaattagtccattttattgttaatttgtgtattatagacatattaataataattaatattttgtattataatttaaaatttttattgttttctatccattttcattcatccaaccaaataagaagaaactggatcgtccgatctactcaatcaaacaaaaatttaaaccactatctaaagaaaatgtggacatatcgtgagatatcttgacgataaacaaaagcaccctaacattccagtgagagtcaaatgaagtgataaaatagttacgttgtgacaaagaatgtggaagcaaatgctatagcttgcctaagtagctaataggtccttcatcgagaatttatatttcactattatttacaaaaggacggttaattttaagtggggacagatatattattggagtttgcaaaaacataaggaatggctaaaagcaagtactataaacctttaatcacttacctcaaaattccacataagcccatatgataaaatggagaaaagaagaaatgagaggcggtagaagacaccccttatgtaacgggcagtttccacatatgtaacgggcagtttccacatagacttcaagtaagaaaaaaaatgatttgacaaacaaaattattagaattagtgtactagagttagtgtgcatgtgatatattgagtacatactacctcttagtttgtatgaataaaattagaagtagcaactatctcttctataaaacttgatctaaggatttaattaagcactagtcccaatatcatatgatgagtaggaggatagaagagaggggaaaaagacacccctcataaaaaatgtaatatctatacaaacattaagacaaaaggagggagaggaaccgcagtacattggaaaaataaatattagaactagtgtattagacttatggatataatatattaaatatgctatgtctaaatttataagtatgcgatatggaaaaaaaatataggtaataacaaccatcttactaatccctttgttccataatataaaggattttggaagaattagacacatattgtccatattcgtagtactagaatatgtcacatctctccaaaatctcttatattttgggacggatggaattctatataaaacttgctttaaggcaccgtttgaatgtgaggttgggttgagttgtggcacggaaaacgtaatggaccattagcacgtgataattaaaattaaccagtccctccatcacacaaagccttcattttttgccttcttcatttatccgataatttgagccaatcaatgtatttgagtttgagaaatttgagaacggatgcaatggagttttcttaaaagaaggggtcaaatgtgttgaggtttaataaagtaggagttaaatacatcggagtttgaaaaagtgaagaacattttagccttttgactttatattaatatgcgtgagataggaaaaataaaatattttagacagagatagtgttataagtatgaagaatatatttatttgttttttttaaacaaataaacttctgtctactaccttcttcaataaaaatcatttttatatttttcccgttccaaaatataagcatttatagctatgaatctgaacatctgcccgtctagattcatatataaaagttgttatattttcatatagaggtagtacatgaatatggataggtactcttgtatgaatctagataaatggttgtccagattcatttataaatgttaacattttgctaacatagttgaaaatatttgcatgaaacacaacatttaacagcttgagaaacatgctcatgaaaaattaaaaaagaagcataagttgataaaatgatgacataaaaatagagcctctttggatggagggagtaaaagtgtaagacaattaacatgacgattttggtgggattatatgtttctggcacacgagtaagagtatcgtttaacagtttgagaaacatgctcatgaaaacaaataaaaaaaagtagagtaagctgataagaacgatgactagaaataaagtctttttagatgaatagagtaagacaattgacatgacggctgttgtggggctacgcttctagatacgactgatagagttgtgtgcatgtctagattcatgtataaaagtaaattatttttatacgaagatgatataaagtatttgcatgaaacatgccatttaacagtttaataagcgtactcacgtaaaataaaacaaagtagcataagttgataagaatgatgataaaaaataatgttttttggcggtagggagtaagacaattgacatgatgttttctgtgagactagatgcttctggagacgtctcatagagccgtatagctattcagatttatatatataagtgaattattttttaacgaagacaatagaaagtatttataagaaagactatttaacggtttgagaaacctgcttacaaaaataaaaaaatagcttaaactgataagaaagatgacaaaaaaataaagtacttctgtcgtatgaagtaagacaattaacatgatgattttgatggtgctagatgtttctagacatgaccgaaagagttgtatacattcatgtctaaaagtgaactatttttcttttacaaaaaaataatagaaagtatttgcacaaaccgttgaaccatttaagaagcgtgctcgctcacgaaaaataaaataaaaagtagcgtaagctgataagaacaacgataggaaaataaagggtttttagacagagagtaagacaattgacatgatggtttcagtcctactagatgcttctggacatgacggatagagctgaatacctgtccaaattcatatataataatttaaaatttttgctcaaaacataacatttaaccagttgaaaagcgtgttaaaacataacatttaacctgttaaaaagtgtgttcacgagaaataaaaaaaagtagcgtaacctgataagaacgatgacgtaatttttttttcgaccgatacagttggtatagtaatggtttgggtccgactagatgcttctagacacgacgccgtatcctctaggaggattgccgtcctcgaaaacccgtgctgagggtgtagcgcgcgtaggcctcgagcccatctcactatcaaaacgatctatcggatttcccaagtagaaacacacgtctcctgaaccaaccaggtgcacgatgcacctccccgcggtgccacacaccctctacgcctggatggtcaccaccaacaacgggggccccatctgccatgtctgcagtagaagcgaaaccccacgagaattcgaaaccatttcaaacctcccccgccagcgcaacgccgaaaacgcgaaaataagacagttcccacgtaaaaacttttcacgctatcatattaaatattaaatatgtaatattaaatatagaaaaaaagcaattacatagattttgtgtaaattacaagacaaatcttttaagcctaattacgccacgatttaacaatacagtgctacagtaaacatttgctaatagattaattagacttgataaattcgtctcacagtttacagacggaatatgtaatttattttgttattagactacgtttaatattttaaacatgtgttcgtatattcaatgtgacacgcaagatcaatatttttttttttgccaactaaacagggcctaaaccccgtttcccgctgatttcgcctcgttttgcccccaaactcgattcgaaaccatttcaaacctccccgcggcgcaacgcctaaaacgcgaaaaataaaccccgtttcccgctgatttcgcctcgttttgccccccaaactcgcgtccaccacccgccccgcccaaaaatcgcccaaaacgaaccgacgctacgcgagccaagccacccctcgcgcggcaggtcgcgaaaagttggggcaaatacacggaaagaaaccctccatagtacgcgcgcgaggggaagccgaaaaggcaaaccaaatcaccaacaaaaatagtaggccgcccccgtttctccctcgcgccgcctcgccgcggccgaaatctcaaacgcacccccccccccccgcccccccaaaattttcgctgccgcgccttctcgcctcccttaagaacgcgcctccccgagttctcctttgtctctccccgcgccattgccaatctccgacgcgttgtggaggtagttgttgtcggtggtccggctatgccgtcggccgtggtcgtccgccgcgcgcgcgtgcgcgcccggtcgcagtcgccgccgggggagttcgattcggcgcggcgcacgcggccgcggatggagggggaggaggagatgcgcggtcgcggcgggaaggcatcggcgcgggcccggtctcagtcgccgccaggtgggtccggttccgcggcgcgggtggaggtggaggggatgggggcgtcggcagtgcccgacgacatgctgctcgaggtgttcaagaggctgtcgccgctggcggacatcgtccgcgccgcggcggtgtgccgccgttggcggctgctcgtctccggcgccggcgggctccccgcgccgcctccgtacttcgggttcttccgcaactacgcgccgtccgcgcttccccctttcgtccctgcagccggcgtcggcctcggcctcgaccacggggcgctctcggtgtcgcccgcgtgcggcgccctcctcgtcgactgccgtggccggcgcctcctgctccgcgagctcggcgccgggtcggcgagagagctcaagctcctcgtctgcgacccgctgaggaagacgtccgtgtccctcccctcccgcttcgtcgccggacacaaggtcgcctgctgcgcgctcctacctggcgccggcgcggcgttccgcgtcgccgtcgtcctcttcggcgctgctgcccacttcgacattctagtgtactcttccgccgcctccgcatgggaggcggccaccggagcgctcaagaagtccatgaacccacaccaaggcccgacggtcgtcatcggcgacgtggtctacaagctccagagcgaagaagacaaatacgtaatggcagtcgacgcgaccaagatgacgctctcggcggtgccattgccgaacaccgggatgctcctgtacgccgggaaccactggatcggcaagacacacgacggccgtctctgcttcttcgcgctgcgggagcagctcgttcttgcgaagtgggttctcgagtcgccggggaaatgggtggagcagccggcggtggacctgcgcgcgctgatgaacccggccaccgtcggtgacctctcccgaatcaagctctcggcgaaaatctcggaccagctgcgcggctgcaagctcgtgagcttcggtggattctgcgagggcaccggcgcgctgttcttcgtcatggccgactgggtcgtatccctcgacctcgcgacgtggaggtttgagaggatgtggcgcaacaccgatgagtcgaggccgctcggcgacatcttccccgtcgagatgatggtttggccaccggtgcgccgcggcgatcttggcgagaaggaatgaggtgcaaggtgttcgacaaatggcaggctacttgaattgaaggtgtttttttgctgtaggcctgtagcgatgaaaagaataacaaattaagaatgcagtttgcgaatttgtcgtcaatttccattgttactcaaaaatgtgattaacaatgtgatacaattcactgaatcatactggaatggtgaaactttttcttttttttttttgcgggggaatggtgaaacttttgggtggttttatctttgtgatatctctttcatgaacatatacttagtaagagcattcccttgcatgttgccgttactcataacgaatcgcttcgaatgtcactttgacctttgaaaggattggttcattatgttgagtaaatcttgtgaatgctaggagtaaagccgaccgtttctgccatttttttttcatttaccaggacgcattatttgactgcattcatcactgatagccataatgtaaaactcgaatattaaaaaaagaatgacgaaaattgcccccttttttcattcaaaagaacattgtctttgttgctaaaagttacttccctgttatagaataactttatttgttatccatttcataatactaatattgacggagcgtggggctcctcaccgggagaccgcgcaggcccccctttgccagttcggccgggggccctgtgtgaggttctaagctcttggtctgtggaaagttcgcgagaatggaaacacacaagacacgggcgatgtatacaggttcgggccgctgagaagcgtaataccctactcctgtgttttggtggatctgtgtatgaagaagctacaaagtccgagccagcccccctctcgttctaggatcgttctcctcttttttccccctttttctaagtgggcaaggtcctccttttatatctcaaggggataccacatgcaccatctctccctctctttcttacttgacttctcttcattaatggacggagatttgtatggctgccgtccgaatgaccttctgatgggacggcccatacctacctccacttccgccggaagcagacgcgacgtgggaacatggctgtctgctgacatgaccattgtcagaccgatcacaaatcggtcattcttgtccaccacgtgtcagtttaa

SEQ ID NO: 31996 - DNA, 16195 bp, Oryza sativa
ccgcctgtcgccacctaacccacgatctgaccggtctgtgaccggtcacagcacgaataaacgagcgcgctgcactgcgttacatgcggcgtgacgcgctcgtccaaaccgtaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccgtatcaccctcgggcccgacccccccgagggggttaggccacgtgggcgatcgtgtctgcctcaagtctctaagtcatgatactcctggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctagactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcactattattccccttgtcttcgccgcttgcgccctaactccttgtttcctgtgccctaccttcgccacacgcgctcgctctcaaacatctcttcttccggcgtcatggcacggggctccgctccgcttgatggtagcgtgctgccgccttcccgcatcgtgagcgagagacaggccgagctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgtttcggtggttcttcactgtacagccggtgtcgccgccgtcggtggttggtggttgctacttccagccgcgggggccggtgctgaaccactacattccctgcgtcctccgcaagaagtgggatgactggaagagcgactggttctatacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactgggctcctgaggacttcaagatagtggtccaacgggtgctgaatctcagctccgtggaggcatccctcatttctcaaggagtcctccccctctgcagcgatccagaccgtgcctccatcctgaccatcatgcaggcggtcagggcgtcggaggagcgggctcctcgaggccacgatggcgcgggcgggagccgcaggggggaacgatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgaggggagcggaagaagaaacggccccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacaaaggctcggaggcgggaatctgaccggcgagaagccgcggatcgcctacggtaagccgaggaggccgcccaggtggccgtccgagctcgccaagctgaagaagccgctcgggaggaggccagacttcgccaggccgaggcgacgacatcctccgaggcgacccgtgaaactgaccggcaagaggccgcggatcgccttcgagaagccgaggaagctgctcaggtggccgtccgagctcgccaagctgaagaagccgctcgggaggaggccagacttcgccaggccgaggcgacgacatcctccgaggcgacccgtgaaactgaccggcaagaggccgcggattgccttcgagaagccgaggaagctgctcaggtggccgtccgagctcgccaagctgaagaagccgctcgggaggaggccagacttcgccaggccgaggcgacgacgacttccgaagcagctcgcgacgaggccgcgggcgcatcgcttgggcccactcactcgtgcgacgctcaggacaaaccaggtccgggggacatccccgagtccggcacgtccatcggcgggccaagccgcgcggcatcctcttcgaggcggctcttccccacgccttccgttgctccactgagcgcagaacctcttctgcaggccttggccgtcgctaacaccacggtgttggacgggttaagtgcccagatggaggccttgcaagcagagcgggtggagctcgacgccgcatgggcacgtgtcaaagaggggcgtcgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccactgtgatgaacgaggcgcaggacaccctccgccttcaatacgggagctgggaggcggagctagggaaaaagctcgacgccgcccggggggtccttgatgctgccactgcccgagaacggcgggcggcggagaccgaggcggcgtctcggcggcgcgaagaggccctcgaggctcgtgccatggcgctggaagagcgcgccggcgtcgtggagagggacctggtggaccgcgaggccgccgttgccatccgggaggcaacgctggcggcgcacgaggccgcctgcgccgaagaggagtccgcgctccgcctccgcgaggacgcgctcaccgagcgggagcgagctctcgaggaggccgaggccgcggcgcaacgtctggcggacagcctgtccctccgtgaggcagtgcgggaggagcaggcgcgccgtaatctggaaggtgcccgcgccgagagggccgcgctgaaccagcgggccgctgagctcgaggcgcgggagaaggagctggacgcgagggcgcgcagcggcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagtccgcgccgggcggcaggcgggtctctggggcgggcggactgtgaagtacgccgccaaccaggggggcctcgcccagcgcttctcggagatggccgggactctccagcggctccccgaggagctcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgacacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcactacgccccggggcacggctcggttctgggccccgtttggcgattttagccgacccgagcccccgagggcaggattgaacacgagtgacttatttcaagtcaagatccttcaaaaggaaacaacagcacagatacagcctttaggaaattgaaaatgtttttattgaaatacagatacaagagatataagaatatgcatatgtggtagcccccggccaaccctgcacgcccgaggggggtgcggggttggcctgagcccgaaacctgacacccgatccccctttaggggtagaagcgatgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgtggctcggagggccgcgcgccgccttcgctcttccaagtagtcgaggtcatctctgcgaagctgatcttgatcagcctcgcagtacatggtggcccgaggggaccttagggtgagctcggatgggagaaccgcttccgcgccgtagacgaggaagaaaggcgtttccccggttgctcggcttggcgtggttcggttcgaccagagcaccgttggcaactcctcgatccacgaatcgccgtgcttctttaggatgttgaaggtcttggttttaaggcctctgaggatttccgcattggcgcgctccacttggccgttgcttctggggtgggcaggtgaggcgaagcagagcttgatgcccatgtcttcgaagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcctgcctaaacggtcccaggatatcgagcccccagacagcaaatggccatgaaagtggtatgatctgcagggcctgggccggctgatggatttgcttggcgtggaattgacacgccctgcatcgccggaccaggtcgaccgcatcattgagagctgtcggccaatagaaaccttgtcgaaaggcggagtgggatccgcattcgccttcatggatatcggcaagaaactcgacgccttgttcccgaggaatgcacttcaggaggattccgttagccgcgcgccgatagagggtcccttctaccagcacgtagcgtttggagatgcgctggacgcgttcactcccttcgcggtactcgggtagagtcttatctgtgaggtatgcttggatctcaacgatccaagcaatcaatctaagggagctgggagcgctcccctcgggtcccgaggcctggactccgacaggcctcgggggcctgtcaggcgcgtccgtctcccctgaggggtcgggtcgcgccgaaggctgggcaagcctttcttcaaaggcgcccggtggggtctgggctcgcgaggaagcgagccgtgagagctcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccttcgtactctgccatattattggtggcccgaaagtcaaggcgaaccaaatatctgaggacgtctccgctcggcgaggtcaacgtgacccccgcaccggcgccctgaagagacagggaaccgtcgaactgcatcacccagtgggcggtgtgaggcagctgcgaggggcccgagctggcctcggggactgagacgggctcgggggctggggtccactctgccacaaaatcggcgagggcctggctcttgatagcgtggcgtagttcaaagtgcaaatcaaactcagaaagttcgattgcccatttcaccacccgtccagtaccctctcgattatgcaagatttggccgagggggtaagacgtaaccaccgtgacccgatgcgcctggaaataatgacgcagtttgctcgaagccatcagaatagcgtaaagcatcttctgggcctgagggtatcgggtcttggcgtcccggagggcctcactaacaaagtagacgggccgctgcacctttcggtggggccgatcctcttcgctaggggccacgtccctggggcgctctttgtccaagcggcctcgcggggtgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgagccaagccagcacagggtgggggtgcgcggaatgaggactgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctggggggcgcatctgctctatagctcgtatcttctcggggttggcctcgatgcctcgggcagagactaaaaacccgaggagcttgcccgcaggtacaccgaacacgcatttatcggggttcagtcttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaacccgagtatgcatctagaaaacacaaaaggtcgcaccccgctgtggagtcgacaatctgatctatgcgaggcagggggtaagtgtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccagaccggccttgcgcccgaccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcacatgtgactatccgctgcctcggggcggcgggggcggaggtgccaagcctctcgtcgccaccctcgggcttggacgcggcggcgaggtggtccgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtgaccgggaggtcgatatgacctagcggccaagtgtgacccggcgtcacaccgataatcggctgggacggccggagcaccatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgtttggcctcacttcgccgattgccggaaggaaccgccggggacttgccctctcggcgctcctgcctcctctcctcctcccacttcctcgtccgcttagccaaacttttgactgcgcggcagtccgcgaggtcgtgaagggaagtgttgtggacgatgcaccacttgccggttgggcgctccctgctgggagcgccggcctccttctttttgtcgcccgcaggcctcccttttcgggtggcccgcgaagcgccctcgacggcgaggacatgaccctcgtcgtcggtatgggctgacctcttcttcctcctcctgtcacgccgccctgtctgagcagcggatccgggggcggccgaagctgccacaccggaaccggaggggttccaggtccatgcctcctccttacgagccactcagtccgcaagctgaaaaagctccgcggtagtctggggctctttggaggcgatcttttcgagcatgcggttgtgccgcacacccccccctgaacgcgtagatcaccgcgtgtgcagggatgcatggtatggtgttatggacttgacagaaccgctgaatgtacgagcgaagtgactcatcatccattcgctgtactgcatgtaagtccgcttcttcacctgggcacggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatatttcggcgatgttggcccgaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatatcgatgtgggcatccggccccccacgcagatcttcctgggtcggaggcgctgacgaaggagtggcggccgaatggcgagcaacagccgccgctcgccgcgccctccgccttgacgatacggagccggtggtagcagcgccagaggtcttggtggcggaggaccgcccaccagcacctaggcgctgccgtgccgtcatgaccaagttggccacgtcgtccagccaacgttgggctggagactccgggtcaaggacaatgggcgggtgacgtaggagtgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggtttggctccccatcgtcgccgctaacgctcggagagaggttgtgcgcctttgcttgttcggccattgggctgaacaggaaaagcttggcgcacacgaaagagtgcgagagcttagaagaacacacgcagaaccccctacttggcgcgccagatgacggagcgtggggctcctcaccgggagaccgcgcaggcccccctttgccagttcggccgggggccctgtgtgaggttctaagctcttggtctgtggaaagttcgcgagaatggaaacacacaagacacgggcgatgtatacaggttcgggccgctgagaagcgtaataccctactcctgtgttttggtggatctgtgtatgaagaagctacaaagtccgagccagcccccctctcgttctaggatcgttctcctcttttttccccctttttctaagtgggcaaggtcctccttttatatctcaaggggataccacatgcaccatctctccctctctttcttacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccgatcacaaatcggtcattcttgtccaccacgtgtcagtttaacaatctgcatgttcacccttcttcatacaatatcttgcctgtaatggttaggataaagcctggcatatatctgaccggaaccaacgtgccatctccaggagctaacacgccggttccggctagggacgagtgcttggaggctctcgtcctgacgggatggggcgaggcgtgcgtcagaccgcctatcgccacctaacccacgatctgaccggtctgtgaccggtcacagaccggataaacgagcgcgttgcactgcgttccatgcggcgtgacgcgctcgtccaaaccgcaataaatgtggttaggtgagccccgctatgctcacctaccccatatacgcggcgcaaaacccacaaggggtcggggcgcctcggccctcagggccgaggcggtagcggtccgacccctcggggagacaaagagaagggcggccgtatcaccctcgggcccgacccccccgagggggttaggccacgtgggcgatcgtgtctgcctcaagtctctaagtcatgatactcccggtcccatgtcactgacaaatataaaagaaaaataaattatcccaatatcctatactttatcaaattctaatacaattactcttaattttatctagtcctaataaatttatcccctatttctgaaagttctaatataaatatctcttaaaagttgaagtagtaatatctactattctgtaaaaaaaaaacgaattcctagctacgaatgtaggtaggattggcctttttttttttggcacaaagggagtatttatgtaaattttggatcagaaaccactcttttttacaatagaaggaatcaaaattttcagttaggaaaggtaatgtgatggtaaaggagaagttgctagtataaggcttcgtttgataggagagattgctgtgagattgagtagaaaacacctcgttttctgcgcgcacgcttcccaaactactaaatgatatttattttgcaaaaaaaattatatagaaaagttgctttaaaaacatattaatctatttttgaaatttaaaatagttaatactcaactaatcataagataatagctcaccgcgttttgcgtatcttctcaatctcctcttttcctatcatctcaaacttagccttagtagcatcgcagtccgaacaaccaggtgcactcattacatccagcagggaagtaatgaagttattcacttaggctgtgtttaaattccaaaaaattttagccaaaaacgtcacatcaaatgtttggagacatgcatggagcattaaatgtggatgaaaaaaaactaattgcccagtttgcatgtaaattgcgagacaaatcttttgagcctaattgcgtcatgatatagacaatgtggtgctacagtaaaaaattgctaatgacggattaattagacttaataaattcatctcgcagtttacaggcagaatctgtaatttgttttgttattactctatgtttaatactttaaatatgtgtccgtatacgtcaaaaaaaaatttggccaactaactaaacacagccttattctacaaagtacaacgaaagcttttatgttgggtgtacttgtttgtttaaatgttaccacctctgtcgcaaatcacttctgaagttattaaaaaaataaaaggagagtaaaaattaaattaaagatgatcgttattgattgagaaaagaaagtatgtgaaaaaaataaatgaaagatggttatgattggcacaaaaaacacttcattaattaagtatgatgtggggagatgatggccgacacgtcgacgacttaccagagttccgcgtgtgggccattgatcatctcaatggtcgaccggtattggagcattggtacgatggccacacgtcgaaggtgttcggatggtggcaaccgtcacatatgactggggcacgacagcatgcgagggaaggatgtttttgggcgacatcctggtctgcttccaggttgacagcggcgatgcttttccatttccattttctaccaatctcttatgcagacgatttgtcctcttgcggcgacgcttctgaccgccacaaaatgaccatgttggtgggttcatgtgagggagaatggatccatttctctatcgccctctccctctacaacaaaaggacgtggatggcgttgagtgtagataaaacacgacgcttttgtttgtttccttagaggggttcgctttgttgtaggcgtgtgatatggcttgttgttttatttttcctgattatagtcatgatctcccatagctatgatcttgtaacttttttatcctatatcaatatgaacctcacactatcttgtgtgatttgattgaaaaagtaaaccattgtaaatttgaaaatggatttattcatcttttcaataaacttttatactatatccgtcccaaaatacttgtcgatttgagttgttgtctgtaacgtttgaccattcgtcttattcaaaaaattatgaaattattatttattttgtttgtaacttgctttattatcaaaagtactttaagtataacttatccttttttttatatttgcactaatttattaaataagacaaatggtcaaacgtagcaagcaaaaagtcaaaaggatcactaatttgggatgaaggtggtatataaagttttttttaataaaatcaaatgatgccattaattttggaagcaggaacatacatgtgtttggtagggagtacgtgtttgtccatgggttggtgcatttaagaatgtttaagtcaatgcacaaaatatgtgcttctctattttttttatatacgacgccgttattttttttacacacattcgactatttatcttatttaaaaaattttatgtaaatgcataagatataaatcatacttaaaatatgccccaaaaaaatttttagtgacaacaacttacagcagaataaataataattatgtaaattttttaataaaataaatgttaaatatgtgttaacaatcaaagtcatcatctatttaaaaaactgaggtagaattaggaccagcagagttcaaatgtggtatgtgctgactacgtggagtgaaaatacgtaaggtgaatctttagcatatggttaattgagtattaattattttgaactagaaaagatgatttgtataattttttaacgcaacttttatataatttgttttataaaaccgtttagtagttcgggaagcatgcgcgtggaaaatgaggcaaatcttctctcaatgttcttttttttaatcaatctctcactgttcttcaaaagtacattggggagttatgattgcatattactcaatccaacaagatcatattctatttactaatactccctccattccaaaatactccctccatctacttttgatagtcatattttcaaatctgaaaaatctatttttgataggcatatttcaatccaacaacctatcatcttaatgactttctcagatttaatgcatgattctccattcttccacacaagatttgttgcatggacatcgagaaatgtaaatattaatgaatcgcttgtttacgaggaatgactagtagcatgtttaaatggatgataagtagaatcacttatcattggtctgtgtgtcaagatgaaatatgactatcaaaagtagatggagggagtataaggcacaaccacccttaacccaaagaataagaaataattattatcacttatagtttgaattaccctaataaatagaatgcatacacccaataaaattagagatcttgatggtggaagctttaaataataatatttgagtggaaaatatgtgctagttaatgacatgcatgcatgcacgccttatattatgaaacaactttaaaaagtagttgtgacttatattattgaatggaggaagtatcatgtactgataatatattgaaccaaacaaatcctaaatttgtcaacttaagcctcctctgaaatactccctccgtttaacaatgtaagtcattctggcatttcccatattcatattaatgttaatggatctatatatatatatatatatatatatatatatatatatatatatatatatgacactcatatggggcaccatggtgcccgggcaccatgatatcaaatacacaaaatcactcaaatttttcaaaattttcaaattgtgagtatatacctagttataataactcgattcatacctatacctatcaacaaaacaactcagatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatatatatatatatatatatatatatat

SEQ ID NO: 31997 - DNA, 4160 bp, Oryza sativa
gtttttgcacaagtatgaataggtcggatgagtgaaggctaccaatcactaccaactctagttctctcattgtctgcttttgggctatcaatggcaaataaaatttaacttttgaagcttaattggagttgattttgaggttttcaacggaagaaaaaattatgcaagagatcacatggatgcaaaagtctggactacagcgtgaaaacaggcttccaacagcaaagttttacctggtggagcagactgattactgaatctctttaaaagcacaatctccttcacgatgcgaataggccaaatacaagcacaagaattagtcatgccgaattaaaggctgtcgagtaatgcattgggttaaacttctatcctgagaattttcaagctaccgatgattgctttgaatatcatacatacacgacagctttattacttccgcatcatccaactaaactctccagcaaactgactgagtataaacacctgtaatgtactaatgtaaggagaaagtcctcttcgggacgtactagtagaacgattttcacgaggatcacttcaattcctgtaggcataaacaaaaattccagcattccaaactgcgccaactttctgcaaaaacttttttctcgaatttgccaaccaagtcatcgggcattgccttgatgggacgactcaggtggcaattttcgggcctgaaatgtcaggcacatggagcgagaagatacaagcagccgatgtgcctcgaaccactccttggctctttgccacatgaatcaaatgctgaaaatattagtatgcgaatttcatatagcagtagaacataaaagaaatatgacaaaatacattgaaaactaaaaaaattaactgtgctgagggaggcaaaactaaatgtcatttaatgtaaaccatcgttagggttgtactatacacagctttagtttcaggaggtaactgtttttactgtggcaaagggctctatagctatatgcagaacatatgtaaactttagcaaggactctgggtcaatgcatgtgactttaatcttcactggtccacgtagtagttcataacagaattaagaaaatcgatatttttttagtacaccacagtttttttcccctcatatctctgcctcatactaatccacaagttaaataaaacctggttatgctatgcctgaaggcttcccccccatagtcaagactcaaaaccacaaaccttatttactggtggattgtagaaggccaaagattatgtagaactaacatctaaacatttcttaatctgtttaacctgaactataaagaagacatcatgcaaagttgcatattcattgcatataaagccagaaatgggtggacatatttagaaaaaaggcaataacatacctactgttctgcggccttttcaccaaccacagaagaagatgggctccattttctatcaaaaggcccatagcttctctccacaatagtttgccgctcggttagtttcttatctattagctccagtaactcttgcaatcctgtccctgtcactgcagaagttttcacatgacaagtggacattggttgtgttgaactgcagctatctgtactaatagtttctggaccacaaagctctccaaaacaatcttttgatgatgatgatactgagttcattgctctcatctcactaggctcaagtgaggatgatatttcaccattgttgccttccaaattttcctctgataaatattcggagtctgttccatcatccaaggactcaaatgatgattcttctgcaggcacatcgttttcagaaaataattcttcctccttatcctcctcaccttcggtcaggaaaatctcatcttcaatatcatcagttacatcattatcattgttgtccacaatatcaatctgaagaaacaccataaaaaagtcaagttacatgaaaacccatgctaccaacaattcaccatgcaagtgtgacagtcacagccaaattaaatttcactactaaccttattccaaacttcgatcatactgttgattttatcctgtgaaacaccaatctgttgcaatacttgcagaacagtagaacgatgttcctcgatattaggagcactagaatctaatacatgctgcaccaatgcaaataaagagacatacaatcaactctatttctcttttttttattaagtaatttatcttaaaacaatttctgaaaagaaaatgtacatggctgaagaactatttgttattaaactagcaatggaaagattttagaagctgtcggagatatgggccgggggtatgcaaagtgaggggaagttaccttcccatccagccacgtggctctacagtctggccctaccccgcacctcgcgagtcgcagaagcggccggggcgcctcggggcgccacgtcatgcccctcgggctctcgcgttgccttgccccgaggccctcccccggctgccatgtggcgggggagcgagaggggaggaaacccaggctgaacagccatcaatgcgcggcgccccaactgtccctcactgcgtttaatgtggtaaggacggacgtgcggtgccgcaccactgacccacgtcaatcgggtctgaccagtctgtgatcggcctgtcgccggtcacgttcgactgaatgggcggccgtgcccccacgtcgcctctgtatccggcggagtggaggtaggtatgtcccgtcccatcgaaaagtcattcggagttccctccgtgagaggaggaccgccacaagtcttcactcatttatgagggaatgacagggctgtcccccgtgtcaggctggggggggacgttgggtcccgctcaaggacggactgctgcttagcttccgggcgaaggtacgggtcgcagtccggtcaaggtagtgggtccccctcccgtagaagagtaggcagaggcggtgcatgcggtatccccttaaactatacaaggatgaccttgcccaccgagaaaagggacgactctcagtaagcctgaactctaggagaagagaagtgggagcgctctccggagtttaggaacccttgtaacactccataatctcacacacaggagtagggtattacgctccatagcggcccgaacctatataatcttagtgcccacacgcgttttagtagcattgagggcggattcacgatctccccacgcgagccttttcccccggccgaactcactaaagggggatctcacgatctcccgctagagaggatcactcctcgacagctggcgcgccaggtagaaggaattcgcgcgcttcaaagggaagtcgtttccttccgccccaagttctcctctaccttcgacgatcatggtcgaggtcttggaggaagaggtggtggtgcacacccccattccctccgggagtgaggatgctagcgggagtcgcggcccccgtcaccgtcgccgcaactggcgaactccgccccgtcgcgaccccccgcggagggaggatcccacccggtcgggtggctcggccctctccccgcctcccggcggggggaggccacggcgcgtcggagcacgtcgccgcctgacatacggcgacggtgactcgccccgaggcgcgcttcaggcggcgggagcccttctacggcatcctccggtgaacgcggagcatcctcaggttggtgacgtcgccaacctggtcaccactgcccagcgacagctgaccgcgggtggccgttccaccgccactggtacgtcacgtacccccaccaccctctcctcatcagcaaggaggagggcccgtcggtcggccacggccttgaggcgatccacggccccaacgtcgtcgggggcctcgggaagtcggaggcatcacgatgacctctacgaggagcaggacgctcgaatcaacatcgagcaacaccgggacgagcgccgcgctgcccgcatgggagaaggcgcctcctcgtctggagtgccgcgttcctcctcgcgaggcggcccgccccccacgttcacccctggagggactgcttgtagggccttcgttgtgagtctccggaatgtccggtgacccccgaagttttgccccaacctcacggagaagtatgatggcagcatcaatccctccgagttcctccagatctataccacgatcatcgtggcggcggggggggggggggggag

SEQ ID NO: 31998 - DNA, 21591 bp, Oryza sativa
cgtttatacgtttcggaacggcgtgcggcacaatcgcatgctagagaagatcgcctccaaggagcccaagaccaccgccgagctcttcaagctggcggacaaggtggctcggaaggaggaggcgtgggcctggaactcccctagcaccggcgcggcagctgcggctgcccccgaatccgttacccgctctaagcggcgagatacgaggggcaaaaggaagccagcccgctccgacgacgagggccacgtccttgcggccgatgggccctcacgggccccgcgcaaggaaaaagccaccggcgataagccgagctccaccgctccctccggagagggtcggtcggcagacaagtggtgctcggtgcacaacacttatcagcacagcctcgccgactgccgctcggtcaagaacttggtcgagcggtttcggaaagccgatgagaagcggcagaatcgacgggagggcaaagcccccgcgacccccgccaatgactggcgaggggaggccaagaagaaggcccccgccgatgacggcgatgatagcgaggatctggaattccagatacctcagggaaccgtcgccactctcgacagggaggcttgcgctcacacctcccgccgcggtttcaaggtcacgaggtgtgagcttctggccgccgtcccaactcacaaggcggcacggaaggcgcgctggtcggaggtgaagctcaccttcgaccagagcgaccatccaacaatgctcgctcggggagggaagttggccctcgtggtctccccaaccatccacaacgtcaagatgaagcgtgtcctggttgacggggaggctagcctgagcatcatctccccggctgcttttgacgcgctcaaagccccggggatgaagctccagccgtcactgccgatcatcggcgtgacctcgggacacgtggcctctgggtcacgtttagctcccggtgaccttcggcgactccaccaacttctgtaccgagcggattgacttcgatgtggcggacctcaatctgccctacaacgtggtcctgggcaggcccgcgttggtgaagttcatggccgccacccactacgcctacctccagatgaagatgccgggccccagcggccccatcaccgtctttggcgatgtcaaggtcgccctcgcctgcgcagagtagcgtgccgacaacctggcggcagccacggagccgcaggtcccgaaggcctccacgtcccgcgcctccaagaagcgcctcgcctcggccgacgaggtgcccgtcaaggagattccccttggcgatgatccatccaagaccgccaagattaacggtaccttggacgccaaataggaaagcgcgctcgtctccttcctgcgggcgaactccgacgtctttgcgtggaagccgtcggatatgcccggggtccctagggaggtgatcgagcaccgcctcgccgtgcggccggatgcgcgacccatccggcagaaagtacggcgccaagccccggagcggcaagccttcatccgagaggaggtgacgtggctcctggaggccggcttcatccgagaagtcatccacccagagtggttggcaaatccagtggtcgtcccgaaggccaacggcaagctccggatgtgcatcgactgcacggacctcaacaaggcatgccctaaggatcccttccctttaccgcgcatagatcagatagtcgactccactgcggggtgcgaccttttgtcgttcttagatgcctactccgggtatcaccagatccgcatggctagggaagatgaggaaaaaactgctttcaatactcctgtagaaacctttattatacaactatgccttttggtctcaagaacgcaggtcctacttttcagcgcatgactcgcattactttgagtaatcaaatagggcgcaataggcgcaatgtagaggcgtatgtcgatgacctggtggtaaagacacgccaccaggacacgttgttgcaggatggctgagactttcgacagtcttaggtccacgcgcatgaaactgaaccccgaaaagtgtgttcagtgtgccggcgggcaaactcggttttctagtctcctcccgaggcataacccccgcacatccttcggcttgtgcaggcttggccgagggctaccactgttaattatgttgtatcttttcccttccccagcaataaatttttccgctcaagcggaggctattgcgcgccctttcttactccttcctatggctcgtcctgcttcaaaggatgattcgcgcttatcccggaccctaagtggcgttgggcgacctgaaaaccgccgaaagggagcctaaacgcgggccgcgccccgggctgcggcgaaccctgggggctcggaagggcctacacacggccatccccgacccccggtcgtcgtagcctcggtctggccagacctgctaggcagctccctcggggcgacggcattgcccctcgccacctaggtgccacgggccgagcgtgagtttcccttttcaccggaacaagcccgaggagggacataaagagggtaagaacggcaacttaatcataagaaagtcaattgaatacgttcgctttggtttcttcttctttctttgccgcagacattcaaaggagaaagcaagaatgtaaaggcgcgaaggagaagctttgtttacaaacagtatggcacgatgacctaaagtttgaagcgttcaccgcgagcacataacaaaataaaagaagaaaagcggggatagtcacggagtgcccgggaccccgagtccggcgccgctgaccacctcgtcccagtcctcgccgccgtcatcgccaccactgtcctcgctcccctcccctcgtctgaagcaagcgcaaggttgaaccgaggggccgacccctcgaagctggagacgatcgcgtcggccgcctcctggacttgctcccgagccctcgcctcggtccccggggggaagtcctcgagcgcgcgccacaggacgaagtcggggtcgcgagcttgatgacttgcgaggaccagttccaccgcagcccgcgccaaagaagccgacaacgacttcacgacctcgccgacctcctcctccagcctctccaaatccgcagccatcccgtccagccggagcgcgagtgccggctgtgtgggcgggagcttcctgtcccgacgcacggagatgcctacccggcgccccgcgcactccagccgttcgacggcgtcggagagttggccaggtccgatctcgttggtgaggcggagggccgcaatctctccagcttggtcctgcaccaggagccgcaggtcggcgagggtgctttgaaccgcggtgagttggctcatcaactccgcgccgccgggctgcccgcctgccgccagctccttctcccaggcctccagctcggaagccctcgccgccatcgccgcgcgctcagcgcgggcaccttctaaatgccgggcctcgcgcccggcaacggcctcctcgcgtttcgcgagttgctcgcccagccgacgcgccgccacctcgcggcgattcacctcggcctcgcgtgcggcaagcgcggtgtcccgttctcggcacgcctcctcccgaagccgcaaccccttcgcgcgatgagccaccgaagcctctgcggcaagggtggtctggttgcgctcggctgcggcctcctggcggaggcgaagggaggactccgcctcggccgccgttctctcgggcggccaaagtggtctcgcgctggtctagcatgcgcgcccgctcctccagcacccgagcatgctcctccagctcccgggctcactgcgcctgttcccgactgcgcccgtcctgttcgcactggttacggtcgaggacctcaatccgtcgatggatcgtggcctcgaactcctgcgcggagcgggcgcactcgtctaaggccttgcgattggcctcgagcgccgccaaccgagcccgcagcgaggcgtcgacctccgacgcccgccgctcttaggcagcagccgcgtcgaggactccgcgggcgtcttcgaccctcttcgccagatcctcggcgtgggcctcgtactgcaagcgaatgtcgcccagcgcctcatccagtacgctcgaagagataagcaccgcctgccgctcctcctccgtctcccgcataaccgagtccagcgtctcttcgcgcgcctagttctccgccagttgggcttggcgcattttgcgccccacctccaccatgtcgtccacggcgcggcgcccctcatcgactcgcgcgcggtccgccgcgagctgcgcccactccacctccagggccgcctgctcgtccgctagggcttgaacttgggcattgagcccctccaggacggtggagtcggcagcggcgagcacctgcaggagtggctccatgctcacgggagtcggagaagaaaaagacggtccgcccccgagatgacggagtgctgctggaccccccgcgagactgggggctgctctcggcccctcttccgcgcggccagccccgaggacgccccaaatgcagaggggaacggttgcccccgtcaccccccgcctcggcccctcgggcagactcggcctcggcctcgagttcgggcccgcccccggcctcagcctccaggccgtgccccgcctcggcccccggagcgtgttccacctcggactccgagccacgacctgctttggcctccgcccccgagtggcgctcctcgtaggtcgcgccctcgggatcgcccccggggggacgccgtcgccgttgctatcacccgcggatggttgcacctcggctgtggcgggctcggaaccagacccggcgtgtggcccgggggccccaccagggtactgcgaaggccccgtgacaccgggttggccgggtcccggtcgatcccaccgctcggattttgacccctacaagggatcggacgccgagaccccctgggaaggaatcccgctacaggagaaccccaatcacgttaaaaaaaaaagaagaggaaggaacaggaggccgagatggatagagagcaccgagtcggatgctggcgatcattcctgcgaggagggcgtttgaaggtccacttccggggctcgatgaagctcccccggcacggctccgtttgccctatcttccggagccgcttcttccgtccagcctcggacgcggcggggcgtttgtggcccgccggtggtcggtccgccgttcgctcggcgccccctccacgcgggggagaaggcagccgagattcgaacgccttccgcttccctttcgggtcgccggccgagtcccccccgggtccatggctcggaccgggcgcccaggagccgacgcccccgccggagccgccggcccggctgccgcctacggtcgcgccgctgctacccgcgccgtcgccgccaccaccggcgccgctccggcgggaccgacccctgccagcaccgactgccgacatcacagccaggatactctcccggtcgcggtcgctgcagagggggaggatcccgtccggaatcagcgtttgcttgatagtgtccaggcccagcactcgccggatcaccgtcttcgcgtcctcctcgccccagtcccagcgctcacccacgtgggtgcgcatgggatcgttgtgcccagtatactcccacgcgccgcgggaccgctcctggagaggcgcgatgcgacggcggtagtcgccgaacaccatcgcccccgttaagccttagcttcgcaggcccctgaggcgatcccgcacggcgtcgtactcctcgcccagttccgaaactgccaaccacgcggcggatcgttcaggagggccgacggggagccgaagtcgcggatgatccggtagcgcggtgtagaaccaatccttcttccaatcctcccacttcttgcagaggtggctctcgatgtactaccccgccattcccggccggggctggaggtagcatcctcccaccgccgcgccttgctgcagctgcgggatgaagaaggactggaacagccgcatcgtcggccgcaccccgacaaacatctcgcacaagtgcgcgaagatgaccagcgtcatcacggcgttgggtgcgagatgcaaggcttgaatctcgtagaaatccaaaacctcatggaagaacctggaaaatggcgggatcaaccccaccatggcgaaggacaggaggtgcacggatcgctctggataccacggccgcggccgtgactcccccaccctcacggcggcgtcctccggcatgatcttgcggacgaggctaagatgcatctctgccgtgatgcgcgacgccgggagcacagcgtcaccagcgtcatgggccatggtgaccggcggggaaacgacgaggagcttggtgtacagaatggcgtggagcgagagaagcgatggggcttgaagaacgagtgagcgggcgagcagtcggcgagaagaaggggacgaactcgcccccttatccttttatccccgcctcgcccgcgctcgtctcctcgtttcacgcccccgcggttgtctcctcgattcatgcgcctcatcgtttctcgcgtccactcatcacgtcgcccactgaatccgcgccccgcgttcagtgaacctgtcagcggcacactcagcgcggggcgtgcgatgttcgtgggcgcggattaggcgggcccgccgtcggtcccgtcgcgtgcctggcaggcgagggagtcgaggcggcgtggctgacgattctgggcgtggtctggtcgaccccccgattttcgcgccttaggcgcccccatcatcagcgcggttaatggcggtcaaatcgccattatggctaatgcgccagcctggccgcgcggcggcaaccgtcaggattccccgtcgggcccacaacctcggcacgggaagacgtgaggcgccacgtcagactgccctcacaaggccgatgtccgacgtggtgccgggggctactgtcggagatatgggcccgggggtatgcaaagtgaggggaagttaccttcccatccagccacatggctctacagcctggccctacccccgcacctcgtgagtcgcaggtcgcagaagcggctggggggcctcggggtgccacgtcatgcccctcgagctctcgcgttgccttgccccgaggccctcccccagctgctatgtggcggggggagcgaggggaggaagcccaggctgaacagccatcaatgcgcggcaccccaactatccctcaccgcgtttaatgcggtaaggacggacgtgcggtgccgcaccactgatccacgtcaatcgggtctgactagtctgtgaccggcctgtcgccggtcacgttcgactgaacgggcggcagtgcccccacgtcgcctctgtatccggcgaagtggaggtaggtatgtcccgtcccatcgaaacgtcattcggagttccctccgtgagaggaggatcgccacaagtcttcacccatttatgagggaatgacagggctgtcccccgtgtcaggcggggggggtgcgttgggtcccgctcaaggacggactgctgcttagcttccgggcgaaggcacaggtcgcagtccggtcaaggtagagtgggtccccctctcgtagaagagtaggtagaggcggtgcatgcggtatccccttgaactatagaaggaggaccttgcccaccgagaaaaggagcgactctcagtaagcctgaactctaggagaagagaagtgggagcgctctccggagtttaggaacccttgtaacactcagccataatctcacacacaggagtagggtatcgcgctccatagcagcccgaacctgtataatcttagtgcccacacgcgttttagtagcattgagggcggattcgcgatctccccacgcgagccttttcccccggccgaactcactaaaggggatctcacgatctcccgctagagaggatcactcctcgacagaagccatcttcaacctatgaatgccaataaaaaatgaattggagataagttaattatacataccactaacatatctgcttcaacaacttcttccaaagtagcatgaaatgcttccactagctgcacaagaaaggttactatattattactgtcaccacagtagttgaaaaaggctttcatgcatcattaaggttcccctggaggcctagaccaaagtggcatgatagtgctgtgattggcagcaacaccacaagggcagggagagatagagtaaggaatttcaggtcactcttgcttagcacttcatgagctaagacctcatgttaaaaagagcattcctaagataattcaatctaagagataagataatagagaaactaggaagtaatgaatatgtgaacttcaaaccacatacttgcaactaacttgcagtgccagctcttttctctcttttactatcaactctgcacagttctaacctagtagcacaatgtaatacaagcctctctgcagcattttcttaaaaaaatgtattaaccaaatctttatagtaaggtgaatgttggggtttagcagaggtcggcataacagatggtttcgctttaaatcgtgccagcagtgctgttggcagagtacaaaactatgcaaaataaactaataacttgtatgcaaaatggtagacgctaaatccacgattgtgtcaaaacaatctgcaaggtcaaaattaaatcaagaaagctacctgcacaggcaagtctgagatgaagccaacagtatcgctaagaagtgcttttctcctgaatagcatttgacaaaaaaaaaagattatatactgaacatgcactaatcacaaatcaaatctactgacatacaatagatgaatgaaaaatctattaaggtaccctgatgggaggatcacactgcgtaagcggggatccactgtagcaaatagcctgcatggaaacagtaaaatgatttggctacacagtgcacatttaaaatagtaagctatacagggaaaagttctcatcatacctgtcatcactgtatagatcagtttcagaaagtgcactcactagagtggattttccctgtaaaagatagcatcaaaggaaggagtttgtagaaagctcagatatatttcgctgtatttctggaagagcatagaaaatggttgtccaatattaagggagagaactgcaatggcagatcaacgtactgcattagtgtagccaacaacagcaacagttacaagctcttgaccaaatgagttgccatgccgttttcgatttgagcgttgtatcgctctagttcgacgtacatcttcaatttgagctaacaatctgacacggcattcctggattctacacgagatgcagtaaaaggaaaaacgatgagaaatttctgataaaaatcaggttcaaacaagattctatcaatcaactgttaggcacctcctccgctgtagttgaagttctgtttcaccagcaccacttatgaagccacgtcccccacttcctctcctaaaagccacaacagtgaattagtcaagatcaggacactagacacaataagaaataagatttcaacaaaaatgtgtttaagatggccacaaattcttagcaactacaacatcagcacagtgatgacaaaaggaaatgtatgtcaacttccttttttatactagcttcaattatttccatgcacatttaaaactgtgtatagtaaatacaaacaaaacaagtaataacaatgaagattgacaagtggatctatgcccattttgaatttgaatacttcatgttatcaaatgcataacaaatttacgtattcaactagcaaatcacacgaggcacataccaaaatgaacatgcaacagccacataataatgtttctctgaaggacctgtgcagctatgttagaactataccagcaagtacatcgtacttgaactaattgataaggaaacaatggcagcaccacttttacattagcatgctaaatctatgccctaatgtatccacaacataaagaaaaaaaaagacataacactctagttcttgcaccaaaaatagttaaaaaccagtgtgaccatagtgatcattttcttatagtgggaatttcatcttctgcagttacaaccgtaccaggaatatgcatgattatccagttgtgcatgataaaaatgagttcataattctaaacgatataaacaaagagcaatgttgatgtcactacataagtgtataagtacaatttaaatgttgaaatcttgcaggttgaaatcaactacaagaacatgcaagtttaccatgtttcaaaatgtggaccagcacaggttaaagttcatccttgacattacaatatcattgtaccaaagatggcatccacattaaattttgctcatcattcatcaaacaatattttaccaccgctgactatgattaagagcagacataccctcgagcacttacaacttcagcttcaccactcgaaccaaaagttaatcgtccacctggaccacggacacggacaagtctagtcttcatgtacatgagagctgctaactctgactgtgccaagcaaaacaatagagcaattaaacaaatatccaaatgtcacagcatatttccatgaatattatgcatcaaagagaaccatatacatgcactcaaaagatctgacaagagtgacattttggtcagatatcaaaatggaatggacctgtaattttgcttcttttgtttcagcgtgagcattaaatatctcaattataagcccaacacgatctaaaaccggcttaccccaggcaacctgcaaaataagatatcatcatgaacaaaaaggacaggaggctcagaaattcagaatgcggcacaataattgaaacttcgacaaaatctaacaaaaaataagcaggagcacttgcctccaagttcctttgttggattccagtgagaattgcattaacaaaaactgcatctactccttcctgttagattcaaaggaataccagataaatggcgcttaaggcatactggaatattttccttcatatatcatacatgtcggaattgaccgtgcaatagaaaagaaagcataagcaagtgcgatcacaacacaaatggaatatataatggatcatccggggtgtaaaactacaaatgaagttacaccgtagtcatgtttatgtacaagaaacaaataaagagtgcacctctgattccgatgtcctcaggtagcacttaacattatccacagttccaggtccaaaaaatttatctgtatgacaagttgtcacataaggttaaatcctataatccaagaaaagccgacgaaagactctcctaggtgaacagaagtatagaactatacaaatgctggcaaaaagttctaacaaataaagttacttgatagcacagctggaagtgtcaaccagtgaagctcaagacttcacctatttgcttattgatcgaactctagaaaattcagtctgggttatgaagttcaaacattgcaaacaaaaaactacgcatatttagcaagaaagtggttagcacctcaggagaaaataattttgacattttgaaaggattaaagactcaaaggtacaaatcaacttcaccactaagaaaatgtactacaaccacatcttcagagcaacatagaaatgccaatgagggtcttccaaagaaacatgacttattttataccatttccagtaaaaataactggcagatctatagaatgtattgcatcactaagcataccctaaccttaacagatgcaattagaaataacctcaagccaatctagccagccttatttcccgttttctcaagacagaagaataggtagagtaatgcgcctatatgagtactcatgagcaaatctcacccaactctgtatgcacagccctctagtatgtgccatccaaaaagctcagtctataagtaaaattcaaacaatcagattaaagccttacaattcgctcttcattcatacaatgctaaaagtgctaacctaataatcttataagtaaaattcaaacaatcagattcaagccttacaattcgcccttcattcataaaatgctaaaagtgctaatctaataatcttataagtaaaattcaaacaatcagattcaagccttacaattcgcccttcattcatacaatgctaaaagtgctcgtctaataatcttatcacaacaaaccccaggtgtgccagaatttaaataaaaatcgctgcatatcgcatgccggcatgcagaaaagacctaaaccttcgaaatacaattacgattaaatacactcccgcttgagttaaccgctggaaatgaacaaaagattgccacataccgacatgggagcggccgcgggatgaggggttctgggcgacgaggtggggcggggcgcccttggcggcgagaccttccttgtagaagccgtcgcgcggctcctcgagggagttggcgaggttgagggcctcggcgagcttggagtcgaggagcgagcccgggcggaggcgcggctgcaccaccagcagccgcggcgggcgctcagggtcgcgggggagcagggagaggccgcgcggggagccctcgtcgtcggagtcggcgggcggcgacgcggtcggggaggagcgcttgccccagcgggtggagagggagcggagcggagcgggcgtcacggagggtaggccgtggtggtggtgggcgtgagggtgggggtggaggtgcgcgcgcaggcgggagacggcggcgcggagcatcgcgaatggcggcgcggcggcggcggccggtggtgtggcgttgggtcccaccggtctagcactcgggcactgatggaggagagcggttggatcgagtccacgagggatcgtgggacgaaccgcgacggtgcgactgcgcgaccgtgcgacacgagtcggtatggcgagagcggcagcaaaaggtggaggatagaattgctatcttgccatctttcaacaagggtttcctcatagttgtgccgtctattgttatatatcgttaaattatcattttaaacattgtctatacgaatactattataaacaaaagttcacttgaacatcacttctcctttcctttaaacacgtcaatgtgtttgtcggcagcaccaccgaatgccatgaccaccatcactctcaccgacgatgcactgcgctccacttcatcagctcaacccacatcacttcctagttgtgccgcctaatcaaagccatctccataatacatctgtcgtcatcctgcgaactccccgcacatgtctctctttggcactccgtgcgtcatggcggccttcacgtcgtgctgatagaaaagccggactgcacagcttggcggtgcacaattaaacgatggggtgccagcggtgggctggctaggtgtagtgtactcgtccatgtcccttttcagcagcacgtgacgatgacggttcaagccagtgtagcaaggccatcggagttgaaagagaaacagagaacgaggacatttcagtctatttatatggcaaatggcactctaacgtgcaatgtctatttgaaattggtaatttagcaaaatcaaaatgcaagacaacattccggtgaaacccatatttgaagatggcacactaacaattttctccatgtagagaggccaacggtagaaatattttaggaatgatcttttatgcagaggtgttcacgtacaacctgggtatcccaatgaaccaaaccgcttgactagctagtttttacgcgctggattgggttaggctataaacccatctaaatcatttgtatatatgtaagcacaattttttttccgtccccaatttcatctcgtctgtccgtaaggaataagcagcaagttagaaaaaagcatcattttttcgttattgttgccgccgccattgtcattctccttgtcgtccttgttgatcgaaacaaagagcatcatgtcaggccaggtgccacaaccaccatcgtcatcgtccttctcattgtgcttgtcgcacgagaaatggagcgctatagtgataatcgatggtaattgtgaatgtattcgacgtttttttttacttgtgagcaatatgatacattagaggagtagaagacggatgcaacaaggaagggctcaccatttgcttcatgttttacctgcttgtcatttgtcagtcacaacgttctccttgtttttttcgatgaatccgaacgagaaagacgacagcttaaactgactaaaacaaatcatataaaatagttattagtggttgggttatagagtgaactcatcgtaaacccaataagattctactttccaaacaaaatatattgtgaagagaaattcttgtgtttgaaagtaccgtttaacttggacggccataaattaatagagctaggaagtttctaaaagctatcaaatggtgaatatggtctatttaaaatcatgttttcttgaagtacagtgatgtcaggatatatatttacttatgatatctaaaaattaatataatcatctaaaaccaggtgggctttcttaagtagaagatctggaagatcttactcaaaatacaatgattacaaaaaagtttttattgctgtccctctactactccctccgctccaaaatataaacatttgtttatcgatatggtttttttatgctactttgactaacagtatctacaaatctacaaaagtaagatgttttaaataaaaagagttatatattatgatggttcgtttaatgatacatgattaatctttttaaattttttgctattagtactccctccgtccgtttcacaatataagactttctagcattgcccaaatttatttagatgttaatgctaaaaagttttatattgtgaaatggatgaagtagttaaaatttagaaagtttgacttgacactattctaaaaatacttatattttgaaacagacaaagtaagatttagttacatctagagcttatctacgaatagtacttgcgtttccatattgtataagtgatgaggtagaattcatacacgcgaccttcgagcacattttgaatagaaactagtttcgcttacggcttcgctatcacgacacatatccgtccgatctctatgctacagtctacagaatagatatcccgacgtcgtcaccgtgccgccgatcgaaccttaccgaagaaacgccacgattttttcaccccgtgccacgccacggccacggccacggtcggccactcggttggcgcctccccgacgcacgacgacccgcggttccctcccgtccccggccgcctcctgcctccacgcgcggctccacctccacctcccctcccctcctcgccgcgccgcgccgcccagcaatccaactccgaatcatcctcctcaccccgcgcggcgccgctccgaccgaccaaccaaccaaccgcagcggacgccacgcgaggggaatcgaagcggagacgtaggggcggggggaattcggccgaggggaagcatgagcttggcctcccacgcgcctagccgtcgagctcgaatcgcgtgagataaggggccgcgagcaccgtggtgggagagggagatggcctcgcgggaggacgaccgcgccggccgcggtggcggcggagggcggacggagcaggagcggcggccgtccaaggcgtgggggatcctcatcttcggcctcatcggcgccaccaccgccaccttcgcggtgagcagagcatcccctcttctctgttagtctgttacttttgtgttgattgatagtcgatgacctggttgattgattcaatacgaatacagtcctgtttcaagtgcccagcttactagctttcttgtttagtttcacgccttccgtgatgacatgactgtttccatttagttgttgctttgatgaaatttgctcctgtatctgcaattcggcgtcaaatgctccaattaggctgtttgcatcgtttcatgcccaaggtagtggcaccttcagtgcttctttttaaagataatgcaagtttttattgaacccggtcaattatatcaaggtgatacaactgcactgagaacattcctagcctctgcaaggatttagtggttcttatgcagctccttgtggcaacgaagcatgtggctctttaaacctgttattagtagtaatgctcttggcttcatatgtctctttgctgaccaaagccccaaggtcctaaatgctatcttaagattgcacgagcactgcagatgggtaaaccttgtgctaggcaggtacttactcccatcctcatgtttgcgaggtgggttgctaaggattgttgctattattggaaatcctttcgcatctccgttcaactgtgatatacggttattgtttttgctggaaacaaacccttgttgtaagctattgttacgacttacaagttgcaaagatcacctgtgcttgacctttctgtttcttcttaccatgtaattttcaggttgctcaagttcgcagaagtgttgattgggtctacagtcaggtatccaagttagcatctatctgtttgttgattggtcaaatgcaaactgttgcttttctttgaactaataatatgtccatgcggacattgattcattggcccatatgattggcaatgggtttggattgtggctgcgttacgcgcgtggagggggtgggggggggggtatgtatggggcacgctcctctcggtgggggtgcggaggggaggagatgggcatctccactttttaagtagtagagaaatgtagacatcccaaactaaatgtcctgttccagctccttatctaatcaggattgttctattcaagcagaatgaattgaagcgaagcccccaaaactttatggtttgagccttgtacagtatagagacatgatctgtgttgtggggtggaacattctttttaggttaaaacaccatatagggttttttttacatctaatagtcggtagttactccctcagtcccaaaatgagagttcgaccattaatacatggaaaaatatataggttagctttaataaatagtattgaatttgtcttgccaaatgctttcataatagtattgaatatgacttacatttttggatgtttgggagtaatagattgtttgctcaaatgtagtacagttcggcaataacaaatttaatgtgtctaccccatagacgagcattattatgatagaccagtagggtaagattcctgtcaatcctctctccctcgtcagttctactccaacaatggatttgcgtaggaacaaactcttttcttgctattgcattcaattattatttgattatttctcagtctccctgctatatgtcggaatccctttggttatattgttatcccaacaaaaatgctgtgtagtcaggaagctagccaataacagatgactgatttatcatcctatgtctccgctgtatgcttatacttgtctgtattttgattctttccatcatttacttatatgttccttttatgtctccctttcaaaagttcaataagatgcagacaacatcttggaggaatgcaagtaacagctctaaccgtggaagtttcagtgaggatgctaggagaagatattaccaacgtatgcaacaggaatatgaggaggaacaagagagagttgtaagttttaaataatgcataatccttttaacttctttatattccaagacattcatttatctttggactttgaatttggaagtcggacattatatgaatgctgcctatacattgtaactgctgctgttaaggtttagaaattatcgtgagctatgttttaattaaagttatacacattcacgaggaacaaatgattcctatttcatcccttaaatgtctcaattcaacatcttctcaggtccttttcccatttcccttcagtatgttcactttttatttgcttttttgcagcaaagaataagacacatgcaaagtgttttcaacagagagaggaacaagtttaggagaagttatgaagcttggagggagaatggccctccaggtggatataattatgtcccacgggacgactggtactggcagacagatacatcacactcggaacataaaaataggcggacatatactcctgcaggacctagggtgtattctatgtcacatcactatacagtccttggtctcaataggtatttgtttaagtctctagctgcatacttctgttcatctgttaatatactcatttcatggtacagatatattttactgccatactcagtattaagtgatctgtggtttatggtactctgaagtttctcaaatcaatctaaattgctaagagcctcagacacatgttgtaatatagtggagctgaaggtttagtattttggattagaaggctctgttaaacatttcatgtagtattgacccatggacttccttgtgtatggtataatctggctaatacactagtcagatggtcattcctttttttgcactgagttcttgtgtttttgtttgaatctggctattacgtcttctaaaaatagaacaagcctgctttgcttcaatactaccattttatgaacccagctctatattacctgaaatccctaaagtggtcctttggtagtaggaagctttcattagcatcttgcagtcatctggcatgcgagaggttctattatgggaccagtttctcattgctattttttgctatataatcaaggtcaaattggcattgctatattgttctgtatattcatgttagtttcatagtttttttaccaattctggttatctggtgaaacatttctgctattgataataaaacaagttgtcaattagttggtatccaaagtagtacactagaagcctttataagaagtgacggaagcacacgtagcacactataatcagtagtgaaatgaggattgttgatccttaaagaaaaggataatcctttgtcaggacagacatcaaggctatctgagctcagtgaactaggatattttgatgtacagacaagtctattatgagtttaaaagataatcttggaaatcttatatgctgtatactggtgctgcgatgtttatcccttttctttacgcattcagtagtacataagaaatttcctattgcatttctaaaagtttttttttgcaatctaactgttgatactcatagttcttgatggaaaggaacaaataaactatgatgtcgatttcatttgattaaacacaatgatgcttttatccccatttttttcccttccctcaactgcctttgtttgagaataaccttcacaatagtaggatgtgctacagatataccaatttgtcctaacaagccatgtcctcctttgtaggtcacggacaacaccatacaccgacgcagaagtcaaggtattgtattcgaatatctgtctgtcatgctattgttcctccagacttgtactgtagtatgttttaacttgtctcagctgacatgatagtggcatttcctctgatggtttaattacctcctttctgatcctggatggaagcctaccgcctgttccagctttctttatgctttcaactacctcttttttacatcccctttgttgtgctaaactcttttgctctttctgattcaagagttttcatgccttttcttactagcaaagaaatggaaacattatgtttgtgattatttatttttgttttaccatatcacttatcaaatatccaagctaactaaaaatccttcagctagctatccagaaatcataccctgttaatttgtatggatgttgaggattttgcattgtgccgtccccaattttcctacgatggaacaactctctaaccgtgtttttcaataattcttacgtgatctttgattccaccaatcaaatatttcatattttatgttctttcctattgtatatgaatgtattaagtggctttttgggaatatctggttataaagggaatggccaaagaccatccggttcatgaaagaaattgaaatttttctcatttcctttttcaagagaagatagccccaaaaatctagtagggatttgttgttctagatctgcagaccgaatttgttgtttggtatatttaccatgtttgctgtgtgtgatatgtagctgagtatctaacgtcaggaatttacttgctgcagaatgcttttagaacaaaagcaatggaggttcaccctgatcaaaatcaagataatagaggtggctaacaactccatgctttttttttcttgattcgtcatatatatgtatcgtgttgttatgtatccacgaataccatgaacatcttatgttgtgcagaggctgcagaagagaggtttaaggaggttgtcaaatcatacgaagcaataaaactggagagaaaaaatgatgcaagttgaatgtgaatatgtagcttcactggagctcattgggaagattgaaaggatcaatgaagacagtatcagcaggccttgcaatcaagtggatgatctgttaggttcggctgtatctgttgatagcctgtaagcacaagtttttatttgcgagtttttttttttgggagcacacggccctgatgtagactaggatattgtcgacaaaggtgcaaaaggaaattgctcatttgtgcttagccactaatttggggtgcaaaatctggactgcgggtgagcatttttgttgtgtacacctgctggtttattttttattagtagaaagtagagtgaagatctgatagaaaataataagtagcccataatattatagcagaaaaacaatgtttattacgacttactcagttactctgttgtgcattagagctgtggttagctcaaaccggtgctgcctatcatctatatgcgttaaatgatgcatggatatgaattcggtttgttacagctgaccctgttgattctgcacagcagatcgcagtatcagactgaaattgtgagtgcaatctagccataaaccaacatgtcactttcgaaatgacaccgtatgatcatactctgatacgtggagagtactccctccgtcctataaaaaatgaatcttcccataaaaaatgaatctgatttatagtaatagaatatattaaatctggtactaagttgttcctataatcatgttgccacgaaaaagaaaaataaaaaatgaaccaaaaagaaaagaaaaatgaaccgggcaagcattctgggcttgcgcagttgcgccacactgccacagtccagcccaccatgcggcgcctcctctccgctccgctgcgccgccgcctatgcacggcggccgtggccgcggcggcgcccgacccggccctcgcctcctccgcggagctcgcgtaccgcctcctccgccgccaccactccgaccccaagaggctcaccgccgcgctctccggctcgggcctcgacccgacctcgccgcgcctcctcgacgccgtcctccgccgctgcggcgccgcctccgcgctcgcgctccacttcttccactggtgctccccgtcgctgccgccgccggggccgctcccttcctccctcgcgctcctcgccaagtccttctcccgcgcctcctccgcgccgtccccttccctcctcgcgccgctccccgcccagctcctctccccgtccctcctctcccccgtcctccgccgcctcccgcccccgcgccttctccccttcgcgctct

SEQ ID NO: 31999 - DNA, 23713 bp, Oryza sativa
  unsure (1)..(23713): unsure at all n locations
gtccctcgccaagaccggccatgtcgccgtctccgagcagctcgtcgaggagctccagcccaggctcccgctctcgctccgccactacaccgcgctgctctacgggtggtgccgcatgggcaagctcgacgaggccaagcacgtgctcgcccgcatgaaggccgcggaggtcgccccggacgtcgtcgtcttcaacaccctcctcgccggcttcgtcgccgacgggcggttcgaggacgcgttcgagctggcccgggagatggagcggcgtggctgcccgccgaacgccgtgtcgtacaccaccctgatgcaggggcttggcgccagggggagggttgatgaggcaatgcgggtgtttgtggaaatgcgcaggaaggggtgtgcaccggattccgtcacctatggcactctggttactgcgttctgcaaggctggtaggatatcacagggatatgagttcttggacgtcatggcaagggagggtctgcgggtggacgccggcgtgtacctcgggttcttcgtcgcgcacgagaagaaggagcagcttgaggagtgcttggagttgatggagaggatgagggagtgcaggtgcccgccagacctcagcatctacaatgtggtgatcaggttggcctgcaaactcggggagacgaagcaggctgtggcattgtggaacgagatggagaccaacgagcttagtcccggggttgacacatttgctatcatggtgactggcctcgttggccaaggcgtgctggttgaggcctgcggttatttcaaggacatggttgggaggggactctttgttgcaccccagtatggggtgctgaaggacctcctcaattcattggtcagagatcagaaacttgagcttgcaaaggatgtttggggatgcattatgaccaaaggctgtgagctcaattttggcgcatggacaatctggattcatgcactgtacgcaaagaaacacgtcaaggaggcctgcatgtattgcttggacatgcttgacgctggtctgatgccgcagcccgacacatttgcaaagctgatgaagggactgaagaagctctacaacaggcagattgctgctgagatcactgagaaggtgaggaagatggcggaggagagacatgttagcttcaagatgtataagaggcgtggggtgagggatcttgaagagaagcctaaggcaaagagaaagaaagggcagaaaaggagtcgcttgaggcaggctggtcagaatcaatccaataggcatgctgacaaaactgacctttttgatgattttgatgatgaataatttcatgcaaggactagtttttgccttctgatagttgctctatatagtttcgacttattactctagatcattctgtgtgaggtttaatattttttttcttggggaatcactggatctagattgtaaagttgctaatccaaacaagtcaataaacatgtcacaaaaaaatatattgttttttttttcatatgcaactagagcgaactgtaaaatcttacacgtgcagagaaataggtagtctgtaatgatctactttatgtctcttaagttgttgcatgcagtatgattgtgatcataagtatatctcattgtaatttcaatttgtgataactggtaggttgatgtatacgtagcagtatttcttttcccaagtttgatgggcattgaatttctctggtttcattatatattgtagtttaaagtatcacgaatagtattactttaagttacatttgtttaagtatttcttaattgaattcctcccttaagaaatacggagtactgcactaaagtaatgttctttgttctagggtggtgaggagccgaagaaacatggtttggttttctattgttcgtttggttaagccaacaaaaaccagatcgggtgttttgactatgtgtacctgcggaaaacgttggctagaagaagaaaatgactgtttgcctgaaaattgggatgaatacatacatttgtcgtgtagtaagaccccccttaaaacgcacgatagaaaaacacaataggttcccggcgaaaaaaaaacacaataggaaaaaaacgtaataattgaagtattatgtttttccaatcctatgaaaattgagaaaaaaatatatataaaaagatgagtaaattacacccgcggtacatgaacttgtgtggtgggtgcaaatagatacaacaacttacaaattgctcactttgatacaataacttggctagttggtgtgaaccgggccaaaatgatcacacaagtaaaattgctctaaattagtgcacactaatgacataacaacatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctgttcaagaccaagacaatttttatatgtactattaactactaaaagaaaattttaattttcatgttcatgttctgacactttcatcgaaagtgtattttacaatcaggtatttttaattattttgctttttcgttggtctagatcttaaaagtatcatgcgactaataatatgtgtcagtaaaaaattttgatgtgtaacaataattacacactagtacgtatcatattacatcaattttacttgtgtggattagtttggcccatctttgtatgaactagccaagttattgtaccggaataagcaatttacaagttattgtacctaattgcacccaccatacaagtttgtgtatcgtgaacgcaatttactctaaaaagatggactctttgattgcatcacaggaaacattcaacaatcaacgaagaaaagtttcacaagagatctaacctcttatttattttcatatggaattgaccataggaatggaatcctatggaatcaaaggactctagaaaaaaatccttcaaaatttctttgctaatcctccatttcaaagggtccctaaattaccatttggacaagattttttaacaaagtttcactttgaagtctttgcgctattctaaattctatattttatataataaagctaaaagtatttacatattttactttgaaccactctctaatgagcggattacctttgtaagtaacgtgtgggccaaaagattatcaggcccacatggtagtaagaaaggcaatccctaacgactaagagtaagtataatagtgggctataagaaggctgaatgctgaggtggatgggagaaaagaggagagagatgagaagcaggctgtaagtttgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacagttggcgcgccaggtaggggctgcgtcgagttttccgtcgagaagtgcgatggaactttgtgccggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgcnnnnnnnnnnnnnnnnnnnnnnnccggcctgcctccgtcgccgccgactggtgtcctcgcctatacggtcggttggtcacaccaccgttgatgggcatcgtcatctacaccgccggcctacctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctggccttcgccgactggtgtttccgcctgcacggctggcctattatgccgccgctgttgggcgtctacgacttcaccaccggcctgcctccgtcgccgccgactggtgtcctcgcctatacggttggttggtcataccaccgttcatgggcgtccacgtcttcgccgaccggctggccttcgccgccgccgactggtgtttctgcctacacggctagcctattatgccgccgctgttgggcgtctacgacttcaccgccggcctgcctccgtcgccgccgactggtgtccccgcctatacggtcggttggtcacaccaccgttgatgggcatcgtcaacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggacgtctacgtcctcaccgccggcctgcctccgtcgccgccgagtggtgcctccgcctacacggctggcctattatgccgccgttgttggacgtcttcgctttcaccgtcgaccgccttcgtcgccgccgactggtgtcttcattgttattgatggacgactttgttcccacattggccacttctgccatcaccaaggggaatattataaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagaaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacgtcaccaccggctcgcctcgaccgccgccgactggtgtttccgcctgcacggctggcctattatgctgccgttgttgggcgtctacgtcttcaccgaccggccgcctcgtccgctgccgactggtgtttccgcctgcacggctggcctttatgccgccgttgttgggtgtatacgtcttcaccgaccggccgcctcgaccgccgccgactggtgtttccgcctgcacggctggcctttatgctgccgttgttgggcgtctacgtcttcaccgaccggccgcctcgtcgctgccgactggtgtttccgcctgcacggctggcctttatgctgccgttgttgggcgtctacgtcttcaccgaccggccgcctcgtccgctgccgactggtgtttccgcctgcacggctggcctttatgccgccgttgttgggcgtctacgtcttcaccgaccggccgcctcgaccgccgccgactggtgtttccgcctgcacggctggccctattatgctgccgttattgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcgcctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccacccacgacgtctttgtgaacctcgacatctcggcatgcaatgccatgttattttactacaacaagtggctctccaatattcaggatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattactgtcggttacgtttgtcgtcgccgactattttcctcatcttcatgattggtggatttcgtcatcgcctttgatctgcctcgtctgtcaccgactgattatttcgctgccatggctacacaactttatcgctgggcgccttcatcttcattgatggctgacctgactgttgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatatatgcaacatgaattcatgatcatgggtctattttatatgctcaaagactggactatttattattccccgtaagggttatcaactgaatacttgcgccagtcgggattcaattgttatatctattttggagtatcccataagggataatcactcagatcacatggtctatatcacccgggagcatgttacatgtgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacaaagtttacagccggcttagacataggaaccaagaaaatctgtaagacagacatgtggatcatatatttatagtgaatagttaaccactatatgagtgagctgatagatagactataactaagcagctggatgtattattatcttgctctaacgagcaccggctgctgggctcctctccccgtcgctcaacggtctattggcccggtctaatagtagggtccgatcttttttggtccaaccgatcgaccgaaccgggtctgctacgataggtggaagtgtgcccatatccactcctcggcaatttcgcattccccccgaaaaatttgaaatccttttcgcatccctctcctctccgcgattccccactcccggctgcagggcggtgcggcgatggccgacgctccgccgccggtgctgacgctgcaggtgaagaagggccgccgcggcggggagacccggcagtggcgggcgggcgccgtgctccgcgtcggccgcgtcgccaccggcaacgacatcgccgtgcgcgacgccggggcgtcgcagcgccacctctccatcgagttcctcccgccgccggcctcgcggtgggccgtctccgacgtgggatcctccaacggcaccctcctcaacggctcccccctcgtgcccaccgtcccctccccgctctccgacggcgatgtcatcaagatcggggagtccagcatgctcgtggtctccatcgcgcccgattcggatcccaaccctggccctaggcgctcctcgcgccaatccgccgcagtggtgggggagcaggagaaaccccctgcggtcacccgccgtggcggacggaagaacgctgcagcggcggcggtggcggttgagccgcccattgcggagaaggaagagccagagccggaggaggctccagtggtgactcgccgcggtgctcggaagaaggccgcgcaaccccccaaagcggaggagcacgaggagggcgaggaggaggtggtcgcggcggtggtgacgcgccgctgtgggcggaagaaggccgcagagccccctaaaccggatgaggaggaggagcaagagaaggggaaggatgaggaacaagaggagaaggaggaggaggaggtcccggtggtgacgcgccgcggcaggtcgaggaaggcggcgccggaggcagccgttgcgccaccgccgccgagggcaaggtcgacgagagctgctgctaggagaggcaaggcagtggacacaagcctggatgagagggagagcgagatggccggaaagggacggggaagggctacaaggtctaatgcaaggaagtgtaggatggccgttcctgaggacgatgacgatgatggggaacagcaagagggggctactgctgtggcagaagagcagataaaggatcaaccgagggcaatggcggtgactgacggtgaggaggaagatgataaggtggaagccatggatggagaagttgaacagaatgacaaggcatcagaggaggaggaggtgccagtggcgcggagaggacgggcacgaagagctccaaaggggaaggctactgcaagtagtaatgctcatgctgcttcggacaacgcggttgaggaggaagacggcggtagaggagagggagcggctgtggaagtggagggggagagttctgggagcagcagcttggaaaccatgacactgagggagtggtttcagaggatgaatgtgtacctccctaggatgatcaatgaggctgctgaagaggcgctttcagccctgcgggagaggcatcggcgtatagatgagtacatttcaacgcttgaggattagcgtgattcatggtatgttcatctctcaagagaaatctttgtccttctgttacttctcttcagcaagttcagttctctttatgaaatttcctactgctgtcagaatgttctattatgttcgaatagctcaatctttcaggtctagcaatgacttttctgcattgcccagtaattgataattcattttaattactagatacagtatatgtataggaactgtacttgaatgcagttggtattggggccgtatctgcataaatttactatgccatgcctaatgccttattgctgactatcaatctggattgcctcaacatttgcttatgttaaagttttctcgcaacaattttgtaggatcatgtttattgagaaagttcttgcataccaaataacttcatcaggtgctcttgtcatatattttatcttcacttcataagtctgatttatgtcctctcccagcaaaaaccagaatgccgagtgcatatctggctaatctccagtgcaaccattacccattattagtctccaacatatgatgggaacaattacgatgtagttgacagttactgtttagatctgaaatgaatgtgtaattgtgaagcaagtgtgatctattcattcttgcatattgaataactgtttactgatcaattctagccattgaggtgtagcaattaacatagacaattactctctccgtttcataatgtaagacattctagcatttcccacattcatattgatgttaatgantntnnatngatntatatntanattnattaacatcaatatgaacgtgggaaatgctagaatgacttacattataaaacggaaggagtagaacatacttatatctgcagtttgttctttgcctgtaatgtttcccttttgcatccataacatatttacatgtaaaagctgcctctgtcaccatatgatgtgcctatttccatactgctagtgctatgacactccacgttcctgatctgctactatgggactgaagtttcatgagtgatctattacacaaccgaacagataattgttcagctgcagttctttgttctgcttgacgttttgccacagccaatgcttgatgccttgaactaaaatgacaatgttgaagaaattttttgcacgactctttcaagatctaaaattgccttttggtgccacaccgtcttattcagcaagctttacaacccagtgacacagaactcgcaaatagtttttcacagtttcagcgtttccgtttgagatgctgaaaaggaagatacatccagtggatcatatttttctgtgtaatccttgctcccatagtctcatgtattgagctgtggcagaagtacggtttattttgctattcatctactaatgcttgtgcttagcttttatccacaatttgcttaacatgccatctgtctgcaggataattaggagctatttggtcaatctgacgtaggggtgatgcctggagataacattaattggaggcaatgctttgctgaagcgccacaaagatttgctgaagcgccacaaagagccattaggtgatatttcactgggatcatctcattatcgattccagttccaccaaatgccgcaaaaatcattgatgcaatacactgtagcactcttcatgtttactctagttatgtagtaccagtactctagtactcatgaagtaggacctgggttcgtaggcctctatgcaaaggcattcaacatgcatcgcagatttcattctgtaaattgcctctctaaggtgatgtttattcatgcctaacctctatctggaatacaacgcgacaatgttttgaatgtatatgtcgtttctaccatggctgctattaggagtcagaactgattattttgcccctcccccgttttttacttttgaataacgtgttcctggatgatcagtatcaactgttgggaatttgttggtgaagatgagttctcatgttttgatactaaatcagaccaccttctagtctcaatgacctctctcatctcacttggaaaatgtacctgatttgttgcagtgatcctcatattgttaaaacccactctttaatgggatccttcgatcctctacatgcaacgctcagtaataatctcaggtgaaaaatgaacgaatgctcaatcttatctttattttcagcgatacgaagcgcacaatgcaatttcacctgcacagcatgaactgttaaatcgaatggcaacacagaagaaaggatcagatgcaattatctaacaaagaacaacacacgcatggcaacatctggtatccatgccattttgtggagaaaaacacacccatcacccccagctcattcagtgccatgtactgatgtacagactcacagcggaagacatttccaaagggtttaacctgctcatcgggagcacgcagtccacattctttttgcagatgcagaagcattgcttaacttcatacaatgaacaatctaagttctaagacctaccatcagtaactcctagctcaactagaacattggcagcaagagtcatcgttttctcttgccatgagtctttgacttgttctcaaggtcatttcctggtggcgccttaagagacttggatgcaactgctgagctccacagcgctctctcaacatcagaagtagtgaaaacttcttctcctgagctcaattcctaccagagaaacaaaaaatatgaaataaatgtcaatcaagcaccgcatgtgttcatcttcagacttcagctaacagtccaaatgttcaacaatctataattttgatatggaatttgcagtttactcggtgttattctagcaatgcggacgttacatgcttgcattttgcaaatataaaagcataacgttcaagtactaatcagcttatcagtatattaccctattgttgcagctgctgtctggaataaaaaggcaagcagctgaaaatttggcatacgatttttgtaatgcatactctgtaaatttatgagcctggcatccttgagcctattggacgttatgatttagagaagcatcagcaaacaagaaaaaggtgttatctttctgcactagttcttgaacagtactataacaaaaaatatgtggtggtatgttctatttcaatttcaaatgtcagctaagatcaattcttctaaaatgactccacacaaccagctaccttttgaagtccctttcagtttatctgcattaaatcaaccacatatttgaagtgtatcaactagaaatctccacacaagggaatacaccgtatttttttcccctttgtctgaactcaagtgatagtcaccgcaaaacaatcctaaagcattaactaggttcagacttgcagctgcctagcaaaccgaaggcttattatacagacacttcgatcagcacaatcaggaaaaacaaatgctatcttaacaacagtttatcacacatcacaaatgcagaagcaataccttcgatttagtttgcaacttttcagcaaaagcaagatactgcttcagagtgtactcctttgcattgcctaaggctgccaccatagcctaaacacagtccatccatgtttacaacatcaaagatgcattcatctcacctggaaatgcagaactgccaaaacaaaattcacaaactcacctcatcagacatgaacggtgcaacatcaggcgcgtaggcagcgagaacagcggatgccgtggcagggccaacgcccttcagcacggtgagctcggtgatggccttgcggaggtcaggcagcgctgcgaacgccttgcacgatgctgattctaccactgcatcctccaagcccttgacgaaatccatcagtctcggcctgcacaaaagaacagagcaacaatatgattattttttcccccaacgagtttgataataacagggtagtgtaggagtatcatcaactaaccaactagggtaatgattgatttgccaagaaaacgagtccctaaatcaatggatcaaatcagtccaagcacccttaagatactagcatcatccaattgatccacacatttcggcacgatttctagggagatttgagcgagaaatactactacaacatcacacgcccctgggaaccagaagttcaagtgctctaaagaggaacaggaaagaaaatctaagagcgggatgagacgacctccacttgccgcgggagagcttccattggaggaggcgcaccagctcgggcttggcgaggaagggctccgggtcgcggcggcgcaggagatcggggaggtcgcggcggtagaaggagtcgacctcgacgaggtcgggcttgcccagggccgcgagccggcggtcgtacgccgccagcgccgctcgccactccgccgcgtcgccgctcgcgaagtccaccgtctcggccatcgtcgttaccggaggcggcggcgcggtggaagaggtcacttcggcgcctcaagagccaggaatttcaaacagactagtatctacccatgtattaatatctctcgataaatacaacttcggcacatatcattggatatctactctattatattatcatcggtcgattggattgattgttcaagttcttctattgtctttatatcattatttatctgagcgttagaatttacctcggacatatagccaattgttcaagaccatatcaaatcggcttattggctgatcggttcttttatcatcaatttatctatcttgtcagttatagtatcaaactgactgacacgtacaaacctgatattttaggacttgcactggagcaaagcacgtatagatgatgtcagcacaagcccatctatagatagatgtttgttcctccttttttttgcaagcgtcctgtgcgttatattcttattagacactctttaggcccattcgtgaatgatcctatgtaaatgtaagcttctctattgcctttatgcgtacaaaaagattattccgtataagccttttctagtcttatttcgataccttagttatcttctagagttaggtataattatgataaataattatttctaaagtgtgaatgatattgtccattcaaatatactccctccgtaaaaaaaaaaagacaaactctaggtttccgtgtccaacatttgaccgtccgtcttatttgaaaaaaatatgaaaaaaattaaaaagacaagtcacgcataaagtattaatcatgttttatcatctaacaacaatgaaaatactaattataaaaaaattcatataagacagacagtcaaacgttggacacggaaacccagggtttgtcattttttgggacagagggagtttgatccaaatgactacaattattctaaaccacaacaaaaataatgatgttggcataatatatatttaatgtggatgttttttattttaccaattttcgtttttcgtgtgctggaacacatcaatttctcccagtggcaacgcacgaacacctacctagtgtaaaaaagaagagagaatctactatatgctactgagtttgtctcagttcaacgatttgctactgataatgtctctttgtgcaatataccgatgggacactgaggagagtacaaagttcaagaagattgcaatatatcgatgggacactgaggagagtacaaagttcaagaagattatttgagccagtgaacatatcattatgatcatgatggtgagcagcgtagtggatatatgtcccacgccataaaagaactagtgtgcttcttggaggagcaactccagcaaccccaaaacacctcagaccacgtatccacccagacatatctacgtaagttcgataagcatatcagtcatggtaactaattattttagtaaacaacaacattgaacaaactctccagattaactcggaataaaaccataaaaaagtgggaacaaactctccaacaaacattaacctgtaggacagaggcttgacataagacatcgggacatagatgataaacattaacctaaaggcaaggatcatcgatgtgatgctcgccacgtgaactacaatcttcaccctcttgatctccatggttttgggttgctcgtcatcgccaatttgaaccaccatacttattttctctaatatctattttgtcatatataagtcaacttaaacgcataccacctatacacgattcttggtagatgagcactacgcgaccatccgcagtagctagtagcgcctcctttatctcactctctcccgcaccgtcgttgcaacagtgcctaagagcgaagtccacgacaggcaataccccacatgcccccctacgctcataaaacaaagggtaccttatagaaatagttgatctccatggttgtgggttgctcgtcgtcaccaatggagcttaagctaaagtggaggggaaacctatagaaataaacatcaatatttgaataaattgatcaaacatttaaaattttaggatgagataatcaatttaccatttattttggttaattacaacactttgagctaacatatatcacttgaaagaaaatagataacaggatgacaaaaacgaatcatccacaataagaattaacagatatcacacctgaaaataaacttacactaataaatataaaaagggtttgttggaaccatgctaaatttgagatatgccacccgcatctcaatgacatgtaggacccacgagtcaatgacatgtgggtcagggtggcatatcacaaattttgcaaaatttgtgtggcatggttcaaattgtcccatataaaaaatgcattatcatttgcagcgtaaggaaatcaaacttaatatgaaatgcattcctcagcacgagacggtagatgtgtacatagtgctaacacaatcagatgtagagtacatatatcatcctaatcctcaagacgaaaaatacgtgtagttttatagatcctcctacttctcggcacgaggaaatcggcatcgaagatccatagcatgcctagtgccttgacaatgctacgatcgtgttgtctagcaagtagggcagtacccaaggctgcaattagccctacctcacgtgcagcacatgagtacctgcatgaacataaatataagttaatcaaattagggggcgtttgagagggaagtgagttgaaagacctcatttacatggcaagcattaaggcccatataaataaaacattaattaactctatccatttccaagatatagttagttttataaataatttctgacactattccaaagccaagtacactcatccactgttgtttaaaaatgtatttgttgtactacaatgatgaggaaagtagtaacattttcaacccaagacaaatttattatgaaaatatattcaattattgatgtgatgaaactaatttagtattataaatattactatatttgcctataaacttagtcaagacatatccgtaaggtcggtaaggataccagtcatggtaactaattattttagtaaacaaaaacactgaacaacaaactctctagattaacttgaacaaaaccacgaaaaagtgggaacaaactctccaatgaacactaacttgtaggacataggcttgacataagacgtcgggatataatgataaacaccctgatgacgaggatcatcgagcacatcctcgccacgtgaacgacaatcttcaccctcttgatctccatggttttgggttgctcgtcgtcgcaattcgaaccatcaaatctcactttctctaatctcgtcatatataagtcagccaaagcgcctaccacctacgcactagataagcatagcgcgaccaaccgtggctaataacacctactttctctaatctcgccatatataagtcagcctaagcgcctaccacctatgcagacaagcatagtgcgaccaaccgtggctaatagcgcctcttctatcttgccctctcttaactagacaagcacaacgcgaccaaccgtggctagtagcacctcctctatcttgccatctccgcaccgtcgttgcaatgttgcaacggagcgaagcccacaaggggccaatgggggcacatgcctttctatgctaatagaacaaagggtaccttatataaatagttgatctccatggttgtgggttgctcgtcgttaccaatggagcttaagctaaaatggaggaggaacctatggaaataaacattaatatttaaataaattgatcaaacatttaaaatattaggatgagataactaatttaccatttattttggttaattacaacactttgagctaacaaatatcacttgaaagaaaatagataataggataacaaaaataaatccaaaataataattaacagatatgacacctgaaaataaacttacacaaataaatataaaaaatatattatcatttgcagtataaggatatcaaacttaatatgaaatgcaatccttagcacgagacgtagatgtgtacatagtcctaacacaatcagatgtagagtacatataccatcctaatcctcaacacgagaaatatgtgtatatataatactgcgtatagttttatagatcatacttcttggcacgaggaaatcaggatccgaggatccataacgtgctagtgccttgacaacgctaagaactccaacaaacaccgctagcacagatccaactaggaaccgtgtgcactcaaccacgctgatgcaaagatcatgctgtctaccaagcagggtagcgctcaagctgcaattcaccctacctcacgtgtaacacatgagcacctacatgaacatagatataacttttactctatataacttaatcaaattagggggcgtttgaggggaagtgagttgtaagacctcatttgcatggccagcattgaggcccatataaacaaaacattaattaactctatccatttccaaaatatagtcagttttataaataatttccatgacactattccaaagccaagtaccatcatccactgtttgtttaaaaatatatttgctcgtactacataacgaggaaagtagaaaaaatgttagtagtgctttactactccattcattgcccagcttattttggtccatcattggggagggatctttcattgcacggcttattttggtccatcattgattggggagggatctgaggaaaagacattgaaagtatttcattttattctcaattttttctaaacaaactattaatacttgtactttgaaactgagagagtagaatttattgattatcgtcatgctctatgcatattaatcatgagattataaagtataaggagattatttgagccagtgaacatatcatattgatcataaccatcatgatgtgcagggtagtggatatgtgtctcacgacacaaaagaactggtgtgctgattggaggagcaactgcaggaacccaaagcacctcaaaccacatatccaccgagacatctccgtaagagcaactccagcaaccccaaagcaccgcaaaccacatattcaccaagacatatctccgtaaggtcggtaagcatatccaccaagacatacctacgcacgattctttgtagacgagcacatcgcaaccaaccgcgaatagtagcgcattttctatcttgccctctccgcaccgtcaatgcaatgatgcaacggagcgaagcccacaaggggcaatggggggcacatgccccttaagctcatagaacaaagggtaccttatagaagaaatagatgatctccatggttatgggttgctcatcgtcactaatagagcttaagctaaagtggagggggaacctacagaaataaacatcaatatttgaagaaatcgatcaaacatttaaaatattaggatgagataagcaatttaccaattattttggttaattacaacactttgagttaacagatatcacttgaaagaaaataggtaacatgatgacaaaagtgaatcatccaaaataagaattaacagatatcacacctgaaaataaacttacactaataaatataaaaaatgcattatcatttgcagtgtaagatatcaaacttagtatgaaatgtaatcctcagcacgagacgtagatgtgtacattgtactaacacaatcagatgtagacgtgcacattacagtacgactgtgtacatataccatcctaatcctcaacatgagaaatacgtgtgtatatatagtactatgtatagttctataaatcctcctactacttgtcacgaggaaatcgggatcagaggatccataacatgtctagtgccttgacaacgctaagaactccaacaaaccccgctagcacagatccaacatgatataaagggcattaagtggaaatcctctatgtttaactttgaaatcaactagttcttgagaggatttacaacatgtagttgaataaatttggaattcttataatgaaaagggttctagtattgacaaatgcgttggagaatgcaaatgataggaaaaaggctaaaaggatagaacatgaactgagatggtgaatacaaatggaaaaaaaggtggcaaatgaagtattcatatcaagattcggatagagatgagccaagagaagtttggagtggagggactgaagtttttgtgtgctcctctttttggcctgatgccgatggatgcaggttttctgccctagcttatttgtagtttttttggtagtcgatttggtcacacctgaaccaacgagaattaggccaacaccttttattttctttcttgaacttaatttctcttaatacaatgatgcataattctttgccgtattccctgaaaatactttcactgaactaaagtatataagaaggagaaatagtgatcaagctaataaatgaaacatggtgtaataaaaaaaaccataaacaaacatgtgagattgtgataaaaagcaattgtaactatatagcagctcatccctcatgcggagagagagataatggggagaggggtgtttataataaggatgagtatgcattcatgataatcttaacaacactaaacaaccttgactaacctggccaacagttcttgtgtgcacaatccagaggaaggcactaaatcactacatgccaatcgatagaagagacaaatacttggatgagcccctacaatatgtccacaggcaaaaaaagttgacagacttgcttaggagcacaccaaaagccagatcaagtaaatacaatcaccaaacatctattttgttttgtattttttatacaaccccctaatgggaataaactaagcatgttcttattgatttagttgattgacatggatgagccattgaaatatttgttaaatataaattactttccattaaaatataataacaaaaacaaggaagaaggtttccgcatgtaaaagtactaaaaagataattcaatatgtattcaaactttagtagtacctcaagaaacatttcatcgagcagttcttgagcaccaaaaacctctaatgcgttcctcctcttccttgttctctttgtatccttctattctctagccatggcagcagtacacggcatcacatacatcatgaggtcagcacagagcagaagcaaatcaacaacaaatcaaaaagagcaatgcggaggcagtaacataatagcagcagcaacaacaacaacaaggataccaagacaacaaggaagaggaggaacgcattagtggtttttggtgctgcagcggaaca

SEQ ID NO: 32000 - DNA, 2465 bp, Oryza sativa
  unsure (1)..(2465): unsure at all n locations
ccagttacgtacaacaactgtcaggcgactcaagctcgtgctgcccaccggtggtgcttccattttttcccctttgtccgcaggaaaccgccactatggccgttaccatctttcccctttgtccacaaaaaaccatcgctatccccatcctttgcatctgtagtgatacatggatggggataaacggaagacaatggatcattttataagatttcatctcttcctcctcttatggtgacgacgttgcggcctgctacctagtcccgctttgctcgccctagggtcacactcggccctcaacccatgctcactgcgttccttatggcgaagatgcggagtcgaggacgacgacagatcgacagcaccgacagcggtgggcaggcggcgatgtcgagcggagttgatgtgtagcggccacagcgcactgtgttgaggggaggtggcgacatgggacaaggtgacggtgctgggctaaggcgcacggtggcaggcctgttggtgagccggcgacggcattggatgagggatggcagtggcgatgagccacatgggaaggaagaggggtggttcaaggcggcgacgaagtggaggcgtggggtgctcaaagcaaggaggttgtccattggtttcactaatcctactactaatccatctgctaatccaactcacaatgtaggtcgttagatgagaggatccaacggttaggaatgatctgggtatattttgttaattcgttttgactttttccgtagccaaacttaaccaagttttttgataacatatttgttttgtatttaaaatgctatgctaacttgattaaataaagtttgattagtcaaaacaacttataatatgaaacagagagtatatgcctactaattactaattgacttactatactagtaatatgaacgtgctaacgctacggtgatatttcataaaacaatggtgatagacagaaaaatagaatcatgttgagaatcaaacaactaattatacttgttgctcaaagtatattgatttaaaacccattgcatgatcagtttcacttgagcaatcaaagcgtaaggattctttgaaaaataaaatcaaccacatacaacagtagtgggagaccatagtttacagggtcaataatcatgttttctccttttctagcctccaaagataggaacattgattcaattgtttttaaaagagtaaaatacacggccggtccttaaacttgtagggatgtgttatctaggtcctcaaaatacaaatccaggtcctagaacttgtcaaagtgtgtcatgtaggtcccaaatcgtcacagctcctccaggatcttacatggcactgatgtggcaatgacacacagacatgacatggcataatattgaatgacaaatgagacccacttaaaaaattttcatttcccttttttattctcttttttttcctttcttctccttttcttgctctcactgcagctataggccaccgctacacgggttgctcaggtcacagagaaaagagaagagaataaaagaaaaaaaaagagaagaagaaaagaaaaaaaaggaaaaggaaaatttttaaatgccacgtcacgttcgtgtggcacgccacatcagcgccacgtaggattttggaggagttgttgcgatttgggacctatatggcacactttgacaagttctgggagttggatctacattttgagagtttagggacttagatgacacacctctacaagtttaaggaccgcctgtgcactttactctttttctaaactcccaagttactttagaaaggttgattttgaagatcatctgatttctaaccaacattttttaagatgttggagaggtggttgaaaaccaaagacataaaaattacatgatttggtacaagacaatcacttgttaagcatccaaactacccttcatcatgctcagaagtaaaagagagctgaaactcacagattcagaagtttggatcactgaaggctgcaacatggactgttcacttcagaaaagagtcgacacttcaaatttatctacactgatcacacaacctaatagattcaccagacaccaatctaatgacatatattttgacaaaatatgtagcagagaaagtactaatcattcataaattacaccatgaacgttgcttaccacgtagagcaacaatcgacagaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32001 - DNA, 540 bp, Oryza sativa
cgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttaccgccggcctgcctccgtcaccgccgattggtgcctccgcctacacggctggcctattatgccgccgctgttgggcgtctacgacttcaccgccggcgtgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgacgttgttggacgtctac

SEQ ID NO: 32002 - DNA, 471 bp, Oryza sativa
ttttctcgagtattatatttatatcagatactactcatcctatatgtttgttctgcaggatccagatccagatatgcataaaagggattcatggctttaagcttatctcttacgctccaggaatggatcagtcagaacgtcaccaccggctcgcctcgaccgccgccgactggtgtttcccctgcacggctggcctattatgctgccgttgttgggcgtctacgtcttcaccgaccggccgcctcgtccgctgccgactggtgtttccgcctgcacggctggcctttatgccgccgttgttgggtgtctacgtcttcaccgaccggccgcctcgaccgccgccgactggtgtttccgcctgcacggctggcctttatgctgccgttgttgggcgtctacgtcttcaccgaccggccgcctcgtccgctgccgactggtgtttccgcctgcacggctggcctttatgctgcc

SEQ ID NO: 32003 - DNA, 7531 bp, Oryza sativa
  unsure (1)..(7531): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtttttctcgacgtacaagctgagatccgtgcctgcaaagagcgtggaattcaacgtacttctccaacccgtgatgtccattgtcctattcataagacaaagaatcacgacctctcaagctgcaaggttcttctcagcaccatgaggacgtcacctcctaaggttcaacagtcacaaatctctcttagagatgcggacaaggaacgaggagtgacggttatctcagatcgattcgttggggtaatcgacatcgatcctcacgagctgtctgttctacacttgttcgaagaccagacctcatcatcaacgagtacaccacgtgatgtattcgccatcgatgggaccaacacatctgcgcacgctaacgcagaacggaggatcaagtggttacaccggcccagcacatcagggccatcaacgcattgctgagggaaactccttatgaccccattctgaacgatgatctcgaacagtggacagaacggctacgggaatccgtagctaacctcagtaacgcattcgaggaggccgctgctagggcacaaccagaacaaccgccgaacggcggtgctgacggagaaccacctgaacagcggacgtcacctcgtcaagccactcctccgcttcggggcaccagcgatctcctcgaccatctaaacggtcgccgagaagcgcgacgcactcgagacaacgacgaccgttcttgacatcgcgtctcctcgcgacgccgcgggaacgaagaacaaggaggacatccaagcgagaaccgagaccgtgataatcgccacaaccgccacgaacacaccaatcgcgagcagcggatgccgggcgatactgatcgaggacgacatcgtgatgacgatgacggcggagatcgacgccgggacagcaacggtgggcgacgacaagattctcgagaacccggacgtcattctcgtaatcgcacaccggaaccgagcgactcttcatcgtcatcgtcatcatcctcatcatcttcgccatcggacagacatccacggagaacgtacgatcaccgacaacccactgcccccggcggtgggtgtagagctttcagccgtgctctgcgggacgtccgatggcctgagaggtttcgaccgggagcgatagagaaatacgacggaagcaccgacccggaagagttcctttaggtctaatccatagtagatcaaaaccggggtcaaaaccaccaaaggacctcgggtgactggttttgtatagttaagagatcctgcatcaaaaatgttttttatccgagtaaattgcacccacggtgcatcaacttggcatgtgggtgcaatttggtgcaagaacttgagaaatgagcattctagtacaacagcttgataggtaggtgcaatttagtataagtactttataacaacttgcaaggtaggtacggttttgatacagtaaactaaggagttatgcgacaacttaattatttggagcatttttttatatagattcatttttaagtaattattttgacaatatacaagggttgatttttataagcatatttatattgttatcctaataactcataactgaaagtcaattaaactagatgtaaaaattattatatttcggttgatatttaagaaggtgaagaaaacaaaaggaaatcttaaaggtaattggatgtaaactagatgtgaaatataattcttaaagattaaatttaatatttaaggtaatatccgtaggattactatgtaatggcatattgatatcgtgaaaaaactcacctagcatatgcttagccaacttgatgcatcaaaatattaaattattaagttcctgtactggaacgcacccacttatcaatttgttgcactcaaacgtggtacctacctaccaagttgttgtatcatgggtgcaatcaactctttttatcccggtgacaagttgagggaccttcggtgtactttttcctctctgtcagtgaagaggtcaaggccggcttcccaagttgggcagcccagtgggccgaagggcctggtgatttctaaggcttcatgaccggttcgtagccctaattcctatatatacatatatatatatatatatatatatatatatatatatatatatatatatatatatatatatatatatatatatatatatatattaaatatcttaaaggtgctggattagctgccttccgggtgattgagccagccgttatccaatacaatcgtgacacgttgttttgttacagttgatcaactgccaagccaggttagcgcttctatgggccagctgattttttggcccaatgcacggcagccttttagtgctcagcggcccatcgcggcatcggtgccgtgaccttgctccgtcctgggtttcctgtgcgctggatcatccgtcggtcgccgctatcctctcgacgcgtgccccttctccatcccctatctgaccatcagcgacggagcgacgatagtgctctgccatgggcgtacggcggcgacggggttggctacggctgctgctccactacgcggagagccctatgaggaccaggggaggtaatctgcatcgctccttctttcttccactcccttttttcttccatatatggagctggttctatttgctgctcctcctgcttagttcttgaggatttccagctcggtggtttccctcaccgcatcgtctcgtgtggtccgaccgttcctgctgtgctcgctctcgatttccccattgcagtgccgatgttgtgccagccatacttgtgctcactgtttttttcctgttttataccttccaggctgcgctctcggattggtgtctctcccacatcgcgtcttgctttggggggagggaggggggcatctttgcctccctcagctacttctcgctaaggtatttagtataagatcacctggttttatcatggggatgcctgttcagttcagtacgtatgtgtggtgcttggtatatgggtaaactgagatgattatgtcactggatgtttgttcacttcatttcgcatatatggttcccctctgtttttttcattggattcctgattagctacgatttggcatatatttatgttatttcgtttttcatctttcctgccgtgtctcgctgtcgatttccccattgcgatgccgatgttgttccatccatgcgtgtgctcagtgtattttttttctctgccttccaggttgcgggctccaattggcgtctctcccacacatcgcatcttcttttggggggagggaggggggcatctttgccttcgtcagctacttctcgctaaggtatttaatacaagatcacattgttttatcactgggatggctattgagttcattacatatgtgtggagctgtggtatatggataaactgagatgattatgtcagcgaatacctgtttgcttgatttcgcatatatggtgctcctctgttttttcccttggattgctaattagctgtgctttggcatatatttacattatttcatttttgtattgtcctgttatgttatatattctttcgtaggttggtttttttatcgcttatgtgggatacatgtttagttcatttcacatatgcgatgctgcgatatgtataaactgagatgcttttgtctccagtatagctgttcggtggatttcatatatatggtgctcctcttttttccctccttcaattaccaattgctttgttttacattgttccgctatgatatatattcgctcctctttttttccctccttcaattaccgattactttgttttacattgttccgctgtgatatatattcttggctgtttttcgatcgcttgtgttgttgccagttgatttcgttcggcgtccatctgtttcttcctttgctggaccttatacagttatatgtttgggttagcctttcaatgtggttatgtctttggtgttttaccattttcgtaaacgcattttcaaatatttgtatgttccagtctaagcatccgagagctcctggttcagctcttgatgatttcccactttgttgctgttagatatgtcatattatgtccagttattcagtgcttgcttatatgcatctatctttcttccatatttctatagtagctcgtgcctctgttctttatgctttccctctccattatatattcatccatatgtttttctgaatgtgtctatattttgctcctttcgtttcttggtgtatagaaatgacatggagccatccagattcgttcgcatctgcccgcggaagcgtccagatggtacttggtgatgtcattatagtttcgtatgcaagcctcggagttagcaaggccattagcgatccttttttttccctgattcacacttttgctcaccaatagatgggtcctccatatcatctgctgccaataagcacttagagcttacgagtggtgtgtcatgtgccataggtatgtacgctcaatagtctgagagttagcgaggtcattaggataattgttgtttttttgtttcctgattcgcaattctgccttccgatagatgagccgtcatcatcccgcggtgccactgggttctcaatgctcacgggtagttcatcatgcactataggtatgtacgcttgctgtagtcgctgctgtctcaatgtttagtgtcatctcttatcccttgcacatctttttctcatatttttgtacagttgtccacttgctgtgatacgatatgctcaaaatgtatgttcatattgataagttcatctatttgctcattggttctttctagcttagctttgttttctctccgatccctcattctatctcctcgcatcacttccacagggagtcgtggagctggccacattcagtcttctcgacccaacagttacctctggactactatttgttgtgttgcttagcttgctaaggccttttcccttcttccgattgatttttttcctgtttaaatttttcataggagatcatttttgcccaatagtgccagcacgtgttgctcgagtgaaccgggaaaaaagacaggccgctaggaaaatgcgtcttattttgcgacaaggttcttgacctgcttatgtacatgatcctttctggtcgcttatggcgatgttctttctttcttttgtttccctttatttcttatttgctaattctcttcttccgttcttcttctatttgcatagaacatgtgccacgttcactgtcgatgagattcacatattccataccaaaggagcacatgcaaattcttaaaggtaatatcttagtaccagccttgctttgcttcgcctttgtcccttttttttttgcctctctatctatttctggacaaacatatgcatgcttctctacttataggtttccttttcgctcttatagctacgtacccagatcgttcctattatggtggccttgactatgaatgcaatcattgtggtgcattattttggtaccaagaaagggttgttagccagagctcgcacagagccaagaggattgcatacaatctgtgttgtcgtggtggaaagatctccttacccccacccaagccttttcctcctatcttacaagacttgattcgttttgatggcggtgcccgttccaactctttcatgcgactcatcaggcaatataattcattatttgcattcacatcgcttggggctaacattgataggagcataaacactggtcaggggcattatgtttttcgtatcaatggtgttgtccatcacagaattggttctctggttactgctcctggacaacgtccggaattcgcccagctgtacatatatgacaccgccaatgagctccagaataggcttaatattttttatcacactgatgatcctggggatgtccctgatcctgttattgtgcaagagcttatctcgatgcttgaccagttcaatcctcttgtgcaacagttccgtcttgctcgagacaagctgctttctccaagtgctcctgagattgctatcaagctcattgggtcagaccattctcagagtgaccattacagccttcccaccatctctgagttggcaacactaattatacctggtgcatcttgtgaggtatcaaagtttgatgtcattgtgcagaagcattcaggtgagttatgtcagttgtcacctattcatccagcccttatgtcattgcagtacccgcttctattcccatatggtgatgtgggttttcatactggtatcaagcttagagaggtagatgatcagccacccggtagttgcgacgaagcatcgatgcttgaattttatcggtacgagtcccactatcgaaaggatgagcccaatccattcacctgttgtggtaggctttctgatcagctcgctgcgaatgctttctcatgtatagagacatctcgactcacataccatgccctcaaccagaaaaaacttcgctctgagacacatcaaggtatatctgatgctgttgttaggggagacagtgatggaaaggatgttggcaccaaggtaattctgccatcaagtttcataggaggaaggcgatacatggttcaaaactaccatgattcaatggcaatctgccgttcttacggtcctcctcaaatattctcaactttcacctgcaattctaaatggccagagattattgaagctattcgttttgaggcagggcaaaaaccaagtgatagaagtgatatggtcacacatgtttaccatatgaagctagatgagtacatcacatctattaagaatggagaagccttcggtcccataaaagctggtgtgttacttgtcttattcatgatagctgtcctatctttacgtacatctccttcctaacacatctattgcttcccctaacacattatttgttcttttcttgttgctttgcttttcaattgtgtacactgttgagttccaaaaaagaggattgccgcattcccacacattaacatggctcacagctcaatctgaagaaccttcacctgcattcattgacaacctgatctgtgctgagataccagatataacagctgataggtttgggtttggtcttgttgatgaattcatgatacatggcccatgtggtgagcacaatccaagcagcccttgcatgaaggatggtcggtgttcaaagggctatccaaaatagttctgtgatgttactaccatagatgatgatggaatcctatttatcggacgacgcaataatggtcgctatgtggtgaagaatggtgtttcactagataaccggtgggttgttccttataatccagctcttctgaagaaattcc

SEQ ID NO: 32004 - DNA, 4572 bp, Oryza sativa
gagaagaaagtttggacaaagcgtaaaagaggaaccaagatagggagattaaagcacatccatccaagtactgggaagccgttctaccttagaatgttgctcatgatagttcgaggatgtatgagttttgaagatattaggacatatgaaggtgtgttgtatggtacctatcgtgaagcctgtcaggcacgtggtctcattggtgatgacgctgaatgggatcacctctttgaggaggcagttatctgggctacttcataccagctcaggaaccttttcatgactgtactagcacactgtgatgtaggtgatgttagggttttgtttgataagtactggagatacatggtagatgattttgcttacaagttaaccaaagctcttggagtacaacgcacagctattccagaagttatgttgcaggataccttgctcaaagagttggatgccatgttctcaaataatggcttatcaatctcatcatacaatttgccaacaccagttgattgttcaggatccagtgcagcaaacaggcttatcttagaagagctttagctttaaccaacatagcctccatcaagaatctttgtccatgtatgccagcttgaacaatgaccagaagatgatatatgacaagatttttgacaggatagaccatcacgaaaagtgtattttttttatatctggacatggtggaacggggaagacattcttgtggaatgctattatggcaaacatgagatcaagaggtgaaattgttcttgcagttgcctcttctggggttgcagctctgctcatgcctggtggaaggactgctcattcacggtttcggatacctatagatatacatgaccggtcgatgtgtgctattcgtagagggacaatcctaggagatcttattaggaaagcatcactgattatatgggatgaggcgcctatgacacacaagctgtgctttgaggcattggatagaactctacgagatattcaatccgctgatgaaccagctaatgaatataagccttttggaggtaaacccattttacttggtggtgattttaggcaagtcttaccggtgattgagaaaggtacaagagctgatgtggtagatgcttcgctggttaggtctgcactatggaagcatgttgaagtcttacaccttaccactaacatgaggctacataatccatccctgtcgcagcaagccaagggtgaattggcagagtttgctaaataggttcttgacattggtgagggtcgtgctcccatgaacaaaagacaaggtgaggttgagaggacatggatagagatacctaaggagttgctgcttactccctgcggtgacaagattacagctataattgatgccgtgtacccggattttgaattgaactatgactacattccttacctttctcagcatgcaattgtctgtcctgtcaatacagttgttgatgagattaatgataagatgcttgctaaagtgcttggggatgcaaaggactatcttagcagcgacactatttcaaatacacttgaaaagcctgcagattttgatctattgtaccccatagaatttctaaactcaatatccataaacaatttcccgaaacatcgcatatccctcaaaattggttcagctgtagtcctgcttcgcaacattaaccaatcactcggcctttgcaatgggataagattgatggtcacccgactcggtgattatgttttcgagtccaaaatcatgactggcacaaatattggccagctggtctgtattccacggattgtcctaagtgggaacagtccaaagtggcctttcacgctccagcgaaggcagttcccaattaggttatgttatgcaatgacaataaacaaatgccaagggcaaactttggggaatgttggtgtatacctcagaaaccctgtcttcacacatggtcagctatatgtcactgttttgcgcgctacatcgaagcaaggcctcaagttgttgatagaggatgatgatggcaagccttgttccactacaggaacatcgtctacactgaaatattatcgttgctgtagattaatcttattgtcagtttgtcactgtgactgcagctaggatactttgctccttttgttcacctgtttcttctatgatcccatttctccgtgttactgtttgcttgtgtaacttaagcaagaactcatggtcatacagtgttctgtccacaatgactatccgtatttttggttttcgctatttgttactgctttctttttacccttcaatgagttgttgttcatacttgttttcttcctatttgaccagttgattgttgcagtgtcttccatatctgcttattaattgttctttcttatttttgcatattcttctcttggatgcaatcagttgcttttaaacatgcctgcttgaaacactgtcagttgggaaacagttcccacctcgaaaaaaaaaagatatatcctgcaccacagttccttcagcaattaggactttatatcttcatatcatgcaaggtattattattattattattatagtttccctctaacctatgtaatgccttctttatgtgttgtagatggattacactatgctaagggatgtgacacaggaatcacaccgttggcaggtccgagtgcgggtcactcgcttctcgcagttcactacagcaaatgaacctgacaagattctgcgacttgatttagtcctgcttgatgagcaggtatagcaataagcacatggtcatgccttattttacctccatgctatttgtctcttacacatccaaacatcaacagggggacatgatggatgcgcagatcccaggacgtcatgtttctcaattcaagcctttgctgaaggaggatgctgtgtattacatcaagtacttcgaagttgctgaggcgcgcccctagtacaggcctgttgatcggatggtcatggcaaaattcactgcccacacaaccgttaaagaagacactgaggcaccatccacagtcccatctcatgcttacaaggttctttcttttgatgatattctttcaggtgactctgtttggtccagatcaatctatctcattccttattagctttgtctattccctgcttactgccctcacttactcatgtgcaaattttatcccttatactactcctgtagatgctataggtataatgacacccattggaccagtgcaaactgtttcttgtggaggtgttatgaaagctgtgcttaatgtccacataaccaatggaaggtatgtatgcgttaatccactaattgttccagctgcttttgtattagatacaaaatgacttaattgtccgcacatgcattgtcagtttctttttacacatgtacaatccttcttttttgtttataatatcaacattgtttcacaactctcttatttgcaaatgtgaatactagcttaattcatgcacattattttccacctcttcattcttctatgtgcctacagcgaaactgctgtcattgcattgtggggtgcccatgatacacagttccacgctgaaaacttacagcagcaagcaaaccatggacctgaggtagtattgtttgttggattaactgttaaattccaaaaccgtaaaaaataaattcttaccctattatcacctctcctatttacatatttgcctgttcttgcttaaataatgtactctttcatgcttgccagaccagctagccctacaaggtagcactgtttgtaggtggtatcccaatgcaccaatccagaaaacaatttctctcataagcaggtatctctttcctgcactctttccattcacataaacatgctcttctttgttcaacttatatcttccttagtttatctgttatatggatcaaccatatttccctagcctacaaaccaaaacactaatctgtttcatatttgaagcctccatggtaacccacgggtggtaagggcaatagagccgaacttcggtcagaaagaagctgtgcatgtaaaagtttctgatatctgtgaccttaatccccacgaagccttggtaatatagtgtacctccccacacctaatgattacattgcataatttccatccatgtgttatcagtgccatcctttacttcctctgtttctcgcatgtgaaccagggcaacagctatattgtcaagatagccatcaaggatttagtccctgctgaagcctggtggtaaatagcatgcaacacctgtaagagaggagcaggtagagatgggaacacatataaatgctcgaggtgcatcactaatgcaattgaaacaaggtactcttaccacctacacacgttcagctcttctcaattgttttacataataaaccattcagtatgctacaatttgagctatagaacataagacctacttctgctaccttatataataggtacagagtggctatcataggtgtcgacccatcagatttagcgaaccatgacgccaaaacagctgagtttactttctttggagaaattggctaccagttgattggcatccctgttcttaacctggttgcatctgtccaaggagca

SEQ ID NO: 32005 - DNA, 13708 bp, Oryza sativa
cccttatgctagcctcactagatgcagcccacacaagtactctacccagccatgatgcttctatggcatcttctcagcatggctcatcaccagctgatgcaattgaaccgcacacgataattggctcttctctccaatctatgacaccttctacaccattggtgcttccagatccaaaggtataatctaatagcttcattctgcagcaatgtgtactctcttgcatataaacaattgtaaattcttatattaatattgcttatgcataggccacaactgatagccgtgatgatcatcatgggacaacaccgcctacttcagaggctagcactatattctgtacttagagcaaatatgtatgtctgtcccttatcaaacctaactgaccactaatgctttatcagctcctggctatggcacaactagacaaaaaacgtaaatcttctgcaattgatgaggatcttgctcaggaagggtaagtgacaatgcacagtttcatatttacgttccttgtttttttttctttgagttttctcatggctcaaacaaattgcatctgtagttcatctcctcgtgaacatgattgtcagaaagcatcagttgtgcgtgcgctgttcgtagacaaactgcccccacagcccccaaaatgtaagtaaacgttgttagccaactatatattacctgtgtgctcatttgttacagaaaaactgactctacattacattttgccctttaggacttgagggctccatataatatcaccccaccaaagcggtcttttgcacctggcatgccaaggcgtatactcctgtccctgatcaagcaagactaatgctcacatattttgcccaatgtattttgcagtgggaatataaataggggatgtgttcttttgtgcaagccattagaccaaatgacattacttctacgtcttacaggcttgcgagccctagtggctagcagaacgataaatgaattcgtataaatagtatgtggtgtctgtacgatatgcacgttctaatcaaatatcgccagaacttatactcttataattggtgctatatctattcgctgcacactgtttcccaaagtcttcttatgtttgtgccggaaaaacacaatttcctactgtttcttatatatgcagcggctatagtcaaccatgtgttaccaaatacttacgatccgtgcatcgattagcttattcttgaaaaagcatacttgcatattcctgaaaccataggcacactctatttttctcccttttatgtccaaagcatgtggtcaggcactattctatttttcagcaattcttttcatcaaaacaagcacccatgccatttgagagcagcagaccatttacatgcacatattaattgatcacgctgttatagtattcaagaatttccagataccgacaaacatagctaaccaccatacatagaaattatagggctttactacttacactaccattccatcacagattacatatgtctgactatatactatagacaaatacataaccaccatatatcatgcctacatgctgttccatgcatacacacccagctatacacaactgctgctatataacagacgcttattacaatcaactgcaggatccctactgataaaatactggacataatatcagtcacaacatctgttgttttcgctcagcttagttcccaaaaacaatccatgcaggtctccttaggcttagatatatctagcagcaacactggtaagattagccaacccttcgtccacaaaagattcagcatattcaccaagacggtgcacatcgtagaatactccaacctcacgatgactaagatcatcagcatcaggacctcctagaacaaaagaacatatgtcatcacatatttggttgacagaaccccaatgaatctaaagctctatcccagccgatttccagcaaccgtgccttctttgcaagagtattgcatttcttcctagctctcccaagagctctcttcagtcgctctgtctcaacatgatagcgattcatgtcaaaccagtttgtatcatcgaactccacactacattctttcttgataacagaaattaaagcatgtgcagcgctttcttccgcatcacatggtcttatagctgaaataccctgtgcacgaacaacaaaaggctctccaactcctcttgcaccataaacagttgcctcagcaaacccaacatagccatctgctacagcacggcaactgtatcgtgcctcatttgcgcctatgcctctcaaaacctcagatagcaacgttttggacctgatctgcacgagccgacgctgctctgttaaaccataacaaaaacaacatcactaaccataccgacatcataaaaccatcccctttcttcccctattcctaaaacttcctataatcatccatttatatataaatcatccaaatcaccatatgctgctataaagatccagatcaacacgggtcaactgaaaaataatcacacatctaaaaaaacaagcccctcgtacacagctccttcagaccaaacaagatgcaagagaccgaacaaaactaacaccacaaatttataagagtatatctaggtccccaagattaatcggagcatatacaaatacattaatacacataccttgtgcaggttcctccgtaccaactggatagtccctcttatagcaacaagatctaacaaagcagtagcagcgccgccgcaaccactcagtataaagaagcagccagttataccacatatataccagcctcagcaaagcagatgcaatcccaccatgacacgttgccctgggacaaccgagcttaactcaaaaaggccgtgcatcataaatcccaaaaccagcccactaattatgggactgtacatctttaaaagcccaaggtcaaacataaaaggaaaaggccataactcctttatggcatagcacgatcaacccataataacagcttgacatacctccactaccaaaaatacgctttccatatactgcaccggtacgtatcagataaaacccatctcttagcagccgcgcagcgcgctacgcgtaaccgctctagtatatataatcctagtcggagacggagtacgcttcctccccttttcctctccccgcagtaggggtggaaacgagccaagccgagccaagctcggctcggctcgtgaaagcttgctcaactacaggctcggcttggctcggcttgattaattgaacgagcaaaagatgcagctcggctcggctcgtttcaaagctcgagccagctcgagccagcttgtgatgtcatgatggacggcgtcgagtcagggacgccggcgacgcagggggcgtcgagctcggctcgagcggcactggggacggtggacggaggccggaggtggtgcagggaagggaggcggcgccgcggcgggccgacggcacagggggcgtcgccgtggagggaggacggagccgacgcagccacactaggggaggtaggcggcgcagggagtgaggcggcgagcccacggcgcagccgcgcaggaaagggaggtggcgggccgacggcggcggcacagagagggcttcgaacggcgctgccggcctgccgctggcggtctggcgctggggaggggatggatgcggcggccggcaactcctcttgccagtcgccgccagcgccagttgaggaacggaggaaccgaggaaggggagggatcggatctgctcgcactcggctcagctcaggagtcaggacttagggtttctctctttcatgggccagacaattgttaatgggcttgggctcgctcagggaactcagttttccataggcttgacaagcctaccgagcagcttgcgagctagctcgggctcggctcggtttggaaacgagctgtggagggagctcgggcttggctcgtttagtcttcgagccgagccgagcttcgcgagctcaagccaagcccgagccgagctcgcgagcccgagctttttgtccacccctaccccgcagccgccatcgcatctgaagtataattgacgccataggtagcaaagctccaccctctctttgatcgatcgatatcgataggcagcagaaggggagaaaaggaaaccgatctcggtcatggccacgcccaccactttggtcgccgcctccagccatcgccgtcgtcgccggcgtggatccacaccggcacaggcacaggcacaggcaccggcaccggagggggtgccggggtggatccttctgaacagcggtgcccacatcggcagccgctccaacgccaccaccgccgtcggtgaggcgagggacaagctgacgatagaggtgtccttgtggccggcgcagccgccgcacccctccgacgtgttcgtgtgttgcccgggcgtccgccacccccgcgaatccgagatcctcttcacggcccaagatctgctgctgctgcgtgtcccggtcgccgccggggctgcgccgagcctcatcagcttcacggagtgcgattacctcatctaccgtgccgccgccggcgaccgtcgtccgtcgctcacgctgctcccgaatccaaagcccaactacttccacgacggggatgtcggcatccttccccgaggcgggggcgagtacacggtcgcggccctggttgctagacgacgccgggggcaggtggaccaccaagacggtgtggatggacgacccgcggaggcctccccctgtggagatccccatcaacgcaaggcggctcaaccaccacatcaccaccaccaccatcacgctcggcggcgagctggccggtgccatgggctgggtcgatctctggaccggcatcctaatctacgatctcctccatgacgacaaggaccaagaccggccaacgctccggcacatgccgctgccgctgccgatgcacgccatcaccggcaaccacgggatgggcgacaagctagccttaggctgcccacgctctctccgtggcattgcctctgtcacgaggcgcggcaaggcctgcctcaagctcgccggcgtgcatgtcaccggagagcgcctcccctacaacgacgctgaaacccagctgccggcgttcgccgtcgacgactggactgtcacgacatggagcaatgacaagatgaagggctactttgaggactggcaggaggatttcacgattcgcggttccgaggtcaggattagcaacgccatgcgctcggatctgctgagatctgggttgctgtaccgtaaaccgtcacgaggggatggcgatgaggctacggtggaggagctggctttgcacaatctctgggtgtctcatcccacccccagcctagatggtgaagaagatgtcatctacctgctggccaagccaaagtgcttccaccccaaggcgtgggttcttgctctcgacacgaggagcagcacgctgctaggcgtggttgagtttggcactgaaaccgcaccatctgcaggtgtcacgtatcgccccagtactatatccaagtacatgagtctggtgacttctccaggtaattgccatcatgttatagcagcacatgcctcgttccctcctcgcaacaagtgacatttctctacgggcaaaactgactagcgagatatcttagagaaaaccagtctttcagtgacctgtctgtggacaaagactttccttttgtcttagtagctactagctggttgagtacatttcgagattaggtgatgatcaaccaattgaaaaaaattacattggtatcatgcactctggttacatgctcttagttcagttatcttctgttctttggttcttaacctgccatatgtagactcatatgcatgtatttttctatgtaaggaaataaattggcattgcttacaaacattctagtcaatgtgtgggtaaatgaggaagatatatcatatgcacatccaaccacacatccatgcatgagaccgagatatgctccctatgtacctaaatcatatactagattcgttctgcttgaaccagtttagttgccttgctatatttataatagaaaaaattactcatttgatgcagtgatgctagaatcagtttagttgccttgttgtatattaatagaaaaattactcatttgatgcagtgactgggagaacttaaaggatgctgctgctaatcactgaatcaagatggtactgctggcctgtttggaggcgatgcatcgaagattaagactgaatgatgttgttacacatatactccctccgtttcataatacaagactttctagcattgctcatatttatatatatgttaataaatctagacacatatttgtatagatttactaacatctatatgaatatggacaatactaaaaagacttgcattataaaacggaggaagtatatgtttacaggggtcttggcaattttgcattcgggtgcaagaaacgtgtttgtttccctgcgctggtggttaggagtatttatgtaaatttctctagttggaacaaacagccagtagcttgtcgatctgttactaacttacgatgaagcatcatcattatcatctcataaaaacttgtaatgggattttatattcgtgactatcacgcactttgatttcggtgagaagagaaatccagaaaattgccatcaactcatctctgctattgttcttgctctgctcggttgatcttgccggttttactacagcgtgcgtagacacaggggtactaaggctgtgtttagatccagggatgaaaagttttggcgtgttatattagatatatggacactaatactaatttgaagtattacacgtatactaaggaaggccgtgtttagttattttggcaaaaaaaatttaacgtatatagacatacatttgaaatattaaatgtagactaataacaaaacaaattacagattccgcctataaattgcgagacgaatctattaaacctaattactccatgtagcaccacattgacaaatcatggcgtaattaggctcaaaagattcgtctcggaatttattacatgcaaactgcgtaattgattttttttgtccatatttaatgctccatgcatgtgtttaaacatttgatgtgactgaaaagttaaaagttcgaagggaacaaacgtagccatactcgtcttcgaacacttttccaagtcctgaaatgcgatcattgatttgatgcagttgctgaatctgctgaggtgggatttccatttcaaatctatcatgtatttatgggcgtgcatctacgcttcagccacattttaatcctgtctatcaagctccgtttcttcctttaactaaaaagaaagaacttttttttaacccaaacaacattcttgaaggcctgtgggttaggcgtgagcgtgaaacctgtcaaggcttcgcaactgtcatattggtgatgccgtaggaatgtaaggccttacagctttggggagataatgtttataatcctccaaggaggcatatatatttctcttatgcagttttgatcaatgcacttactttggaacctcaaccatatgctaagcatggaatctaataagaatataggaataattcctcatgttgccaccggataagatataatgagcagtgtttcatatgataagatataatgatctccaaatcaaccgagcagcaacaaaatctactaacagagcagtgtatcctatgataggattatcagtagctatacatgcatttgaacaagcaagcgctgagacatagtggagcgcaagctaggaacaaaagtcagaagtcagaacccatcggtcaccgaagaagtactggtctgcatgccctctgcaatcaataattgttcattacttttgttcctaaaaaaaacatagtgggataatggaatttaacatcccagcctttacaagctacagccaattattacattatatcaatccagaaaagaacgtagttcagctaaataggacaccaaacaaaaaacagaggaaactaagccaaaataaggagaacacatttattttaatctatttgtaaacctccatccataattggcaaataattgcataaccatcgacttcaacttgcggcatgcaacccttagaaactccccatcatcctcaccccttggtagctgtgcccaaaaccggagccagtgcgttgccctgaaaattacctgcatatatgaaatagatgatgatttattaaaaaccaaatcatttctactcagtgaagatcaacaaacggatgaagaaaccatcgtgccatttcagttttagtccccccttcctcaggttagtaccagcggctaatgctgacacctcgatcttgtagagtagtagtttacatctgccattctatccagtgacgatgcacgcgagcctaaaatgctcaagcataagaagattgccggccaaaaaataaaaacaaaaatctgatacaaaacctcaggctctgcttaggcggtcagctgcattgacacaaaacgtttccatcagataacatgaaaaaacgaaacctaaatgaaacggcagtaaatgaagatttggttagcatgcacgaaacttgagataaacattacaagtagcaacctctatccccccaccctctcaaagcgaagcaattattgtaatattaaaaaatatttagatgtgtaaaagcatgttcattcgggtaaacaggtactccctccgtccaaaaaaaaactcaatcctgggtttggacctggacgcatgtgtgtccaggttcaaaacccaggattgggttttttttgggacggagagagtatgtcgcaagtggatggacaggtagccaatatcatcctccagtatcccaataaacttcagttatggttcctccattgctgaaaatagataaagagaatatctactactccctccgtttcacaatgtaagactttttagcattgcccacatatatatagatgttaatgaatctaaacacatacatatgtctagattcattaacatctaaatgaatgtgggcaatgctagaaagtcttacattgtaaaacggaggaagtagctaccatgtgcgatgcttgttcataacagaattaaatagaaataagatggttaactttagctatggttcttcacatcatacagattaagacgctggatttaatttgtaatgtcgaatggtcaattagattaatatgaaaatatatagggaaatgtcactactttgtattatgacacccatgtgagcatgaattttgttttagaaaactgtcaattaaaaatgaaaccaccacttcattacacattcagtaaaacttactcagaatcctcaaacattgtccaggttgtagaaaacctaaaaacaagagagaatagctgttaaaagtacaaaacgacatgctttttgaaaaaaaaaagtggcaaataaatcttacgggccatcgatatcacaatttctcactataaacaaaatcaattgtggcacaaattttgaaaggtattccccaatcatcaaagcagtagtaactatgtccaggacagtcccttggtccttcagagaacaaaaaaaaagttagcagactatttgatgagggtattgaaaatttccagaatgaacaaagtgttttcaggaagagacaaggttaaagcgaggctggatcattaggtcagtaaagtaataggacgattacaaagacaaagaaatttggtcaagaaaaaagctcaagaaaaggtgaattgaaaagcataatatagggataaatggtcatccctaactctgcgactctttaagagaactacaactctccttcaaagtcaccactagacccctcatctccagcacacaagccacattcttctctagactatgaatgcagggatgatagttcatttgtgtcaccctggcacatcatctgctatccagcctatcgctgactcccagattttgcatcctactgagccagatgcttttcatcaaggagcaattaaaattgggctgctgcacatttatttataaggaggtatagttgcgtcttcgattaacaccccccctccccaccggaaaacaagcataggtggaaaggttggtgacttggatgaagtaaaaaaagaaagagagaaaacagaaacatgtatttacctttgtgtacctatgggcatgctcaataaagtttctcagatatttcagcagaaaccagtagcctaactcataaacatccacaaagaaatgccaatagacatttgaaaatggtatgccaaagtgtctcacacctctccattctatcagaagagtttccgagacttgtaatggctcatacacagtgtcttgcggtttgcgcagtgaatcacaatctctgtacagatggcatatcaaagtagaaagagctgctggagacatgaaagctggatgacagcccaaaaacctttgaaacttctccagcttctcacgctcatgaacttcagggacttccatacaattatgctgaaattgtagaaagtaacaggggagaactttcttcttttcaccagaagctgaatcgatctcttcatgctcgtaatatgggaaaataatctcaaagaagtttctgaagtcagcttgcatcccttccttggaggttgtatcatttggcacttctgtgataacaaaatctttgatatcattcctcactttcatatgctctgccttccatttcccattccagcacaggcccttcttatgcagcattagcaatcaaatgagaatttcctttgcatttcctactgagttcaaggtccaatacaattctaacaagcctggacaggtattcctcagaaacaaaaccgttgatatctggcttgatcttcgtggtccgagtgaggatgatatagttaacaatcgccaagagagaggaggagccattcttatcatggcatataatttgttttatgtgcccaccataactgatctcctctaccttgtagacagacatacctgaaagatggactggtatacatggcaacaaaatttacattatgtaatgtaaatgcaacaatcttgacaaggcatatgacatagcaatccaacgaaattgaaatctaacagctaaatttggaacatctggaaaaggaaatcctcaatagtagaaaagaaggcgaaagggacgaatacacaggagtgcgcacacgaaacctgttcgccttctcccaacgggcaccaaccagcacaggcagggtgtacggcggcgcgcgcacccacttccccgcctgtctctcccagcagctcaccgccgatctctccgacggcagcgcgcgcgcaccccacttccgccctgcctttcctgcggcgcagcagctcgcgtccccgctccctccgacggcggcgggctcggccgctgcacggaggagaaagtgcggcgggtggggtttagcggtggcttagatctttcgcggccggggggggggggggggggggtggacaagcttaccgcgacttgagtttggtggcgacgccgaccagatcagccggcaggaacgggtccgacaagcaacattagcggccgcggtggcggcgatggcggcggtggcgtggcggcgatggcggcgacggcggagcgcgtgacgagggttttgcggaggaggagggttttggtggagtcttcgacagcaagcgaaagtttatggccggtctgatccgatccgatccgctccccgtatccaccgccccaacatgctacctccccaaccctccttgatctctccgagtaatttgttttttcgattttgctatatcttacctgaaagattttttcttatctctcactcgatgttctcacttaaatttacagtgcattttcttgtaagttacagtgtaatttatgaaatttacgctgtaacttttgtaggttacactgtaatttgtgaatcttcgcatgtaaattttaaaatttgtattggatttgatctttttcttgaggatatggtaatttagtgtccattatggtgtttcttaattgctttttgctttttattatatctatcggattttaattaaagattaaaaatttgtgtgatatgataataaaaatctttcgaaagatgtataggtactcccttgttttttttattctctctcttataacattgtaggactacaaacgacacacttataacacatgcataaattatctctgcgaacacatatagtccctccgtccaaaaagaacatattcctagcatcccaaggttgttttagttgagatagagaaatactaaaatgcccttggacattgaaaaaaaatagtaggtgtgataggtaggtaaagggtattgaaggaataaaacctttcgttttacgtgctgagtgtagataggatggtagaagttggtttttatgggacaaaattcaaactctagaagttgagttttttgggacagatatattggatcagggcctgtttagtttatgaaaagaaaatttttgggtgtcacattggatgtttgaccggatatcggaagggttttcggacacgaataaaaaaataattttataactcgcctggaaaccgcgagacaaatcttttgagtctaattagtccgtcattagcacatgtgggttactatagcacttatgactaatcatgcactaattagactccaaagattcatctcgcgattccctcctaactgtacaattagttttttcatttatctacatttaatactttatacatgtgtccaaagatttgatgtgatgttttctggaaaaaaaatttggggaactaaacggggcctcagtatatcttaatataattattattcgtgtatagctattgatgggtatattgtcaaaaataattagccatataaatacaaacactcatattaagtagtactctaactcggtgggttggttctactataagtatctaaacagttaagttaagctcaccttattctctcttttcacactacccaaattattatgcatcaaattttaccactctctcttcaatcttttttttaaaaaaaactatacacacaatttaacccggttttaaattttttatgtcgtccaaacaagaaataaatagaaaaactgcgaaggggaggggatcctgagctgcattgaagatgaacagcggtacagattacacgactaaaaatgtataaaaattacatactccatccgtttcaggttataagatattttgactttggtcaaagttaaactactttaagtttgactaattttatagaaaaaaatatattataaaaatatattcaattatagattttatgaaattatgctagtattgtaaatattactacttaaaaatatcacgaaaaattttataaacaattagacatttacttctaatagtattacacatatatgcaaaatctcgtattcaaattcactatattttagctgtaacaaaaagatgaaaaatttgacaattttaagagtaaaaatctgttaatattttgtctttttgttactgctcgcgtgagtttgctgcttcgtgagttctacgcatccttgggcaaagctggcatgcatcttattagatatctaatacagttcgtttcaaaaaaaaaaaaattctactacagtatgtagttgaaaggctactacattgggccattcctcatattaactgttgcctcaatgattctcatttatactccctccattttttaatagatgacgccgttgactttttctcacatatttgaccattcgtcttattcaaaaaatttacg

SEQ ID NO: 32006 - DNA, 27118 bp, Oryza sativa
  unsure (1)..(27118): unsure at all n locations
ggcgtcatctattaaaaaacggaggtagtacatgatgttgattgctctttatttgattaagtaatgacaccctcttattgtttaaaaaaccatcaagtaaacacttactctacgaaagttggtctctttcccattacaatgctatctaacagcaataattctgacaattttcagcccaaaatccacatccatatggctcccatgcccacattgtacagtgttttacatatggttttggtgtcatcccacctttccatgccctgcttatcagatcgacgtccccagcgtggtcggtggattccatcaccatcgttggagagatcatctgggctctcaatttctacctacaatatggggagtggattctacccctcgtatacctttttcttctaaattcgatgcaaatagttgtgaaatttttttaaaaaaaattaacaatgtagagtataatgacatctactactccaccaaaattcaagttcaaattcgatctacacatcgagaaacaaaaaagacaaatttagatataaacaatacgctactattcatacgctaaatttgtttatatctcgacgcgtgagttgagtttggacttaagattttgtggagttgtatatatgtgttgtatgaatgttgtcaaattttttcagaatttttcataaccgtttaaatattttttaagcaaacaagggagcatcccctcaagggattagaatagtttccccctacaatgccacccttattgtggtggtgatatatttttgcttgacctgaagtaaggtatgcatctttcttactttattttctgttaatccctttttgtgtacgcaaagtttttttttatggtattcaccttgatataagttgcaatatattcatatagtatttagttaacatcatgaatatttttttctcaataatatatatgcatccatccggcccgtctataattttgtgcactcattttaggcatttttctttgtgaatatatgattatgagtcccaacttcaaagtatatatataatatatatcatctacttgatttttttttaccaaagttacacagcaaaattgtttaactactgcgcttttgctttttaaattaagttatataattaacttatttcattcaggcttcattctgcgctttctggaattgtttcatccttcgtcatcccacggtcatccgtactggcgcagcatgcctccagccccgccttggccgaacctagcaccaccgccatgtcctctcggtgtgtttcttccttcaatcgcaaaaagcaattccctactcctccctcattattttccgtgattttacctttcagttcagctttaattcgccggatttaattgattccaatgatgtctagccatcgagcttatcctgactattttcatcctgaattttatgaattcgctctgatgttggagaaaatagaaagaggagattgagtggatcaaaagctctcaatcaattttaggacatcgataaagattcgataggatttggtgggcaaggttggctccagcatcatatgggcatgggacggaattgtcttccgacactagctagtctgctatactagctgcgtcttcacttatgagttgggtcgaagagaggtaggccaagggttttcaattataatgtatatatagcgatcctaatgttttaatttattgctcagcgtctaatagctagtgtaccataaaagaattacacattgtgacccacggatattttttctagtataattctaatactctaggatgatacatactagtataacaaccaatttcccactatccgttctattcctggctatggaagccactttggaaccgcagtgctctatattagtatatagtagtaatgggtttatgaaaacacaacttgctggttttttgtgattttccacaaaattaaattttataatttgacatatacaaaagaaaaagcaaatcaccatatcatgtgtataactttgacctctatagtaaatatgctatggctgctttttagctctaatataactttgaccatagcatacatgttatctctaatatatttttagtacaactttataagttaaatttggaattatgtacatacatatttgttgagtgatatatcacaaattagtttatttttttaaaagaaaatattttttgactatttaaataacatactatctccgtttcaggttataaaactttctagcattgcccacattcatatagatgctaatgaatctagacacatatttgtctagatttattaacatatatataaatatgggcaatgctagaaagtcttataatatgaaacggagaaagttatgtatatacaaactagtttatttcacaaattagtttatatttgttgagtggatatgtttaggccggattcccttgcacggaacacacctacgtaacttctcacaagaatggaggtttgcctccatgcatgcatataataaggtgtattaattaagtaaataggatatccacctcataacgggtatccgtcaaatgtgtggatccatacccaataagatgggtccatatatgtccatatatatcactctcagcagcatatcatcggacacattttctctgtaagagtacgcaccagtaaggtcatatggaccgcatacatgctgaacggaagaaggtccggatttgcagttgcattccggatttgtacatccaacttttgagcatcgaaagatatactgctatatccgttttatgttataactacatctattttatatcacaagttgtttgactttttaagtttgatcaagtttgtacaaaattataataatgtttttaatacgaaacacacatattataaaaatatatttaatgttatatttaataaaactaatttgatgtagatgttcttaattttttctataaatataaagttggtcaaacggtcaaacctacaaacctttgacaagaaaaaatataaccgatttgtaatatgaaatatagggtgtaattgacagccacagaacaactaaacgaacatttatacatgacagtatgtgattgatatttatctacactaaaagagagagtcggcttcctttttatgagaaatcgctttattggatatacacatggtcctagcatcttcaatctccggagacaacactaattttaaatggaccaagcatcttcgtgccaactttaatatgggcggtctttaacttattgaaaaacttatgttgtcacctttcaaatgcatctggcctcatattaaaattcatcctaagtcaactaaaatcgtaaaaacaaaataacattgtagctgaaacaaactttagccttaggccttgtaatagactaggcaaatctcagacgtgcctctctccacctccacaaactagaacctagccctagctttattttcatctagactaaatttcacaaaactacatatttaagattaagtatcataaaactacatatttaatattgaagttatcaaaaaaattatatatcttagagtttaaatccctagcaccattgttatggtgaagctataaacattatagttttgtggctaaattgattctaaacctagttttattatgataactttgttgctaaatatgtagttttgtgacaccccatcctaaatgtgtagttttgtgataaatttagtattaaatatgtagttttgtgatacaccaagttaaatatgtaatttatgatagtttggtcatagtatctgcagttttgtgaaatttactctttcacatataaatatctatgcacaccctctaaaataattgaattttgtttagttgaattttgccaagtaccagtcacgttgtctctagtcctcggtcaattagtcggcaactatagttttagagtcctcaatagttggtgtgttaatttaccgggttgatttaatctaccatttcaatcgcaactattcctttgtgtcagtgacaaggataagacatacctcctatacaacaatcccatatacccgatagtatacgacaagatatcatttaaatgaggaaatacaggggataaagaaggaaattgtcttctcgaaatagaagatgtcagaatccaagtcaaggaagataatttctccttaggcccatgtttagtaagaaagtaaatgcattggatgaactagtgacgacccctccgaccactagtagatggtgcgtatcggtccaccggtgtcctcttttgctgcgggcgtccctgggcagcttgcgatgactccggtgcacccataggctgagatgcaccgatctcttcctgtttttgctcctcctctttgtcatcctctccctccttcctcttgctcttcctgttcttcctcccctctgatccccttcctcttcatttctttgatgacttgtttcttcagcttgtgtgtgcgtgactcttggttgtgggtcgactgttgtcagggttacggataccacatacccaatagtaattgactaaactcggcggggcccaccatataccaagtcttatatggaatcatgccccatatataggagttccggataaggaaggacaagtagagttttatatggaaacgacaaggactactcggattgtatccatattggtctccgtagttctacttggataaggagacatctatggatataaatacaagaccccgtagggggagagaggatacaacaacaaatagacacacaacacacgcggccagacatcgacatcagagataagcctagacagaccccatctggtgcctacggaggtcgacaagagggatctagaacatctctgatctcgacgagttcatatttgaggaggaagactaccctgccgtcgactacgtgttggttatctatgccgtcaagtcgacggcagctagataggttatcacaaatattgtacttgtgtgatccagataaatatatagagcaacaccagcttcggccaacaggagtagggttgttaacttcctgtgaagtggcccgaacctgtatataatccttgtctctgtctcttttacctcaatctcgcatataccctggtaggctagtaccgacgatccccatatcatgcaaataccttagtcgagatctcaaacatcgacagtggtgcgccaggtaggggaattttggtgcttcaaggtttcaacgagatgggttcaagaggtggattctccgacaacctctgtaagtgtttgtatatgcaatatttgtccattaatcctattttcttatatcaccctgtcttgaagtcgatcctatcgttcctttacgctactctcaatgcgtattaaccaagctgcataaatcgggaattggttttcccaacttcatggctagggcctaggatttcgtcagcttctattgacacgaaaaacacgcactggcctgagagatctgcttaactatagtgcaggtccaaagaaattgccttcaggttctgagcatgccagctggtttgatcctgcaaccaacaagatagaaaaaagacaaagagttaaatccatcaacggtagccaatcggtaggattgccgatgacgtatcatccgaggccatgccgatgtaacttgcgtcagatcggcagaggcagattaaacttggagattgttgggtgtacttgatcgactgtagatgttaacgatacgtaatccaatccaatgggacacgcttagatcgagtgattgggatagatcagtcgctgcaccgagacagtataaatcactccatatctaaatgtgccccaaagtagggattatgcatgctcgcagcatagccgatggggcgaacctaacttgtatcggctaatactctaacaccaccttataccaagatattagcacagatgaaatatacaaaactgaaaccaatctagcaagcaggatgaactagcagactgataggaagcttaatatactttaaatggatgagatcttgatataaggggcagatttagatgatccagaaccaaataagaaaacaagacgactaaatcaagtgagatcggctgaaactccgatgctatctctattagcaatcaaagagagggctagataaagcgtttcaagacagtacttaacagatcgaacctaaccgatccagcattaagcatgaaaagaaacataagatctaatcaaatcgatgaaaactcattcaagatggtagatacaccgcatagtctagcttgatatcgaaatctaaacctgccagctgttttcgatgatagagactagccgataaagcttagataacaaggccaatctagattatgcggtatatatgataactcggtggtttacattgacaggattagagtgccatgaagatgtaagcactaatcccgagaacgcaaaccgccattgaaagttcaagcgccattaatttggttttggtgattaatgacaaattcaatcacatgagactaatattgttataagcatttctttgtctactagtctcatatggatatgaaagtggaatatgtgagatgtgattttcggacttcatatgagttgagagagaaacattcattgatggtttacctaaatcacaaggatgaaatgcatggagatcaagctatatgtatcactctttctctccgtgcacatattgatatattcatatataatattttcatgtgattacataaacatgtgagactaatattttgtttgagccatgtcttgtttagtctctttacattgagaacatgtagatgatgaaggtatgcttttattttaatgtctatatttgagaaataccttctattcttatataggataagctctcaatgttttatatcttgttatgcatactcttacttcacacaaatattttgtatgcatacatttagggggagcaaatcctatactttagttatgcacgtaatcgatccaagttattcactttcatttaattgggatctttacatttgagcatacattcaagtatatgacacttgtggtgttgattagtactcaacatttattcatatccttttatatacgcgatcggttggtcaacatgtggaggttgacatccggatcattgggactaataattttattgagttgaatgagagaaataggtcccaaggattgcaaaggtgttgatgttcaagtgatatcattacacctaacgataccaagaatgacaaagtgaaaaatgttgaagatgtgggatacgaagtggctactatggcaaaacggtgaagggcaagcgatgctcggtcacgatggaccatgcggcggtaaagggcaagcaaggggcttggcaccgaataaccaaatccggtggtgaagggccagtgacggctttgtcatgatggatcgtacgagaccatttgaagctacaagtaaccacatcaatcatttgaagaatatatggtgaaacggtgtagacattggcgtcccttaagacaatgaaagaaagatggaaagaaggcattcctattggtataattctcttcctatttacatttgagtttaggaatgccgtactattaagagagatgcaacgtcgaggtgtttgtgtatgtctcggtgctcaaagtgacctatcatagtgctaccttgagagaaacccaagctttaacctatcctttgagtggttgtagaccttggttttggttgagttgggtagtcctctcagtgagctttccatagagtccaagttcatcaaaaacggactcccgagcgaaaagttatatctgtttttctctgtgtttttcggaaattccgaaaaaggatgcgaaactgagatttgcttcagtagattttcggacttgtccgaaaatgcttttcggaaaatccgaaatttacagttttggccttcaacgactagtttttatgaggctcgggtatataaactcctcgacccctcctttgagtggctgttgttcctgggcaacattagacacatccaaagccaaatagccatccctatttccctacctttgtggtgccttttgtgaaggggatttgagaagagaagagagttggattgagagagtgaggagttgagagctagcgagcttcactccatcctttgtggtgcctctttgtgagagggatttgagaaggggaaagagttggattgagagattgggaagttgagagctagtgagcttcactccatactttgagcactctagttcatagcaagcaaatcttcgattgtgtttgttactcttggggactaaggtctcctagatggtcaggcgtcgccggtgagcacccaaggttgtggtgtgccacggaaagtttgtgaaggctttgatttcgcctccacaagggaagaaatcaagagtgaaaccgaggagtgcatttgtgcaacctcgtgaggaaagggttgaaatagacccggccttgtggcccctcaacggagacgtaggatccgtggatccgaacttcgggaaacaaatcaacgtgtctcctctcttggtttgctcattcttgccttctctcatattgtgcttgagcttgtttttacccgatctacttgcatgcttaattgatttagttggtgaccttatatcttgcttagataccttatttgtcaccttttgattcatatacattttgtttattcaagctacaagttcatagctagtgttttatcccgttatctgccgaacctttcggttgagatcggaacttccaatcctataccggaagttccgatttgaatcaaaagttctcatcactctaatatgctatgaagttgtgataattttaggaacgcctattcacccgccctctaggcgacatcaaggtcctttcagccataacaagctttacctcttcgtcgaagatcgtacccgatgcagctcaactcgaaagcaaaaaaactcatcgaaacaatgaaaatagaaaagggtggcaatgcaccgaagtattattgaactatcgtcctttgattacatggtgtcgggtcatatttatacccgaagtacataacatgtacttgctggacacgactcttatctctaagacaatttaaaatgagtccttcagggggactcttaccaaacatatctctaaggaaactggaaaatgtcctagttaatagatacaattgtcctttttaggactccagtccttgtgtggcaatggctatgaagtgctgcgaccaatcccgacgacgaacgtgtgaccatctttcccgagacaggttgcatcggcttgactctgtcggatccggcgcttagccgatatgtggcaggcgatgctgcttgtaaccgatgcgtattctttctcgaacggaatttctccaactcagtcttgactctagctttgaatccatgatgtggtattaccaaatttgttcgttaacaacttcagcttggtttgttataagatttaagctgtctttgtggaaaaacgatttttccataaagatagctgggggctaggaagagtaccagactccaattgctaagggcagctttagcgagagtactcttttcttgtcatgtgcatattcaatttattttcatattatatcgtgttaccctagggcgttctgtcacgtcctgataaattcaccccgaaataaaaatcattctctaaaaggaataatagaattaattaaaattcgaaaagaaattggcaaacactaaaatacacgtacaagaaaaatccgaatgtggcccagagaatttttgttaaattctccttggcctaaaagaagccctcaaattttacttgaattttcagaacgctgtaaataattattaagcaacaacaacctttatcaaagtttattaaaaagaactaaaaatcatcctcctccctcctttgagccaagtctgacccaaagtccctctcctctccctctattttcctcccttctccctcctttccttcccggcccactccctcctctcctcctcccgcctgggcctgccccggcccaagccgagccgcagctctcccgcgcgccgcacgcgcgttgactgcgacccacgcgggtcccacccacccggtcgtctccttcctcccgcacggcctcctctctctctctcccgaaaaccctagttgctttcctccctcaaatccacacgattcaaacatgggattccaaaattaattagggagaattaatcccctttccttcctcttcaattgcgcctaaggcctcgttcggatagagcccggccttttccctccaatccctagggatattggtccaccacccagaccagtggaaatccaccactcgccgccgcctcgcttctctcgtcgcgtgccgacgcctcctcctctcgtcgcgcgtcgcggcgccgccgccgcctccgtcttctctccccgagcggcgcccacgccgcctctcctctcgtcgcgcaccgcggcgtcggcacctcccctgccgcatcgcatccctcgcgcgcgccgccttccttcctccccagtgtcggcgttgcttccctttcttccccggtgccggcgcctcctcccttcctccccgctgtacatgctggacagagtgaagcagtcttctccaagcccagatccacgacatcagccatcaggtacaccccttgctcttctcctcaccgcatctgttcatattgatgtgcatattgattttcttgattcagagcgtttcactattcagatcgattcatattgattttctagtttcatatatgtacatggatctgctgttagagctgctgcatatatacactttttaatcaactaacagttaagatcttaaaagtctggtcaaagaaaaagaaattctcaaaattggtagataccataaaattggttgttagttcagtgtttcactaacaatgagatgttattataaatgaaaagttaattttaatcataactcgaatttttagaagtgtgtaaataaagaaaccatgcgaagttttattatctaagtgttgcatttcaagtctgaaaataagttggagataggtttaaattcattattctcacttttgtttttcatcatcttagactaaatgtctttgttttcatgaaactggaaactcaaaaaagatttactattataacatcttgcttgttcaagcagttctttgttggtttggtttctccctgccggtctcgtcttcttacgtgttcttctcttctgtccagttgaagcagttcgggggactcaaaggccggagggcttgttcgccaacctagctcactgagctgccaagctcgcttgtattggtaaggtggttgcttctcttcctcctttgttcctcgtgcatctgctactgcttctagttttgattccattcaccaagtagtatgtgtgtagtattggtcagctaaggtcataatttatagtgattgcttctagttgaactgcagtatggcacacaataagatcaagtttatttgcattctttgccattggtataacatattacaacttacctaaagattgctttctataaggtccaattgagttagcgatgttagaaacaatcattaaagaacttgtttttgtgagtaatttcatattttagagctatattttactcaagtcacattccaaagaggaagcatgtttgagtgaggccatatcctgttcgaaattttatatgtgtaggaatagatttttctctatatgtgctgctaaacatccaaatgaagactgattgactttgttttcataataatggaagctcaaaaaatgtttggtgctgagaccttattacccttaacatgaataaatgaattagtgatgctgatatttaatgaggaaatcatttttttaaaaaaagtccttattgacccaaccatgatgtgagtatagtatgcatgaacagtacactttttttcctcttgtgtgtagttaaaaaaaaagggttcaagggctattcgaatgaggaagcgggaggaagaggatgacgatatgattcttttccttttccctgctctgcatcttttctactaaacacaagtactgctcaggttatgaactttgcaatgagctaattgtcaaggagcaatcattttaagcatgcaaaaagtaccttttagaagtgtataaatggacagataatgttgcatgatgagtccccctaataatatttttgacgtttgattcagtttcctttacagtccctgtacctgctactttgtgttgcccagacttttttcagtgaagaagttaatggttgcgccaatgtatctcaactatgtgaaataaagataattgcatctttagcatatgaaattgtcctgtttcttcatgatattgttggtttgaaaaagaaaataaagtggggtaagattgtcatgttttttcatgatattgttggctcccagttagtacttggtactcctagtatcctaaatccagaaatagatcaggtgcatgtttctctgaaggatctgttgaattgtcttgtggcatgtagttagttaatttgattaaggtgaatatgctactatggtactaataagaattaattatgtctgattcatgtggatagtctctaagttattaaataaaattgtagaggaattacttacaatcaaaagttagattagatggggctggtcatgggctgaagatttgatgaaatgttccttctgtgattatgaacatgtatgcagttagctaattattaatgaacagttagctgaatttttagaagtgtatttacaggtgcctgtcaggcttttgacacaaataattatactgactttgacatattgttttggtgtgcagttttctgatatgtgatgtccacgggccttttgtttgctgcaccaatgatgcaaggaaatgtattatgatgtatgtcggaaagtgttgttactagatagaactattaaggcaatgaagctcaagttatgtcttgttttcccctcaaaaaaaaagttatgtcttgttcgatttaatacttgtaacactgagagatatttgtgtcctaaatctcaacgtgtattggttcttcatgttggttgccttttttttttttgcaatattgtaacaattacgacatggattttgcagcaggtcttcagtatttctttaattttctacaattttcgtaattttctaggcatttatatatcttttttctgtattttcctgaaaaattagattttgtttgtgcagtatttcgaattatgtgcataatattttgaaatttctggagtgagactattaaattgatatgatatctcaccactcactattatttaccacaccaatatacttagatcccatgggttgaggggattatatcccatggtggagtggattgacgtgggaattgggtggtgggaggggatccacccaatccctgccgcctagtggtattttccctggggaaaaaccaccccaactaccgaacaagcccttaattatcccttgattcgtgctcttattcacccggaacggcctagccattcacggctgccatttccgccgccgttccatgcctctcccgtggccggctccctccccgcgcttataaaatggagccccctcgttccattctcgtgtttttgcctcctcccgagtctcccgtggccgccccgccctctccctcctcgcctatgcgccgtccggccgcgtcgtcaccgccctcgccctcgcaggtgtatcctcttccccggcgtcgcttccgttccgcgtggagaccaccggaggtacatcctcgccggcaaacagtggcgttgccgcgactccaccgcctccagtcgccgcgccagagcgccggtcgacgtggctgtctcctcctttggcatcgcagcggcaaggtcgccctcgacctcgcctcccctcctcccgatccccaccggtcttcgtcgtcgtcatcgtcctcctcgtcatcgtctccgtccgacgtcgccatcccctcctccggttggccgttcatcctcgccggctcgtcgtctcgctgcgccgcctccgtcgtcggcctcgcagcggcgtgttccacgccgtcctcgcctccgtgtagcagctgccggctgccctcgtcggctactcgccggccccggtagtcgtccgcctctcatcgtttcgtcaagtgtgctgcagccccgtcgtcatcttcatcgtcgggtccgcgtcgtcaagccctgcgccggccgtgtctcgccttcgtccaagggtcgccgccgaagtcatcccctcgccgttcgtctccgtcattcccgtccgcctccgctgtgcccgttcgccgtcgtcgttcccacgcctcgtcgcgtggtggtaaggatccctcttctcgctgccccgtcctcgttctttcggtgtcgccccgtgcccgttgtgcggttgtcgaccccgatacccgtgtaccggtgtcggtagtcgttcgtgtgtgcgtgtggtgaccgtgttggtgtgcccgctcggtagccacgtggtttccacgtgtgcagcccgcgtggtgtctagtggagtccgtttgtcggccacttgcctcggttgacacatggggtccgcttccgtcgacccgtggaccgtctctgtgtactcggtctaccgtggtcctttaggttgacatgtggggtccgcatgtcaacagcgcatccttcatgtcttttccatgctagcgcttacacatgttttatagttgcaaaacctaattacaataatccgtaaatctccatgtaatagcattaaacttcggattaccatttcttggtcatacgaattccgaatcgacccgttcaagtctcttagtgtttgttataacctaaagaaccctgtgttttctttttatgtattgttattgcttctttttaggcttgtagctttgcttgtgtgcttcgcgtagctttcgtcgttccggaggttcccgaagcgtggttcgctgtcgtcgccgaaggttcggaaggacgttctctctgagcaaagcaagtcacatcatccttgagcatattgaatcccaatttataaaattaattattttgatttaaatttttgcattatcgctttatttaaatccctgcattatcactgttttatttagcaatacctattaatctttgttatagccttattattgctattgtttattatcaccttgcttaccctaagaaaacaaaaccccaactagtgggtactctattaatggttccactagtatgaacttaactagatgcttcgctgattaattaggcaatactaggtggttttttaactttagactttgggagctctcatatcatttggacattatggaatggttggcttgtgatggaattgaacacacacctcccccctctattcaaaactcccaaaatggttttaggctgggctcaaggtgcatggttttgctaggagcacctcggccaccataaggaccagtcttcgggcctctgttgcaaagcactaccgtactaaccacatgtctaatgggtaaggcttaactcggtgctcagtctagtcctggcaagaggacacggatagatatggacgaagttggggctcgatggacatctctagggcaaatgaaggctatacgggctacggctcggtagtcgagatgtcatggcacagggccggtgttctgctgctaggggctcaatcctgcctacctgtcccgggattccagccgtaggcggggttgggtcagtacttttgtcacggctaggatgggtaaaggggttatgtcacatgtttatgacgggttccacggccttggaatgtgaagtaaagatgtgtcttgtgggtaaagatgtacacctctgatcagagtataatctattcgaatagccacgccctcggttatgggcaagcctagcaatatacccaagttagtggtttaattcttaaaacttgcttaacaactaaaatgtggaatggttggcctgggttggcttgggacgaactgagacctgggtatggttgccagtttggtctgaatcatcataggccttgggttaaggcaggttcgtgtgggttcacggccttgattaataatattgtgtagccctaggatcatacttttgaaatagctttgagcaactaagtgtcttttaaatgctgtttactgcaaaatctaacccctatattatcacccccttgtacccccttgcattttgtctaaagaaagttgcctattagtaagcagtcttccctctttcataaggctctaacttgcgtaaggaatcaaggagctacagttgtttcttgccccttttgtatttttctgaacacaagttcaccgcatcgcgcctcgtgcaccttcaatttcaccattggaccattctcaaatgccatctacatttatccccaatcctccttcatgattcgtctcctcaaccatctgtaggcagtcgatcgcctttacttgccttcgattcttctggaccgccggacaggtcagtcaacccttgagctgtactgaggggttggactggaaagcatactttatgtgattcctccttccccattgtcctctcctacccgcctttcccacatccatcaaagggatggcaattctatgtgattcgctacacttgctggcgctccaccccataagctaactctattgcctagcggttagcgacacttttccggtagtacaaatcactacacttcgcttctttttctttctatatgataatatgcaccgtcggttgctgcgcaccctgcgggtaatagcaagagagtgaagaacgaacgatcctcagtcagcagtgaatgagtccgactcgagttcgtgagtcaaaggcgtggcaagagagcgagttcgactcgcgaacgacccgcaagtgaaggaccgatcctttaacgccagtactgttgcgagactggtacttgggggctcacgagcaacatatagactaaggttgcccatcactccctcgctcctttttgaaggcccaccggcttgcattttggggcgagtactacagttcctccataatcacacagaacgcccagcttcgcagagctgctctctccccagtccacagcaaggtgtggaatctggatctacagtgtgttctgaccctattggatcaagtcagatactaagccttctactactacttaggtacttaggagagaaaatgctatatttcagagattggactctcttactgtgtttttctcagggcagttcccgagccgggattaatcatgcatctcccggtgtgacttgttgagtactgtggttgtactcattcttgctctatctcccccccaattcagtaagagaagctttggagaagaagtcctaggtgaagtcctggcttataccctagttgagcgcctgtgaagatggagccataggcccgctagtccgctgctgtttatttctgtttgtcaagccttaagtgcctttgtaataatgtaaatattatcgatataataaagatgtgcctttcatatcatgtttgtgtggtgtaccccgacttttcctgggacggggattaatacactagcgttctggaaaaggtatttttccgggcgcgacacgttcgctcgggggctatttgtatctaacaatctgttctgagtattgatttcaggaaagtcatatttcagggctttatcgtagtcgagaatggttggatgactactcgattattcaagaacggttggtggagtttgacaaagattacagaataaagcgatggtgtacacgctgtgaatgagtgaatattagaatctgtgatattgtttttcccttttcatttgttgttcttgaaacatatccagatgatccattgagctcatctgctcatgtccagaaaacacatctcttaactgttgtttatatgcacggttgatttttttggctgctatgttggactattgaagcgctgattaatttttggctttcttgcttctgcgttggctcgcgagctaaacgagctagctcgagctggccaactagccgagccgagctagacttttattagcatgttagtataagcttgaccgagctgagccgagccgagccaagctagctcggtatccacccctagtcgggtttattgataccacatacccaatagtaatccactaagctcggcagggcccaccatataccaagtcttatatggaatcatacctcatatatagaaaatcaacggtattgtcagactaattccgtagatacatctggtatgtatctacaaaggtacgccatattttatatgcaatttatcgtactatctatacaatattgtcatatcagtaatttgttatgtttacctagaacatgttttttatacaatatctattgtgcgagtgtttctgaagttagcccaactacagtttaatactgggggctcgctttattttcttttgtataaatcatgcttgcttatggtttacgtaatgcctgatatttaaatatgctcgttatatcctaataatgctagaagattcatgcagttctttgagtacatactcgatattctctgctatatatcttgccttctagacaatatttttcaggaacaatcgagcactcaagtagattgtggtcgagtacaccccattatcgagaacgttctcggtaaaggctgagttgtcacaccaaacctaccaatgaagaccgatgacttatctcatgtatagcgccggctacgcctggactatttgggcataggttgttaacggataattcctcgtgaatgttgttggcttgatcacccgatatgattgcgaacagacatctggataagctacaagttgggtatgtgagtcatgctggccacatgagatgcacatgtaatacctaactgtagtgcccctataggtgattgagagatgtctatttttggttgtcgaccagacatttgtagtgacatcttgccgcctatcagttgccttcaggtgatcgatagatgcctactcctggttgtcgaccagatggtcgtagcgatctctcgacgcctatcgtgacaatcaacatggccatgataacgataaccgagactgacaggatcgtcgtagtcacccggatgacaacgtccaggactgacgagatcaaggcgacaacagacaaggttaacgacatcacgacatcacatggtgacgatgaaactcgagatccccagacttccagagggcctgaggatgaggtcgtaggtccaggagacaaacccccgactacgatagtccctcattgacttcgtcgtcgtcagcaggcagttctcgcaggttgcgaggatgccgtccatctatctttctagattctcttcaaatggtcgagagatacctactcctggttctcaaccagtaggtcgtagcgatctctcgtacctcggcttcaaatggtcgagagatacctactcctggttctcaaccagtataggtcgtagcgatctctcctacctcggcttcaaaaggtcaagagatacttactccgggttctcaaccagcaggtcatagcgatctctcgtacctcgacttcaaaaggtcgagagatacttactcttggttctcaaccagtaggttgtagctatctctcgtacctcgacttcaaaaggtcgtagtgatctctcgcgcctctatttgttgagtacaactatacacgtggtcttcgcccagtgtggtggttgtctcatcaagtacatcaacttctataagtgtttatatgtgcaatatttgtctattgatcccctcttcttatgtcgccccgtcttgaagtcggtcctatcgtccctttacgctattctgacaaagcctccgagaaacctaaggggatttcagctggggacgcccagaactgataaggctttgttagatgctgcagagccaaacgaccatgtcagatttggtcatgtcagagtgctcactggatgcgtattaactaagcagtgtaatcgggaattggttttcccaacttcacgactgggggctaggattcgtcagcttcatattggtttgttataagatttaagttgcctttatggacaatggttttttcataaaaacagctgggggttaggaggagtaccaaactctgtttgctgagggcaactctagcgagcgtactcttttattgtcacatgcagatttaatttattttcaatttttccatacatattatgtcatgttactcttgagcgttcgctcgggggctatttttatttaacaatttgtttagacttcaattttaattcacttatggaccgttggactccattcagcgttgtcgaggactccatgtctctacggtcttacaccgggatcgactaagcgagtatgacaaatgttgactagagaagtcgcggatgacaacctgagttcatttaactctacccaatgtcagagttcagaacagttaaatcagatttcagggatctgtcgcagactctacgcctactcgattactcgagaacggttggtggagttcgacaaggaatataaaatgaagcgacggtgtacccgccgagatggaatttcttgactaaaatccaaattctcgattacggtaagacgagagacttagtcgtatgctccgtactttctcggttgacatcggagattaacctagacaaacccaatatggtgcctgcagaggtcgataagagggatctagcgctatctctgatctcaccatgaacggtcaagcgagcacgacaacagttattccaaaatcttcggtcgagaacttcaactcatttatttgcattgaagtcgggggctactatcatggttatggataccacatacctaatagtagttgattaagcacggcgggacccaccatataccaagtcttatacggaatcatacctcgtatatagaaggagttccaaataaggaaggacaagtagagttctatatggaaacgacaaggactactcggattgtatccatattggtctccctagttctaattggacaaggggacatttatgggtataaatacaagaccccctagggggagagaccaatagaacaatcaagataggcatagaccaacatatacacaagccaacacacgccgctagacatcgatatcagagataagcctggacaaaccccgtatggtgcctacggggggccgacgagagggatctagcaccatctctgatgtcaacgagtttgtactcgaggaggaagactacctgtcgtcgactacatgttggtaatccatgccgccaagtcgacgacagctagataggttatcctaattattgtacttgtgtgattcggatgaataaagagaaacaccggcttcggccaacaggataaggggctcgaacatatataaaatccttgtctccatctcttttacctcaatctcgtatataccctggtaccgacgatccccataccatgcaaataccatagtcgagccctcaaatgtcgacaactgcgtctgtggacgtacaaccaagtcttgctgccaacatttgactttgttgttttagcctttgcaacaacaaaacaattgagttagaggcaagttatatgaattgatggattaaactcatagcttaattacctatagtacgctccgaagaatacctacttcatcttctaacccaggaggtgtgccaagggccacacccgcgtcgtttacggacatcattagctcaagtgcctgtaggtggatttaatctagtgagaagtaggtgtaatgtgaaatgaagaactctaagccttaatatcttactactcaaccatcgtccttgctcgagtttggttgtcgtactcattcatctccacaaacccctctggatctgtagttatgtcagctagagtctaggccttgttgtgagcgactcgtgaagcacaacatgagctgcttagtcactatgtggccgagaaattgcacttctttcatccaaaattcacacttagaaaaattaggcttttgtaggattaatcaaatttgctttttctcgttctatctcagagtatccattcattcgatcttgctatccgctctcaattgaatcccttctctgttgtcgacatgtgtgtccgcatctggaccagaatcacgatctagtatctccgtactcgaatacctcgtactttattaattaggaagtgaagtagggaacagtttcctattcaaagtacagtgccttcggtacattggtgcattggatatttccaggtagcaggtcggtagagtgagggctccatccataacaaaacaagaacgtctactgaaatgacggaagatgcatattattctctctcgtagctggggctaagaacgatcctcttatccaactttctgtctatcccaaaaccgaaccttgctcctgcttctacttgaccggtgcttgcttattattggcattagttagtagcctagctagcgcccttctgtgttattaagcatatcttgcaaacctactgaatgttgaatctcgatcgatgtcaaaaaccaaccgtagaaagagaggtcgaagcacctgatcactcattcaactcgtttttcgctcatgcctgtatggaatgcataagtcattgcgttttggtggtggagttcgctctgccgcgtaagatcctcgaatcaaccactgccactgtcttttgtctttttttcgttctcttccctatgctctcccttggcccagggagagatgtaacaaactcaaatttttagggaaaaaattttgcgaaatattttaagacttgatcttctcgattcttatgttgagcgaccttgctttcttttagtctcttttactttagatctaaattttatttgcgaagttaaaagatctcttttaaatttcataaaatccttaatttattctctaattcgtttatttcaaattttacaaaacctctctatttactttctttaatctctaactttggctatagattataattcctttgaatccttacccaaatatctccaacatccaaaaataccttttctatcctcacctaactatccccagagtacatgaaatatcactcttcaaccatccctagagtacataaaatagcgattgccactttccctagaaccaatactttccctttggatctctacccaaatattcccagattccatgagatatccttttcaatctccttgagtcaatatacctatcctttggagcttaccaacctaccaccaattacaatcctatagaaattcctatgattccccatttaaaattatttctaatcccttctattcaaaatccaacttcctttagccacaactatttcaccgagaatccataccacatatttggaggccaaaatcctagtcatttgcctccatctatttttaccatcatcccaaaatttatccaaagctagaaggttaatcatttgtatttctttcccttcctattcaaccatttcaatttttaaacttttaaaatattagagaaaatcttttgtgacaagttttacatttggttcttattgaattttataaaattggagcatttcgatccttttttcaaataaatatctttgattttattttaaaaatatttcaactccttttgcttcaaaaaacttatatttaaattccttttataaagttcaaaagaccctcaagcatttgtgttttagattttatctcttttaaaatttatttaaaacccgccattcaaaattcccctagttttcaattccttaaattctatttaaattccttgtccaaagttcaaaaggttcacaaatatcttcctttagaatttttcccctttgaattctagtcaaattcaaaaagttcacaaacattcttcctatagatttcatctcctttgaattccattcaaaatcctctaaacaaaaattcccaaaggttcctattcaaatcgggccgaaattccttctcccatcggcccatttcccacctcagcccaagccgagccagccccagctgagccgcctccttcctcttccctgtgggcgcgcgtggcgcacacgccaccatcactatggctttgcgccaccgtcgccgtcgtgtggatattatgaataacccatacccacagggcatgtatatctgactgggtataggggtaccatatgtagatataatatctttaaaggactcggattaatttcctaacttgtgtatcaaggaaatacccgaggatcttagtcggttacgattgtaatttatctttacctacctattccgttaggaatatgggctgtaccctgtaatacggactcctccccttatataaggaggggttcgggtgcctcttgcggcataacttttctcccagatcatacgatcaataacatactcggcggatcaatccccggacaggagtagggtattacttctcattgagagggcatgaaactgtataaatctcttgtctctaaacccatccacttttcctgcttgatagccacccctttttgtattgccgaaatcttgtttcgacagttggcgcgccaggtaggggtagcgtcaagcttttcgccgatcagtgcgatggtgatacgacccgaccaaggccattcacacataatgtgattgttgcacatcaatgcaaggataacgctatgcttaactccaagtcttattgttttcatcaggaaaggctgctacttggcttgtatgattgtaggttaaagcatatcgttgtgcttaaagagagagacttaactcagattaccaccactacaccaaggcaacgtaatcgtgcactacccttgctatcatatgaacgtaaaccaacaattggattagtgccaccattgcaaggaccaactacgctaagccatgttgtgactccatcaccaagagattgtgctgagcaaagatggagtgcacaacatcattcaataaaaacacgacaaaaggttaattcatttcttgctaaattgaactttagtattgatgataattttatactatctaaatggtgtatatttgctttgctaaggttcataccaaaggagatggtcactactacaaatatcaatgactacatcaatgggggtnnggnttccacagaagatgaagtgacatttgctcaagtggagatggtttacgacaacgagcagactggttacacgcagatgctccaacttccaagggatgtgcgatccagccagtcaaatttctccatgcataatatatatggttacaaagataattaagtctagtttcacctccaacaaatggctcgtcatttcgacttcccaataaggagttatgaacaaatcattgaggactgctcagaagccaaacagacgcgtgagtcttctcggaaattcacttattgtgacctttgagatagcctatgtcctgtaaactcccaagacctttcattcccatctaggagggttgttcctagtataaatatcccttatgttttatcatttggaagacttttgagaatcaaaatacaaacccctttgttcagctgtgtgctaacaaacaccgagagatagagatctctacccctttgctcttgtgaattcctcgtgggattacatagcggccgcttcatcggcacccaatctgtgctcctgctacttcgtgtgcaggctgcttaggttggttctttgagagtgtgattgggcgaatccttggttcaggctgccgtatagagacggtggttggctccttgtgcgtgtcgtcaggttgcattagttatccggctgctcgcagctagttatcttggctgattttcagctagttatcttgttcaagatcctacatcctgaagatcaggacaacatccatatcatctggtatcaaagctttcgttgtcacggtaggattttttatccctagctacatatatttgttttcttcctatccagaaaaagactacaagtaaaattttccgtagcctttgtttgcatctgttattgtagtgagtttggttaagtttcagttcattagagtctttgtttagttgctgatctattttccttcgcgtgtcctttgagccgatctattgttgtctctaagaaaatccctacaaaaaaaatagtagtaaaccatatctatcctttgcgtataccttgatcctattatgttctaattgctgattttatatttttggtttggtctatcatttgtgtaagtgttatacatgttatagtgttgtctttggtgaaaagaaaaaaaaagttgcaaaaaaaagggacttgagaaaagattgaagaaaaaaaaaagaaggaaaagtgaatagataaaaaagaacagaggtgaaaaaaaattgtgagaagagaaaggtgaaaagaacaatctgttggtgttatatgtgctgaaccgtttatgccaccttgcaaaatcagccgttatctacctttggtgcaaattttgctagatctgaaacgtaaatcatccatccctagtgtaatcctttgttttgcatcaaaatatcctatgtttctttgtgcgtgagtttgtgtttctattccaaacattttggatcagcactaggcattgatatctagtttggattgctacttagctttacaacaactagaattcagattgctccttgtgctttatcccctaccaagctccacataaaagccatcgtgtacggtttactggtcttgtattcgctcaattatcactttcactttaccaccacacggattgccttagtaacctcataagagcttcggttggtaagagaaggtgaggttgtgagagtttccacatactatcatattccacatatattttgctacttgttttactaaccatggcagggagaatgtatattcatcttccattttatggaagcgctgatccagaggagtattttggatgggtaaatcaaatggagattgaacttgaagcccaatgtttttgtgaagagaagaaattgcagcgtgctactctcgagttgaaggttatgcctatacttggtggaagaaattttctcacaagcagtatgtgaagtgttgggaagatttgaagaaagtgatgagaaaggaatttattccaaaagagtacgagttgtttttactttgttgtttgaagcatgtgaagcaaggaaccaaatctgtccaagcatattatgatgagttgagttcttgcttgtgccgagcaaatgccattgatgatctagatgcaattgagtattttaagagaggtctcagtcctaaaattgctactgcaattgagggaagatatgcaagaagtgttcgaggtttcttgatctatgccattaaagaggagaagaaagtaaagaagttgcaagaggggct

SEQ ID NO: 32007 - DNA, 11383 bp, Oryza sativa
ttgatgccccttgttatgctgatttggagatgcaacaaaacccaagtgagaatgagagccacatagccaaattgagtgaaagagataaaaagagtgtgttgtctgattccaccaaatatgaggttgagagcatccacaatgagagtgagagaaatacaccacacaaaaagagaggattagagtgcaaagcatgtgaggatgtttttgattctaacaaacttatctccacttttagtgttgtctctcctaatgttcaggtttgcaaagaaaaagatgaagagatagttgtcaacccgatgaaatgtcaagaagataaaagaattgagaagatagaccttatggagaattacccaactactgccctgagtattaaccatgatgataagggaggtaaaaattcagaaacgacacccacattcgatacgtctccacaagagctgaaaggtaacaaagacgaatcatatttctgcaagcatgaagagttggtgagtgaatttgttgatacacttgatcaacgtgatattttaattgcaaataaatttgatcttgtggaactgattactcatgatgaagtctttacaaaaatattgcctgttgaaattttgtgttatatcatcctcgataaacatgttgaaatacacgatatgcttgagaaagtttctgaaatagcttcgctgaaatctttgaatagtattcatgtatgcaagtatacttttaatttgattggtggatatgctgaaaataaattctatatgtgtgctatttgcattacttgtgacaagcttgctgatttgaggttaaaattagtgaataatcatgcttttgaaccttcttatgctcagcgtaagttgaacaaaatgtttggtgcttgttgtttggaaccatttatgtcaccgacatgtgcatatttttcttctgagacactaaaacataatggtagaaatgatgattctttgaaaattttctcatccatgcttgaaatggttggctttgaaactaatgaatttgattgctcgaatatgttgcatgatacaaaatcttggaatgcagatttggtcgatgatgatagggatgaccgtcgggtggcaatacgcactgctcctttcaccgatatccaccggcaagacacgaggcgccgtgcacaactccttcccccctcctcccaaaaaaaaaagacgtgaatattagggaaggacctaatatcaaataattagaaggggtaaggcttcgaacccagttcgtccagcccaccaccttgtggagctagctggtagacctctgggtgtttctccacaactccttccccgacctcatcctccgtacagcgttgcctcgttgcacgctactcgcaccgcccctcatcgacgggtagtcctccttgctcattcaagagaaaagaagaagagggagagagaaatcccaaccatcaatgacgccacgtcgggctcatagctccatcgatacaaccattgcgcggcttcaatccatcgccgccctggccgatgattgtcgccagtcatcgaccacgccgtcgctactacttcgctgcccatttctagggttgaggagagaggatggggaatgaaggtagggacaaaattgtactctcacatcatcacatcattaattttatctctccgattcatccggcaataataaaataaggccgtgggtgtccagcagctaattaccagtcttttgtgatgtccgacagcatatatatattcttgcgatgtccactagctaattacacgtttttttgaatatcttgtagcaaattttacctttttaatttgggatgaatttatcacgacttgacatcccatgcccacatccaatgtgctctccttctcgtacacctgaacaagaatggaaagtggccaacaacgttcgcatgccatctcaacatatcttctccatgtatcagtgcaatccataggcataagctcccaaaaataacctacaagttgacggttaaccaaaacataaagtactataaggccatgggtctgtggattgattttaaagcctctcatcagccagttgcatacacccccggaactcctttcgacaactctatcaatgcccttagtcatactcttgaactcgaacatatctacctcattctgaccatatctaatgttgccttcactgtaatacaagtcgaatatcagcttacttaacatatctgctcacagattaaagtctcgttataatatattaaaataaacgcaattgctatctgtgttgctaaatgtataagtacctaaatatgtcataaggttactacagcatacatacgtactagatctacacccctagcattggatgttattactaacataggatttctatacaaattaataagttgctaaaatattgtccctactcaaacttgcaatgcattgaaatggtaatggaaaaaaaattacctccaatcgagtgtgcgatccggcagggctctgctgcttccttcttaaccttccccttacccctctttcttttttttcttgatttttatgaataaatgagaattttcaagaggaagggagggttttatatagggctgtcaaaaaagctcgaggctcgcgagctgctcgagctcggctcgtccctaagctcgcgagctttttttcgagctgagctcgagtttctaacgagcctagtaatatatgatttttgttgttatttaataaattaggagatcaaatatgttatttgtatgccttatattgacatcatatatttattttattcttttttcctcttctattaatatgatgaactagaaattaattattttttaaagattatctttgaaatatatattgttttccttgaaaatcaagctcggtagtcgagctcgagcttggtcgagctcgagcttggtcgagctcgagccgagcctgtcggaaagctcgaacattttataggctcggctcaagctcgactcgagcttgtattgagctcgagcctaggcagacgagctcgctcgagctcggctcgttgacaaccctagttttataggtgcggggagggggggttgaaaaatcaccctccccttgggcggggaatggccggtcccctggccgggagggggcgtcgagaaattttgcagtggtctcctcgcggtgataaatcgccctagcgtagggcgagaaggggccgcttgcaaaaatatcacggcgcgcccctctccgcggccgccatgtcactcttagccaccgtcccctaggaaaatttatatgccccgccctacgggtggagtatagttttgtaaaatttaaaatggaaatttaattttgtaaatcttttcaaaaataaataaataaattcttttaatttcaatgtctgtttagttttgggccggaacaccacccgtttgggccgaaaatccagcccgtctcccaccatcgcagcaaccgacgaagttctcgcctccccccaacacgcgtggccacctccgcggcgcctcgtgtcatcccccacctcctcgcctctcctcctcgtcgtcgtcggcggcgggccggagccacatgggccagaccctgcgcggcgccgcggggcgcgtgagggccccacccaccccggcgccccctcgtcctcatcaccttccgcctgcgccgccgtcgccggcgggcgctggcggcgcggcggcacaggatcgtctccgtgtcttccaggatggtacggcttccttgctgctcgcatttcgttcggttcttagacgccgtagcttgctcttctaggcagaaaaaatgctccctctgaatgatcgctacagagagcgggatgctttgatttgctctacactactacttatcaaagatttctcatctgctctaacttgcgtccaggcaaattagttcgttcttgagaggcctcgcaccttgtaatcttgctaagggaggggaggaggagggaggtgctagggggggggattaaggtgctagtgggacatgatgttgattataagctcgaacaatatggccctggttttgattcttgattatcttcggtcatgatgtgcttagggatgtcgtctgcgtgttgttcgattgaatttaggtattgttttgtctaatgtaatgtttttgttgcagatttcgtgaaatcgggtactgatcccatttgggaagcatatcctcctgggctctctatcgggtctcttaataattgatagatcggtagatatttcagtattacaaccaattatgttgagttaagaacatacaattcctatccatcccaagctagttccgaaattagtctcccaagtaagctcgtcaccagtgcatgctaatgaagagttatatataattttgataactcatgtgggatgtttactggaagtagcacagtttccagttagacagcttatttccagctgagagtgatgagggacgagggtcaatgttcctccacaaatcattaccgcagcttgctcatcacattattatcttaatattttagaaaaagaagttgttgtatcttggtgggttttactgctaagcactcagcttccagtcaatttgtggccctccagccaagtaaaaggattgctcaaccgtcacaatgtagcacttttgtgaactgagacctgaatatgttttagaatcatagattcagctagggtttactatcagaaattcatattcctttctaggattattcatattctttctaggattaactgtctggtgggtcatttgtttgggttgagcctgtgtatcagaattttaattgatggataggtgacttctccaacacaatataggcagcccacaatatatgggttctaaatccttgggttcaattagggtttattgagggttattttcaagagaactgaaggatacttgaacgttctcaagtcctcagcacaagcttgattgagatttaccaaaacattttacatggttgtaggtttcagattgctgtggccactattttgctttgtagtttatgatttttaaagaaatggactgcagatgtcacaacacaaccaaaagatgcccctggtgtacttaaggagcgtgatccaagttatgatgagatgcttaagcacatggttgggagaatcactacaaagcctggaggaaagccagaaatgggtgaagtaagccctctaacttcagttgttcccccatgctgaaattatgctgtttccctggtgtttttatctcattacatgaatcggtaaataaccaaacctaaagaatcaggttgtttagtttgaacgtaatcaaatgtcggaggatggatacatcatacatgctacagcgcttacatctgaaccatgagaattttctccttttatttgaaacatcattgctgacattacttgcttttcctggtaaccattgtatggggaaaaattggaatactttagcctgaaaatattgttgtaacaatatcagtgttcatggggaataaataagtttcattatgtactctgtacttgaatatccaaattttctttgcattgccatactaattcaggttgttatccttgtaggctttcgtcgtagatcagtacaacaggccactcccaagggttagaacatccagacctgaacccggggaaggcggacacagacaactacctccaggaaccattagcgtcgctcatgtccatgaaatcatccaactgtaccaaggaaagtccagtaaccaccctggcccaatgagcgtggacaagattgcctcaaagttcagagtcgaagcctcagtggttcaaaacatcgtgcagttcgtctcacttccgcaggaagaacatgttaccaagaaagaggaatactgagagtctataggatatagcgatcttgcaggctgtctaacacaattcctttgttcatgtttccgagtttgttctgtggtggactactgggaacacaatgtttcgtagcttaggttctttcttcttgttgttgctgctgctgctgagatagtgagatgagatgatgatggaactggaaatatatatgctgtatgaataaaggtgaaggacgtgttttggccccttgatgctcaggatgagcatagctgcataggttgttaacttgttgtatgctcttttgtcaggttgacatctgctacatcttggaaacatcattaattggctgtgtactgagaaaaacaccaaacgtaaatccagactttttaggtgcgttattcattttcgtctttttatttttacccagccatgtcttgatgaatgcaactaccaaatgaattttcataggaatttctttacatactggtagcttgcaatttcaggcctttcttggaatagcagaattgaatttaaggcccttttggattgaaggatttcttttttaaaaaaaacttggaggaattcagtccttaggaaaatcttcttataagcatctttggtacaaataaatatcattcgcaaaaatcctctggatttgcttcatatgattcaattccataggaaacaaagcataagcttatacctcgtgtctttattttcctagtgcaaaccatctaaactgacattgattttctcatgaagatatagattttacctcggtttccgttagcatgtttttcaaactactaaatggtacgttctgtgcgaaaactttctatataaaagttgattaaaaatattaaatatatccatttgtcaagtttgtaataattaaaacttaatcaatcatgtgttaatagcttttttattttacttgcactaacttaattttcatcttcatgagtttccaacaccaccatagcataacatccgttattcatattcatagagaaggaaattatgagataatcaacatccaagagagtttgaacatagggcgatgtgttgctcctggtagctacctactagctaggctatgccatgttttttaagattaaattgcacccacggtacaccaacttagcaggtgggtgcgatatagtgcaagaacttgagaattgaacgtccgggtgcaacaacttgacaagtgggtgctttctagtacaagaacttacaatttagtattttggtgaatcaatttggttaagcatatgctaggtgaggtttttcacgatgtcaatatgccaatacacagtaatcctatagatattacattataatattgaatgtaatctttaagaattatattgcacatacaatttacatatacagttacctttaagaattttttgttttcttcaccttctcaaatatcaaccgaaatataataatttctacatccagtttaattgactcagttattagttattagagttattagttattaggataaaaatataaatatgtttatacaaatccacgctagtatattgtcaagtacttaaaaatttgaatttatataaaaaatgctccaaataattaagttgtcacaacttcttaatttattgtatcaaaatcgtagctaccttgcaagttgtttcatttatacgatcatcacttataaagttattatactaaattgcacattcttgccaagttgttgcactagaaggctcatttttcaagttattacaccaaattgcacccacctgctaagttgttgcaccgtgggtgcaatttactcttcttttaatataacgtgaagtggaaaaagcacatgaattcaaacacataagagctatgttttttttatcacatgaagattttgaagacagatagatatgaaacaaaacgactttccattaagctaaaactagatgttttctttcctatagaaatagaggaattgccacctctccgaaggaatcaaactgttccactcctttgtcccaatcctaatctgaaactccaaacgattgcacgcctccaaaatttcttgaaaaaatattcgttccaaatagcgtagtgctcccttcgtcccataaaaaaccatataatattttctgatacaatgaatttgggcatacccctattgagatttactatactaggaaatggcacatctcattttaagttggttttttatgaaacggagaaagtatgtaggattaggaacccaaaagggtgtgaatgacatcatattcctatgtttaatcaacttgaagttggttgcaaaccctttcatcaatcaaaagagaaaaaaaaaaagggaaattggggtgaaaaaacaattaggcaaggaatccctctcccaagccgtaggatcacctctcgcacgaatcacgaggcgcatctctccaaagcctccggctccactccaactcctctcgcctccgcggctccgcccatttcgcgggtcgccggagcagcagcagccgccgcgccagatctcgaaccttctagaagcttccgcccgcttccacccatctcccccgagggcgcctggatcccgaaccttctaggcgtcggcggccggggaaggcgcgaggggaggcggaccacgggatctgcttcgaagcccctcgcctcctctggaaccttccgggcgcggcgcggcgggatggcggtgagtttccttcctccgcgctgcgagttacccggatcggcttagacgatgcaatttctaggcgagttaaccagggattcctcaaattgttggtggcttgctgctgctggtctcttcgaccattgaacccgcagttcctgcgagttgatgatttggttttggttcccctcctgggcatgtgtgctgcaattagaactcagaaatttgtagagatggtggaggattggtggtatttgttcaaggcaaatcttagctacagagcatgccactgtttgaccagaatgtgtgtttacctgtcacgcaagcttggtatttgtagcatttctgttcatgttgctatctaggcgtgtagaatccatgaattcagtattatttgaaagtcatttgctggcattcaggagagtttgaatttcttttttctctttctttttaaaccatgaatgatgtgtgttctcttataaccttttcacgtttcatgtcactagagtgcaaaagtgtcgcaccccgttaaatcggcctccgaggagtccaaagtactcgtggtggagaatgggaagatggttgatgttcaggacaaggaaatcaccatggaaggcctctgttccataagttcttatgaccagtgggcacggatccctgtttctggaccgcttccgaaacctcgctacaaggtcctcctttttttacttgcatgatctctaaattccgtctagtctgttgtgctgccatcgtcttctcttggtggttttgacatgctgcacttatcttctacagcatgcagctgctgtggttcaggaaaagatgtatgtttttggtggaaatcacaatggccgttaccttggtgacatgcaggtatattagtcggtcattatacttaatatgtttttttcttgtgatggattcttggtataaactttaaaatagactcaaaattccttatttgcttattaatagaggttaattgtgcaagttcctaactttactctcgagcgttgagaatgatatgcatctcaacaatagtatcttcctttggttgaaggttctggatttcaaatgtttatcatggtcgaagctagaagctaaaatacaatcagaagaaccttcagacttgactggaacagcttcgcttcctccttgtgctggtcatgcactggtaatcaccagatactctttatagtcaagttgagcggaactggattttctcccagatagatataactgtgtagcgtatttccttctggcatttaatctccgcaggttccatggggaaacaagatcctctgtcttgcaggacacacaagggaacctacagaaagtctcagtggttagcctaatattttgctcctttttttctaatcttattttttttgtgcgagttatatttcttatataaaataacatatttatgtcagttaaggagtttgatccacaaacttgcacctggtcaaccttgcgcacttatggcagatcaccggtaccttttttttaatctatttatattgtcagaaagcttctaaagtactcgctgctttttttttttttgtctaagaatatgtggcggtaatcttccttttgctttagagctcatgcggtggccaatcagtgactcttgttggaggcacattagtagtgtttggaggtgaaggtgatgggagatcccttctgaatgacctgcacgttcttgatctcgagaccatgacttgggatgaatttgagaccacgtaagttttgtgattgaagcatgtttttcagttgttgtaaagtgaacaaatgacaatatatttttttaaaaaaaaaagtgatcaaaatgtttatggtccttaatattaggattctgctgaatgacctgaattttgtaactcgtgtgaaaatgctattgcaggcgtactccacaagttatatatttttaggcattaattatgaaatcattcttctagtaaattcattaccaagttccttgaggtgcagagctgatatctgactattttaaactgtactgtaattttccagaggcacacccccttctccaaggtcagagcatgctgctgcgtgctatgctgatcgttatctcttgatatttggcgggggttctcattctacatgtttcagtgatctacatctccttgacatgcagacggtgagaattgaatcttttctttagagctggtattcactactttaggaagtccaaataaatggttatctgctaattgcagatggaatggtcaagaccagaacatcagggtattactcccgaaccaagagcagggcatgcaggtgttacggttggtgagaactggtttattactggaggtggtaataacaagaaaggtaaggatgaaaatccagcacctaccttatactacgattatgacttccaaaacaattgagcttattcaatttccatggttttatcacccttgagtgtagctccttatccatttacagatgatatatttgttatatcttttcttgatagtttttgagcttttctttagaaaaagaaaagtagctcacgaaacagttttcgctcacatgtgcttaatcggctaatcatgatgcactgcaggtgtcccagaaacacttgtacttaacatgtcaacatttgtatggtcagtcgttactggtcttgaaggccgtgcacccccaacaagtgaggtgagctctttatgtaactgggttctcctagtaaataaatgggagcatcatctttgttctgcatatttactctgaatcatctgatagtttgggtgaaaagttttgttggatcttgtattcaaacattgaagttcatattattctaaccaatgacatatttgtaacccttgttaattgcatttctttcatgttatgctcccatgctgttggtgatattgaaatgctgttgtacatcagggctcaagtttagtgctgcccaaagt

SEQ ID NO: 32008 - DNA, 1971 bp, Oryza sativa
cccctggcaactaaatgaacctgaaacaaatggattggcctctgtggcagaaaattctagcagaggggtcatatttgaaattgaagaacttcaagatgaaaaggtaatggtagggtgcagaacttcagttttttttccaaatatttttagaagcatgactacttgaaacttgtttaagacatcgaaagtccctagtgcatatgttttgattattgttttttttgtttttatattcatagaaaatactaaaaatataactaattgactactgacgtcattttcatctcaaatcttaatcagttaatattccaaggcttgagtgcacacatcctaaaatgacgtccgtttaagaatggagggaataactcccaagacctgttcatgcacaacttatgtgttcttaatcactcagacttatatgttcttaatctttcagactattaagagggcagatacaagcaaaactttgttgcaagcagttaagggtgagaagagtcatatagaagaaaaacttaaccaggaagagctgcagagttccagactgaagcaggaattagctaacgtggagacaaaaaatgtggaacttaccaaggcaagctgaattgtttttatagaattgtgcaggaaatgtgatgcttttttctttcattttactatcagaagttatgtctctacctatttcttatgcatgggctacaattttccatttaagttcatttgatatttaaggctcaattgtatgcaattcagaaaaatatttatcaaagcaatgtatgatgtacctcagtgaaatttgttgctctaggctgctatttcagttgtgtttatcaagattctgtcattgagtgcattcaatgttgaaacctcaatgtgctaaacttcacagcatatcactttggaaatactagaatatagatcgaatagaagatactacctctgctagtgtaggtgctctctgcggaggaagaaacatgctttagtctctatgctatcaagtttaattgctgtgctctctgttatgcaggaacttgacttagtccgcaatcaactttctgctgaagaagcaagggcgtcgcaacttgaggtaggtaaaaagaatttagggaatgaacacatgttcaagcattcagtgaattgttcagatcagaaaatagggtttgattttacatctatactcattttcttatgaaaagctatgaatggtgtgcaacaacttagggtggattcagcattattgttccttgaagacacgttttcttaatgataaaaggaaaacaaacaccttttgcatggattggaacaaagctcattgacaaattaaatcggaaaccagcttaacatgcggcctaaccagaaacgagaaaggcaaactgtttatccctgtacataattggaacctgtacttgccatttagcttatctagctagtacctttatttttttaaaaaaaatggtacacaataaattaaaaagtgacatactttttttactattttatttatgtccatgggctgattctgttgttttcagataacattgttcatttacaccctttacgttgcagccttgaaatgtcatagtttaacctttcacgtcctactactcccatggggatatagatgcaacgataagaatcttttgtttccaaatgccagaacgaaatttcggatcttcaacaaaggctgcagaagatggagaccctggaaaaggagtccgaatcgcttcggcttgaaaaggatgcagagtccgacgattcatcttcaggcagcaaccagcggcctgctgataagggcttctggaggtggaatggataaaaattcatcgatacaggtagtagcatactagcattggatgtatggaggatatttcctgcagagttgcacattctttcaatttttgcccatttcttttttcccctggagagcccagtattcacaagtagatcaaatatcgaaaaatgtttactcacaga

SEQ ID NO: 32009 - DNA, 27979 bp, Oryza sativa
  unsure (1)..(27979): unsure at all n locations
aacatgaaatcaattaaattatgcaagaaatttatattgctggcaatgctacatgttttaagaatttcattaagcgcatattccagtgttatctgtatcacggcatttctttgatatgcttgggtgcatctgtgcgtacggaaaaatgtacttcaaaatataaagaagtgcgcaagattgcatagagttgtgtacctcctcggtcactagtgctctagctctttgatgtctcgcaaccagttcggatagaactgcaacaaggcgctgcttcacttcacccgtcagcatccttccttccttgtactcctgatgagtttcagaaatgttagcggaaatcagttgaagaaaacatgttaaagaaacacatcaggcaaattagctctacgcctctacatatatagcataatttgtattaccttctttatgtgctcgagctcattgtcatcttcaaggaagaagttcaggtacttgattggaacatccacctgaacatcacaatcacaactgacattgatttaaggagaaaaataaaatacttttttctgaatctaaaaatacaaatacagaacttgagcattgcacatgcgttaaagtaatgaaagtgcctaaaaaggtaaaatttttgcatgtgttagtgtttgggggaaaaatattgatggcttcaataaatgacaaaagtacaaacgaaaaggaaaggtcctgaatgtatgaactgtgaattagcattcttcctatattcaaattatttttctttaatttacatgttgcatttcaaacaaatatatgtcaacagtgcataactcaggtaatcgggggaaagcatactttactaagtacacacgtttcacaattaacaataagttcaatataacaagaaaatgacttacatcaaggttagctccaagttttctatggagctcaattgagtcccggccacctgagaacgcatatttgttcacctggaaaaaatggtaaaataaatgacaggcccatgaaaagcagaaccataaggctacaggacgcttgacttaattgaagaccaaaatttgaatggcctcaggtaaaatataaaattgcagtagttttccactaaaatacaatgcttaaagcaaacctttgtctttatttctttagcactatctgtcacatatattgcagaatttggatcactggccgacatttttgtgttctccccctgtaaatggaaataagcagctcacataaatcaatgtcccaaatattatgctatctaaaataggaaataagaaaaataaatgctgagcaatggacatgagcgatgaacttggcgaatgaagatgcaatcttatcagacatagataaatgcaatataagaaaatagcaagttactaattaaccaggagctgtcaaacagcacaggaaaattaagtggaatttcacttaaaaaatcgtgattaattgcgattgccttttttttaactttactagtaataatgattctagtgacaaaacttgcaagaaaaatagataacccgtcctttcaactgaaatttcgtatgtaaacaatcgctttgctatcattgaaggactaacttcagattgaggtactgagcatgagctctgtattatgcctccattgttgaattccttttctatgctcattttacacttctatacagtgaagatattaagctataaacccatggtcctaaaaaaacgtacctgaagagcagggaaaaatctcgattcaattaatgatggtttctggtaaccaattcttggagcaacgtcccgggtcatcctgaaataaggatcctggaagaacaaatccaatgagcaactcaaatccaatgagcaactcaaacttgcataacagaacatgaacatctacaatagctacctaaaattaaagaaattacaagaataaatgtatcatggtctgattgatgtgttcctagacgaaatggcatgatagcagcatggaaaggcagccaaaccacaaattcacagggagaaatggaatcagggagcccagatatgtttatacctggtctattgcacatgggattaagcaccgtagttggtcattcccagagaagagatgtggaaatgaagaagggaatgatggaaccgcttgcacaggaggaaagctgacttttcctatatgatcctctggggtgaatccaaatattccaacaacctgtcgttcaagagtaaacaatatcagcaaaagacaatggttggatgcaaacaagcaagtaaccaagcgatccactgcccaaaatattgctagactaacttaaactgctcaccttattatatgtcacacatctggcaactttaaccatgttttcataaaaagcactgtaagaaaatgacagaggattacttttctatagaataaataaatctcaagaattacttgcttagcagaagaacagtcattaaattagtcataaatgaaagataaatcaagactacagttaagaagaaccttaccctccaacataattaaaatcagagaaaatgaaagtcctttcgacatcaaatccacaagcaatgatatcttttgcattttcacgggcaagccttttagtttcctcaacagtcaaattcttccataagaacttctcatcatcagttagctgtattactaggggcaccttgaaagcatcctgcagatatctgaaaagggatactgacagttaatcgacgttgtccaagcattctcacaattataaattagaattaagccaacaatgtaaaggttcatcaaacaagatattgcaacaaagtttggaagctacattcagactagaaagcataggaaacattacacaaagcagcatatctatgttatattgtttccgtgcaagatgtaaaagcatgtcttgttttaaaaaaatgtttaaataccgaattttctttcatgcaaggaacatggtaagatgaaatgttccggggtaacattcatcacacccgacctttcaactggtccggtaatctattgcatcgctctgctgattcaccacataaactacaataagcatatgaaaggttctaccaacactgaaaataggtaaagttcactaggtcatcccagcaaataacacataaaaggtttgtgcacatcaccaacaaacgcattatccaagattcggctgctctagccaaacatacaactactccctctcaatactgccgcggcattgcccagttatttatacaacaacacgagtgaatcaagaacattgcaggggacagcgagtattgcagattggaacaatcgcgcttacttggtgaacatgaaggggatgagatggccgaggtgcagcgcctccgacgagggccccctccccgtgtagaggtagaacttctcccccttctcgtacaaatccagtatctcgttcaaatccctgcacacacacacagagtgagggcgagcaagcaaaccaaaatccagtacttagaatcgggaaacaagcattaagctagggtttggagggcggcggcgggcgcacgcaccggtgggcgaagaagaggccgcggcggaggaagcggtgaggggggcgggcggtgaggcgggcgacgcgggcgacgagcgcgtcgtcgaggcgctggcagccgaactggtcgacgagcttgtcgtagtcgatcccgcctttccccgccgacacctcccacgggttcaccacctgctcctcctcctccccctcctcgttcgtggcatccacctcggtcacggcctccgctgccgctgccatggcgggatctcacgcctccggtcgccggggacgctgcggcggcggcggcggcggcgaggaggaggggattggagagggtgggagataaacctcgtgctctggctgacgtgtggggcccgctggtcagaggcgagggctttgatggtggtgtttcttgctacgcgggttcgggtttgggtctcgttttgtaacgggccggaaggatagtgaattcttcacaattttggcaaaattcaggggattgtagccaaaataatttttggtaatgataaaattttggtaagttaacagtatactaaaattggatttcttagtgtctgttcagattatagccagaataaaccttaccaaaattttagtatgtatttaccaaaatttggtaagaaactaaataaatgcacatatttgacaactctatctaaaaccggtatggtttgaaatggcatcaatctgaacaagccattatatatttatcaaattttggcaaaaactaaatgacttaaaaaaaaggtatagtttgaaatgacgttaatctgaacagcctcttaattcaatcgaattcataattattatgcccaggattgtatctgtaaatttgaggtgatattgaagaatgcaaaacataaagcactcaaatttgcgatgacaacgtatgtattctgagctatcccatcgactcttggtaagaatcgccagtgtgttctcttgacttaggaatatgagatgaaaggacaaaagatgataaaaattcacgtactagctgttgagggtgaactatactctttcgtaattttacttcaggtacatgtattaggttaactaggtgaaatcccacgcattgctgcaagattttagtatgataataataaataaaaataatgtgtaagatagctagacaacgtaagattacttaagttagcatggttcatgataatttaaatttaaaccgtatatagaatgatgatttaaatgtaaaagtaaggtgatatgattttatgaaagtagaaaagcattgagataatttataccatggattaatcatctaaaggctaaaaatcattgaggtaatatgaattaatgagagatgaaaagtagagagataatttgtaccatatattaatcatttaagcattaaaaataattgatgtaatatggcttaatgagagaagagagaaatatcattaactaagtgaggatgaactatataggtacatagtatattataaaaaataatgaagatatatattaaaatattatgtgaattatgtgggatgataatttagcatgcttgtattttaaaagctctaaaatttaataaattataaaattatagatattatagcatgtttacataatgtttaatttaatgattgttagtagaagataatgtggtatctttgcatgttaagttttaggagttagtgggttataactttataataagagacgatatagattttcttcttactcaagtttagggtctaattgaggaccgagcgtagctcggttggcacgttcgcagtggagcgaacggccggtcgcgagtaactcgcgggacctcacctcgacgggattttcccgtctttctttaggacggtccttcagggcagtctcgactagaaatagggcacacacgcgtgcgcgttcagtgagactacacgtttcccgtgcactgagacctactggtctccaatctctttcccagcgtgtgttaaggacgcacacacgcgtgcgcgttcagtgagactacacgttttccgtgcactgagacctactggtctccaatctcttttccagcagcgtgtgttaaggacgcgcacgcgtgtatgtgcgtgtgttgtggtgtgagtgtggtgtatgtgagtgtgcgttctgagctgtaccccttcttaaaaaaagtttagggcctaatttgtcgttatatatgacatccaggtcgttattcacagtatcatcgtttaaatcaagtaaattagttactcctattaacacttctttgccattaaatttaagatatttttatcggtattttggtacgtcatacatatatgagtcaatttttaaattcgtttgcttttcgaaatacatatccatatttgagtcggtttttaaaatcgttcacttctcttctctatctctactattataaaaattgatgttgtttttgctggtaatttgatacgtcatccgagtttgaatcggttttaattttatatttcggtattaacctctatgtctactactgaaaaagaacgagaaatttccttggtctgtaaaaatggtaaaagaaaaaaagaaaaagtccgactgtaaaaaaaagtccgactaaaaaggtaaaataaaaaagaaaaagtccgactaaaaagcgaaaaaaaaaagcttctgtcgtagtaaaaagacattttgtcgtaataaaaattgtccgactccggaaaaaaaaggaaaaaatctctcaccagtaaaaaaacaaaaagtccgtttggttttttttaccggttttttcccgactttttttttcacgcgaaagagttttttttcccacgcgctaaccttttggtttttttcgtctggtttttttattccgatctctgttcactgcacacctcccgagcacttttggtttttccgtcagttttttctgtcaccattttttctcccgtgcgcttttttttacttatccagttttttaatccgatccgttcgccgcatgcctcctgctgccgccatatcgatactgtgttttctcctccaatttgattgcaaaaatcgtttccccacccctccctcatcattctctccttgattttccctttcgattcacctttaatttgttggatttaatctccgtttaacatttgccgatgataaaggccatcttccccggtcgtttttatcccgagtttcacgctctgattttggaaaaaaaaggaaatagtagatcgagtggatcaaaaatcctcaaccaattttaggtgacaggccaccgtactagtacgggattatcttcgggaggttgaagatggtagtagacggtgcgagctgggcttacggctccctttgttctaggtcgaagggaagtaggccaaacgaagggaggtagtggactgacctaggctaaaaaggaaggaaggctttcgaccaacgcacgggtattttttctagtttagtaatacataagaaatcatataaaagaatctatttaacaaaactcgcatgctaaagagacgatcgaactcctaactacagctcatgattttctaaaaatatatatatatccaaacgaactctcatagtaaatttcattttaactaaaccatataacaataataatgtcgacgtttgatgtcgcgattctggtatttgtatagtatggggatcgttggtactaggatatatgcgagactgaggtaaaggagatggggacgaggatttttatacagattcgggcccctgaactgtcaggtaataaccctacatcctgttggccaaagccggtcgttgatcttattcatcataatcacaccagtacaatatttggagtagcctatctaactgttgtcgacatggcggtatgaagttctgactcgtagtcgacaacagggtagtcttcctcctcgaatccgtgcccggcgagatcagagatagcgctttcgtctctctagacagtatccggagacaccataggagactagccgtgcttatctctgaagtcgatatccggcatcttgtcttggcgtatgttggcttgtatgttgatcttgtgtcttgatctattgttccgtgtatgttgattgtctcctctcctcctagggggtcttgtatttatacccataggtgtccccttgtccaagtagaactaaggaaactaaaatggatacaatccgagtagtctttgtcgtttccatgtagaactctagttgtctttccttatccggaactccctctatatccaaagtcagtttccgtataagacatggtatgtggtcagtcctgccgaaatttagtcgactactattaggtatgtggtatccataaccttgacagtagcccccgacttcaatgcaaatgaacaaattcatattctcaaccgccgaccctggagtaactgttatcgagctcacgtaaccgttctcggtgagttcagagataacgttagacttcccttatcagcctcgtgcgggcacctatagggtttgtctgagtcaatctccgatgtcagccaagaaagtacatagcatacgactaagtctcccgtcttgctgtaatcgagaatttggattgaagtcaagaaattttatctcgacgggtacaccatctcttcattccgtattccttgtcgatatccaccaaccgttctcgagtgatcgagaaggcgcagaatctgcgacggagccttgtcaacatttgtcgtactcgccttggttgatcttggcgtagaaccatagagacatggagtcttcgacagagtcgaatagaattttcctgaaatcaatactaagaaaagaatattagatagaaatagcccccgaacaaacgctcaaagggtgacatgttataatatgtatggaaaattgaaaatgaattaaatttacagaccaatgttttgtatattagcgtcttctcttttaccgacttcgattagtcagtttgttgagtcatacactctccctagcccccagccttgtcgtcggagaatcgttctcggaggataaggctcttggacccttgacctgccttggttgaaaaagcactgatcctagcccccagtcgtgaagttggaaaactcaatttccgattacacggcttggttaatacgcacggcgagaactcttacatgaccagatcttagatggccgtttgtctctacaggatccgacaaggccttatctgctctggacgtcctcagccgaagttcccttaggttcctcagaggccttgtcaggacggcgtaaagggacatgaggataggtttcaactctaggtgtcgtcgtggtaagagatctctgggtaaaacacttagcgatattgtgtacctgatatcaactttgttggagtagaggtagtgggagaatcgctacaccgctggtcgaggaccaggtagtagtcgtaactcgaccacttaaagtggcggtgcgagagattgctacggtatactggttcgagaaccagcgagtagaattatctctcgagcaccaatagaagttacggtgcgagagattgctacggtatactggttagagaaccagcgagtagaattatctctcgagcaccaatggaagttgcggtgcgagagagtgctacggtgtactggttcgagaaccagcgagtagaattatctctcgagcatcaatggaagttgcgatgcgagagattgctacgatttaccggttcgagaaccagcgagtagaattatctctcgagcaccaatggaagttgcggtgcgagagattgctacgatttactggttcgagaaccagcgagtagaattatctctcgaacaccaatggaagcgctagagttggtttattacatgggcatctcatgtagccaacatgactcacatctccaacttatagcatatccggatgtctgttcgcaatcatgtcgggtgatcaagccgacgacgttcgcaaggaattatccgttaacaatcttttctcgagtagcccagccatggccggtgctatgagataggtcgtcagtcttcgttggcaggttgggcgcgacgactctgcatttgtcgagatcgttctcaataatagggtgtactcgaccacaacctactcgagcgctcaattgtttctaaaaatattttctagaaggcaagacatataacagagaatatcaagtatgtactcaaaaaactgcatggatcttctagcattatcaggatataacgagcagatgtaaatatcagtcattatatacaccgtaaataagcatgatttatatagaagaaaatagagcgagcccccagcgttcaaccgtagtcgatttaacatcggggacactcgcgcaatagacattgtataaaaaacacgctctaggtaaacataataaattattgatctgacaatatctaaaaataggtacggtaaattgtatataaaatattgcgtacctttatagatatataccgaatatatctacgaaattagtagattaatttaaaatcaatcttactaattaccttcgttcgcatatttataaagatcagactatgcgaatatctgtttttcctcgtcatatataaaggtgtcttggttatatgactgatcaaagccattaattagcttcctgatcaggcgcacgtgtagaagcagcatcggtcttggcttccatgtgtagccggccggacatggcagttgatctcccttccgtcttgctgttgtacacgcgtccgaactagtcacgtgtgttttcagtattggatttggagaagatgccatgctcggtttgaattcgtaaggatgcccatcgatgcttgctccgtatcctccttctcgatgccggatcaatttgtgacgtcgcctccacggtcagagcaggtactccgattgatgaagtagattggattgttaatgatgatggttctgatcttgtcgggagacatacttcgatcgggttagatctccccttcagccaaagtcgccgagtagattattgttgaagaatccatcttttgaacccatctcatcgaaatcctaaagcaccaaaatccccctacctggcgcgccactatcgacgtttgatgtcgcgattccagtatttgcatagtatgaggatcgttggtactaggatatatgcgagactgaggtaaatgagatggggacgaggatttttatacaggttcgggcccctgaactgtcaggtaataaccctacatcctgttagccgaagccggtcgttgatcttattcatcataatcacaccagtacaatatttggggtagcctatctaactgttgtcgatatggcggtctgaagttctgactcatagtcgatgacagggtagtcttcctcctcgaatctgtgcccggcgagatcagagatagcgctttcgtctctcctgacagtatccggagaaaccgtaggggactaaccgtgcttatctctgaagtcgatatccgacgtcttgtcttggcgtatgttggcttgtatattgatcttgtgtcttgatctattattccgtgtatgttgattatctcatcttctcctagggggtcttgtatttatacctataggtgttcccttgtccaagtagaaataggaaaactaatatggatacaatccaagtagtacttgtcgtttccatgtagaactctagttatctttacttatccggaactccctccatatctaaagtcagtttcgatataagacatggtatgtggtgggtcctgtcgagatttagtcaactactattaggtatgtggtatctataaccctaacaaataacattaaataaacttcacccattgtaacgcaagagcttttttttccagtttgaattaaagatttgaacattcaacacgaaactatgaattgtgatgattcaaattcaatttaaatttttcttactttttcgtagtcgccatcagctccagaccaaaccccatcctaaaaatcctccaaatctcgcccatgtcgccgccgacgatgacgaccgccgccgccgccaccgccaccgccatggccgccggcgttctcccccgaccgcgcccgcacttcctccgccgcggcatcctcccctcgccggcctccccgctccccttcgcttcccgggtctcctccgctgcgcccctccgccaccgcctcccgccgccgcgcttctccctctccccgatccccaagaccctctcctcgccgtcgcacgtccccgtccgctccctcttcaccggcatcgtcgaggacgtcggcaccgtccgccgcatcggcccgccgcccgcgccgccctccggcggcggcggcgaggcccccggcgttgacctcgaggtggagacgagcaccctcctcgccgggacgcagctcggggacagcgtggccgtcgacggggcctgcctcaccgtcgcggccatcgacgcggcggcgtcgacgctcaccttcggcgtcgcgccggagacactccgccggacgtccctcggcggccggtccgccggcgacgccgtgaacctggagcgcgcgctcacgccggcgtcgcgcatggggggccacttcgtgcagggccacgtggacgggacgggggagatcgccgcgttccgggccgagggggactcgctctgggtcaccgtgcgcgcgccgccggagatcctgcggctgctggtgtccaagggcttcgtcgccgtcgacggcgcgagcctcaccgtggtgaacgtcgacgaggaaggcgggtggttcgacttcatgctggtgaggtacacccaggacaacatcgtgctgccgaacaagaaggttggggacaaggtgaacctcgaggccgacatactcggcaagtacgtcgagaagctcctcgccgggagattggaggcgatgtcgaaggtgtgaatttgccatttgttgagctggaagaagcactgctcttcattccttttcggtataaataaggcgcaatctaatgttcatcagtaatggcagattctgtatttctcctttctgtatatgttgattgagatgcatatttagttatttatgatcaattgatttcggtgacgctaccttattcatattgtttcatagtcattgaatactttttgcttgctgcggagtaaagtgcttggtgtgatggtgtcttatcttggttggattggtctagtagttcactggttctagttcatcctcgcgctacttaaaagttagtgtttgatcagtgccatgtcatttgtcatgtctgttaattgttcaagaggtagtagcctggttataactatctccaatttattggttccatgcaatgtcgtaattcttgaaagaactggtatcaattttaggtggtagtagcgtgattttctgctgccatatatgaacatttccaatttctggaatagatcgtgatgtagggtgtgttggtagttgtggtatctgtttgcgcagttgtatgtacggttatctgttcttgatgggcttggcatcttggggaaacaggccacactaatggaagtagaatcagcaaaccttcaccagattgatctacatgttaccttttcgttgtgtttttcctgtatatttgatactctgtaattgatatacccgtgctttgcattgtgcaggcaggaaagagaagggaatgaaagcggatcctgatccactgcttcctttgcggaatcgttctggagccaggagcaaggaagataaaaagagaggctcttttcagacttgcatagctccattgcatcgacgaaaaattataccaacagtgttcttgtaataacgcagcttgtaagttgtaagcttgcctttccattgcctctgttgaacgaagcggagacagttgaagagttccatatgataattcagagttataaagtttttgacattgtgtaaatttggtgttgcttctgctgctgctcgtgtaattctggtggctgcttagcttgttgctgaaggctgtgtttagttgaggggaaagtttggattttggttgaaattaaagatgatgtgactgaaaagttgtgtgtgtatgacatgttgatgtgatggaaaaggactgaagtttggatctaaacacagccgaagctttgctccagattttgtatggtggttactggctgaggaattccaggcaggttgttgtcctgatgctgttttatagagtagggtagagttaagtgagaacaattagtttagaaaatgatcagttgacagaaagcgcatctggtgtagtggtatcatagtaccctcccacggtactgaccggggttcgattccccggatgcgcatttgttttttattcttttcactctgtcttttttacttctctcatcatcaaaaacaaaatgcatcagtctgatgatcaaccatgttttttttgggggggtttctttttactcataaacgaaatggatcagtctgttgatcaaccttctcaccatcaaaaacaaaatgcatcagtccgatgatcaaccatgtttttttggggggtttctttttactcataaacgaaatggatcagtctgttgatcaaccaggcgttcgttttcatctctttctcttgttttttttttaatctctaaaacaagatgcatcattttgtagactttctgatgatcaatcaggtgtcgtttcttttcttttcaactccttaaacaaaagcaaagtgcgtcattctgataatctgatggtcaatcatatcagggtgaggattgaagaatgcatcgtctaaaaaaaacgtgaatgctatatcattctggccggttgtcaatcagggatgacttgtgaaagcattcgcaggctgcactgcactgctacagtcaaggcagctcactgaaggccgtgataaccgatttggtcgccataaattatgctaaggattaattatggtcagtctactaaccctaacataattataattacattattaggtccacggttcaccttcacgcttcgtgaactaatacatctccatctcttacactctcctactacctacctctatatatgtgctggatttggatacttccatttgtgccatacattttgtcatttcgacctgctccatggcaaccacatgcatgttctccaaactagtgatccctaacaactacaataatcggagttggcatcttgtaatttattttttggtatactaactgtgggtataaatttagttcgtaaacttaataaatgtgtgcattattcctaaaacttcgtatattttttttcgaggggacaggcagggagctcctgcaatttactatagaaaaagagagttgatccagtttataaggaaaaccggacccaaaaaccttacaactgcacagttaattaaaggaaaactggcgaaaacccggcattgacaaaactgaaccaaatgacaattgtccaacaaggaaaaaaactcctagaacgaatccttcaagaaggttacgctgacagaacggcgacaacgtccgatcctaacgaatccaaggttttcacccgaagagtttccttgaagtggagttgaaacgagggctccaaacgcaacgccttcaagaaggtgaacggcgtccgagggcgctgccgttagtagcaccagaagcggagcaaggttttcacctcggagaccctgtcaaccaaagcatccaaaacggaagcttccaaatgcctcctgcacaccgaagggtacctgcactatggacaccacctgcacaatgaccggattctgcaccacccttgaccccgactgagaacgcgccggatctagacctaaagcccaaatcggccgtcctcctttcaccaccatcgccagccacgggcgaggttggctgccggcgccgcacgctccaaacaccaccggacgtcgcgccaccgccggatccagacgcgccgccgccggatctgttcaccccaccgccgcccgtctccaaccccgccgccatcggccgctgccgccactaccgccgccatctccatccccgccaccgtcgcccatcgccgccccgccagatccggccgaagcggcgcgaatctggcggtttaccgccgccgcctctccggagagacccccggtctcctaagagtggcgcgagagaggagccccgccgccgccgtccttgtggccgcgcggctttgccggcggccactcgggcagcggcgaggcggaggagggaggtgggggagagagaaggggtggccgagtcgtcgcctcccgtgccgcccctgggggaggacgacgcgagggaaggttgtcccctcaagtatcacacacttaaaaacttcgtatatgagtgcaatttagtccaagaagttaataaataaacatataggtgcaacaacttataagatgggtaagattttgtacaaacttaagaagtgatataacaacttacttagtttgggcatattttttctatacatgttcggtttttgaatagttgttttgtggatatacatgtgcatatttgtataagcttactcaaattttatcattctagtaaataaaacaattagattttactatgtagaaatttttgtatttcggttgagatttgagaatgtgaagcaaatcagtggtgcaaattatatgatcaatgtaattcttatggattaatttagattgtgaggcaatatctactggattagcatgtgatggcaaattgacattattgaaaaaaaaaactcagctaacactcattaaccaaagagcaaagttattacactcacttgccaagttgctagaacaaaaaaaaataaaaacctaagttgtcaagtggtacatactcacttgtcaagttattacactcgaatgttcaattataagtgttatataatgaatacaatttactcttattttaggagaacaaaaatacgagaccgactgtctctgcaccatctgaaatacacacaaccatatttcgtgaattaacacctaatctcgatctattgtacataacctaaatatacacacacttatatatttatagacacgatttgaatcctggtgagagtgatggaggccaaacacagacgcgcacgcaacttaatttaccattacactaatggtacttattgtgcaactaattgacagtggattaattttagaaaacgagtttaatctcaactttgttaactacttcctttgattcaaatcattttagcattttacatattaatataaaatggtagaatgacttacatcgtataacggaagggtacaaactaatatatataggtacatgcgtatacgtacactcatcacctggacctggtaggtagattaattaggcctggtcgtagtagtctgatatatatataggcgtgtgtgcgtgtcatgttgccatgtacacacgttaattagtacgttacgtagacatgcaaagcacacgttaattagctagctccttggctactagtaatgatcaggtcaaagcttagtcattagtataaattctgaactaacctatgggcgcacacatacgggaaacggtacgattggccgtgtcctgcatggtggtcaacgtaggcacatatatgctcagagaccttgcctggccttccaaaatatcaagtcgtcagaagctattctaaacggtttagattgtaagttagattatgagaatatccagtatataatatggaaaataaattaaaagttagaagttgaaaaactcagtttttctagctagattctcacaagttagggcccttccattctataggaaaatttcctatgaaaacctttcaaacaaagaattaaatcctatgttatcctttcaaattcctatgtaatggataatcctatagagattttaaagaaaatttagcaagaactctaacctattggaaatttccatttgattctatctctctcatctgattcatggttttttttctacggtccaattaatcggttattcatgtgtttttctgtattttgcaatcatctgttttacaagtacattcctattagaattctacgttttaactattcctccgtttttacattcctactattcaaaagggccctaacattttaccatctgattctcataagatccctcaattatggcttttggctctttccaccttccgtgtgggtgttagtactatatatgacatttatataggttttatggtattttatagaaattattttaattataatatagtcgatagagaagtcacaaattaatatatactgctataattctcgtactctgaaggagaggacgagttagcacaagcaaccttcttaggcaatatttccatacacaaagaacatgccaattatattgttcctagctaagtggatagtggatacaatatgccttatttattagaaaagaagtcgttagagcgatacaatagcagattattagccagctgtaaacatattttaatgagataaaacatgagagagaagagcagcgggctacagatctgtagccagctgcagcgcggactccaagaagcaatatgtatataacaggtgaaaccatatattaatagtatatgacggagcgtggggctcctcaccgggagactgcgcgggcccccctttgccggttcggccgggggcgctgagtgaggctctaagcccttgatctgtggaatgtttcgcgagaaaggaaacgcacaagacacgggcgatgtatacaggttcgggccgctgagaagcgtaataccctactcctgtgttctggtggatctgagtgtgaaggaattacagagagcagaagagctagagagcttaggtgttctctcagttgtcttcctccttttttctttttttcttccccttttttcgtcctttcttttcccccctctcttttcgtcctttcttttcccccctctcttttttcctttttggtgggcaaggtcctccttttataactcaaggggatcccacatgctccacttctacctacttttcttttgggtggagacccactctatcttcaccaaaactcgactcaccttctcttggaagctaaaacacagcttgttcttcagtgtggccaggcgtgctcactcgtctactctcggagatcaccctgtcatcccttcataaatgggcggagatttgcaatggctgctgtccgaatgaccctccgatgggatgggtcatacctacctccactccgctggaaggaggtgcaaaacgggagcgcggttgtccgcctatgacatgacaggcgtcagaccagtcacagaccggtcactctcgtccaccacgcgtcagtttagcaagctgcatgtctgcccttcttcatacaaagacttccttgcaatggttgggatgaagcctggcatatatctgaccgggaccgacgtgccatcttcaggagctggcacgccgtctccggctagggacaagtgcctggaggctctcatcaatccgacgggacggggcgaggcgtgtaacaggccacctgccaccacctaacccgcgatctgaccggtctgtgaccggtcacacgcgcgcccggtcacggaccggataagcgagcgcgctgcgctgcattacatgcgacgtgacgcgctcgttcaacccgcaataaatgcggttaggtgagccccgctgtgctcacctaacccatatacgtggcgccaaacccacagggggtcggggcgccccggccctcggggccgaaacgggagcggtccgacccctcggggagacaaaaggaggggcggccacatcaccctcgggcccgacccccccccccccccccccgagggggtcaggccacgtgggtgatcgcggctgcccaagcctctagtcatgatactcccggtcccatgtcaccgacagtatagtaagcaactattgtatgaattggctattgtattgactatatatgaattggagctagtagtgagctatactattaaacttgctcttatggtggtggagttgaaaaatatttatcgaggatcagggtttacacttccattttccaccaaaattttgggctcacttaaaaaagagtaaattacaccaggggtccttaaacttgtaagcatgttttacatatgtccatgaatttggaaaacgtgcgtcaatgtctttaaacttggtttattgtatcatcacggtccaaaatctcgttcgaccgtggacttacctacgtgacatgctacgtagtcaaatgaggctttaaaccgagatgatataataaatcaagtttaagaaccttgatgcgcactatgcaagatatcgcgaatttaggtgaaacctccctgtaagtttacggagcgctagtgtaatttactctttaaaaaacatcttccgtacatagatactacgtttaagtactaaacatttcctttggtttcaagagtttgatttctccctgattggttgaccatgtataaaacgtgtatgcaacaagacaacgagtatagtacaatgaagacagagcgacgaccgagatgaggaatttcctccggtttttgatcttttcatcaggactgtggaatgcacacgaccgttgccaaaataatggccatgacagctcgtgcttaattaacaagtaatctcaaaaaatttggtcagcgttctctctcgctcgcaacgaatccaaaatccaaagttatgatcgacgacccaaatccaatcaagcaaagtggatcctagttggtagaaaaaagaaggaatttaattggggcatcaagtttttttttgagttcaagaaatagattttgatgagtatatgtttccatggaatttatgtaatattatttttactatctttgaatagaagtttcacatgaaattggtgtgacattattttaccgttctcgaggcgaggataccaaaataacatgatataaacctctgtttcacatgtcataagtatctatttggctaaactgttaactgtgcattataatcagaagtggatttttaattttaactttagaaataattttaggtatttatttgtctatttggttgccggcatgatttttgctagctaggggacaagtaaaagaaatccttaaaaattttcttacaactcaaaagttaaaattttttcattgtgaatgtagaagctggattttaatccattttctaaaaaaaattatatcattttacctacagtataatttaagataaatgagctgtttaatttactcgtgtgggtaggagatagagagaacattgtcattagtaatcactgatttacagattagtcactcatctgctgacacaagaatgtagacaccgttgatgttggaacatggaaatcactgcattcatacgcatcaacacaactatataaaagctacagaaacattgtttttgcatttcgaggtaatagataactctagcccccattacttttgagtgccgaccaacacagttttcaatttggctaaatatctttcacaaaatgccaatgaaattgtcataaagatgatccaaacaaagccatgttaggtaccacaaccttttgttccgtacttcttcataccacacaaaaacaaaaaaaaagataaagtcacaaccatttcaacaaaaattccaacaatgtcccaatgacaagtgggcccacaacctgaaccggctgacacggtcccacatttcagtgacagatatgaacaccctgtgaaccatgtggacggtctcttgcacacacaggagaatattttgttgtgcaggggagatgaacatggacaacctatgatgatcagttgatcacctatgatttgttgaaaacaatgagcagaggaaaacaatgctggtttggtagacattctcagggttgatggagctcaaaaactggtgacagcggctagtggtttttcacagctcctgttctttgtttaactaacaaacagctgcatgttcatatgtttgtgcctaagaactttcttaagcgtgtcccaacaaccccttttggtgagagcaatggctcaacaaccttagccactttgtggattttttttcttttgttccatgatgattaggaactgcatgcaggggacttgttttaacggtgctaatcttttgtttggttcgttgttgtgatgtatccatgcagataagagataattcagttggcctaactactttactgatgagcacatggttttttcatcaaaagtttgtctggatttttaatattgatgacagtatgctataaaaattactaaaacatggtgaaaaaaagtacatttgtctcattggtgatagaaataaatatagcacattaattggtaaaaaaaacataaatatgtagtttaggcctttagggtgcatttcgactataacaatttatttcgcattttgcctggatatagtaaatgagggtgacaattttttaataaatgaacttatgaacacaaccacaaaaattaggctaataagtccacaaaccttaagaaaattatcaatatttttttaaaagtttatgtaagtaatacattagtggtaccattaaagagtttacgagttagaactattaagactttcatcccatggaccacaccaatctatctagtttagtgctcatttgtcatctcccacattgaacatctcataattaatcttctcctaactccaaaccagccagccagccagagaacaagtacacaaaagaattaagtatcctaggagataaataccatgtcacattgtcactcaaaagcccatgaaacaatcatgtgctaaaaaaccaggctaagtcatgcatgtgtccatgtagcagagaggataagactagagagcagccaggccacattataatagagggcaacaaaaaaaacaaaaaaaatccagcagctagcttcactggttttgaaggcttccctaactagatgctggatttgctgctgcatgggcggcgccccctgtattggccacctcaccacctccatggattgcagctgtcctctctaccttaaccctttgaccagtgcttgtttgtgtgtagcactagtagacaaagcaccatccatgacttgaaaagaaaattcaccaaattggttgcaagtattggttgatggctcttatctatctagtaagtagaactagtagaggagataatttgcagatgttttgctttcttttcttgtcctcaccgaatcctactaacctcctctttgtggtaggcatgtgcataagtgtcaagtgtctatatatattcttctgcacattctttgctccctgcccatagatacacatttcctcttcttcttcttcttgttcttgttcttgtgtcctgactgttcttgataaagctcagatttgggaattggaccacatcataacattctttggcagagtttgtgaaggtacatttggagtttggattaatttcaggtggttagctgttcttgatcgttcttcttgttgttggttgctggaagattcgaagattttttttgtgtgtgtgtgtaaattgtggtgttcttgtttggcattgttgctcagttagttgatcatggcgagccgggaggagagcggcaatggcggtggcggtggcgcgacgccggcggcggattaccggagctcggacagccggagctcgagccggcggagcacgcggttcaaggaggacaacgagtacgtggagatcacgctcgacgtcaagggcgacgacacggtcgccatccagagcatccgcaacggcgccgacatgcccgaggtcgccctcctcgcgcgcggcctcgcgcagcagccgccgccgtccgcggcgcccggccccggcgggctctcgtcgcggctcaaggcggtgaggaccgagctgaggcggatcgcgtcgtggaagttccccagcggcgttctcagcggcggcggcggcggcggcgacgcgccgggcaacggcaacgaccgccgccctcgcctcgaccggagcatgaccggcgccgcccgcgcgctgcgcgggctccagttcctcaactccagcgccgtcaccaatggctggccggaggtggagaagaggttcgagcgcctcgccgtcgacggcttcctcctccgctcccgcttcggccagtgcatcggtcagctcaagctcaagctcacctctgaaaattcctctaaatttctgatgaattcgaactgaaaccgactgaattttctcgccaaatcgtgttccaggaatggttggatccgaggagtttgcggttcagatcttcgactcgcttgcgcggcggcgagggatcacggctcagttgctgaccaaggatcagctccgggagttttgggagcagctctctgatccaggatttgatgccaagctgcagactttctttgacatgtatgtgttcagttctatcaaaaattcaagtttacattcagtcttgaagtagtagaattttagtcgttcaaatattgttagttgcacatgttttgtcttgtaatagtgaaatttgccactgaaccttttgattagtatgcacatagattcagttatgacttttggaaagggactctgaagtttgttgactgacatctgagtgctgaatttcttgcagggttgacaagaatgcagatggtcagatcactgaagaggagctcaaagaggtaagaaactggatcaaagcaacacaaaaaaaaaattaagcataatttttccatgtaatttgaagcagattgaggattctgaatttttcttgcatttttcaggtcctcaccctgactgcctctgcaaacaagctgtccaagatcctggagcgcgtcgacgagtacaccgcgctgatcatggaggagctcgatcccgatcaattaggctacatagatgtacatactctcaccctcaaatcctccacatatttgaaaaaatatatatatctgaatttgacattgttaagaacaagaatctatgcaattctgaatctgaaattgttcagagtactagagtagcagtatctgcaattctgaattctgacactgttcatggtcacctcccatttccaaagatatcaaacctggagtcgctgctgctgctgccgccgtcgcaggcgccgtcgaagctggtgacgcacagctccaacatcagccagctgatcagccagaagctggtgccgacgcacgaccggaacccgctccggcgggggctccggcggctgtcctacttcatggaggacaactggaagcgggtgtgggtgatggcgctgtggctggccatcaacgccggcctcttcacctggaagttcatggcgtacaagcgccacccgacgttcgacgtcatgggctactgcgtctgcgtcgccaagggcggtgccgagaccaccaagttcaacatggccctcatcctcctccccgtttgccggaacaccatcacctggctccgttctcgcaccaagctcggcgccgtcatccccttcaatgacaacatcaacttccacaaggtaacactctttcacacaagtatttttacggtgatctctactgttagtagaatatgtaccgctactagtattatcaccagtagaagcgatctaaatcattgatttataaattctactggtagaaacaatatcgtaccatcgatagttaaggttgtactataaatagacattgtccatttgacgagggagaaaaacaaaataaaaggttcagatttatcctattacaatattaccggtagagaacatcgtaaaaactcagtaaggtcattattgacagttgtcttctccggtgacggcaggtggtggcagggggagtggtggtaggggtggcgctgcacggggtgactcacctgacgtgcgacttcccgaggctgctgcacgcgagtgatgcggcgtacgagccgatgaagaagtacttcgggcagacacggatcccggactactggtggttcgtgcgcggcgtagaggggatcaccggcgtgatcatggtggtgctcatggccatcgcctacacgctggcgcacccgtggttccgccggagcaagcttagtgacagcaacccgctgaagcggctcagcggtttcaatatgttttggtactcccaccacctcttcgtcatcgtctacatcgccttcgttgtccatggcgtctgcctctacatcaaccggacttggtggaagcagacggtgagtgagccagcttctggtcgatttgcgcccgtcgggttctttgtggtctgaattctaaaaaatgttgctaacttttgtgtgatttttcagacatggatgtaccttgccatccctatcctgctctacgccggtgagcggattttccgggctctgaggtctcatggcttcaccaccgtaaggattgagaaggtaacccaactcttttttgtttaacatcaaaaagaaaattagttctgtagcactgaaagtttatgggaaaaaaaactttattagcacagaaagatctttctgttcactttgacacgacaatttctttccctgcaaatgtatactgatatggtactgaattctgttcaaggaaattgaattaaaatggggtaaatttgaaacgtgcaggttgcaatctatcctggcaacgtgatagccatccacatgaccaagccccatgggttcaagtacaagagtggccagtacatctatgttaactgcggcgaggtctcgccattcgagtggtaaatcctcaaattcctcaaaattctccggtcgcggcacgcgaaccaatactggttttcacctgacgattgttcacaactgatcatgccaatgcttgtgtcatgacaggcacccgttcaccatcacctcggctcccgacgacagctatctcagcatgcatatccggtgccgcggtgactggacctcgagcttcagggccatcttctctcaggcaagctgatcgccgagccaccatggcgaatcggggaaaatttcgggtgctctgctttgtgaaaatttgtggatgatgatggctaacaatgtggtgttcttggttgcagatatgcaggcctccgatgaacggccagagcggcctcctccgggctgactgcatgtccatggagcaccattcaaggtgcgctttttttccccggaattttgaacaaatttttagtttttgagatgaattcgctccaatgatttgttcttttgaaaaaaagggagtaaaatttaaaaacctacaactattttttgtcaaaattaccaatttgctgcaatttcaaaattcagaaaacaacaacattttttttgtcaaattagatatttgccacaatttcagcttggccaattcaagaggacaacaacaataatgcacgactttacctgtaagccggccctttcaaaaatgattttgtcagagagctacaataatacctaaagtcgcccgaataattgctgctttacgaaatttactccaaaaaaaatcattctgattccattttgacatttgacatttcaaaaacgattttatcataaagctacaataatacctaaacttattcaaataattgcaattttttttgggtgaaatttgctcgaaatatgaactcaaattttggcatcttgtgcaggttccccaagctcctgatcgacgggccgtacggcgcgccggcgcaggactactggaagtacgacgtcctcctcctcatcggcctaggcatcggcgccacccctctcatcagcatcgtcaaggacgtcctcaaccacatctacgacgaccccgagtccgccgcctcgccgcacaccaccaatggcggcggcgccgcggccgcggcgaggagggcgttcatgacgaagcgcgtctacttctactggtgcacgcgggaggagggctcgttcgagtggttccgcggcgtgatgaacgaggtggccgaccgcgacgccgggcgcgagttgatcgagctccacaaccactgcaccagcgtgtacgaggagggggacgcgcggtcggcgctggtgacgatgctccaggcgctccaccacgccaagaacggcgtggacgtggtgtccgggacgcgggtgcgcacccacttcgcgcgcccgagctggcgcgacgtgttcaagcgcgtcgccgtgaaccaccaggggcagcgcgtcggcgtcttcttctgcggcgaccaggcgctcacgccggagctccgccgcctcgcccaggacttctcccacaagaccaccaccaaattcgtcttccacaaggagaatttctagatcatcggattcatcgtcgtcagctgcctctccggcggataattgagttctttcatcctctgagcgagctcagattaagtgtacaattatatacagattaatggtgagagataggactacatattttagtgagtgattggttgttcgttcgtttgtttttttttctccttctgtgtaggtagaagaatggtagggggagtgatgattaagttagttgatgttttttttgtttcacaagtttgtacaaaattaccagaaaacgatgatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32010 - DNA, 1716 bp, Oryza sativa
  unsure (1)..(1716): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgttcgagagatgattctactcgctcgctggttctcgaaccagtgcgtagcaatctcccccaccgcaagcttccattgatgttcgagagatgattctactcactcgctggtcctcgaaccagtacgcagcaatctctcgcaccgcaacctcaaatggaggaggtacgactacagcaataacacagcggtcctcgcaccacgacttcaaatgatcgagataaacttactcactggttctcaaccagtcaatcgtagcaatctctcgtacatttacttctagtggttgagttacgactactacctggctcttgaccagaggtgtagcgattctcccattacctctacttcaacaaagttgatatcaggtacacgatatcgccaagtgttttacccagagatcccttaccacaaaagacacctagcgttgaaacctatcctaatgttcctttacgccgtcttgacaaagcctttgaggaacctaagggaacttcggctgggaacgcccagagcggataaggctttgtcggatccttcagagacgaaagaccatgtaagatctggtcgtgtaagagttctcgccgtgcgtattaaccaagccgtgtaatcggaaatcgggtttttcaacttcaaggctaggggctaggatcagtgcttgttcaactaaggcaggtcaaaggtccaagagccttatcctccaagaacaattctccgacaaaaaggctaggggctagggagagtatataactcaacaaaccgactgatcgtagtcggtaaaagagtagacgctcatatacaaaacattggcctgtaagtttaattcattttctgttttccatacatattataacatgtcacccttagagcgttcgctcgggggctatttctatctaatattcttttctgagtattgatttcaggaaaattctattcgacattgtcaaagacttcatgtctctatggttctacaccaagatcgactaaggcaagtacgacaaatgttgacaaggctccgtcgcagactctacgcctactcgattactcgagaacggttgatggatctcgacaaggaatacggaatgaagagatggtgtacccgccgagataaaatttcttgacttcaatccaaattcccgattacagcaagacgggagacttagtcgtatgctctgtactttcttggttgacatcgaagattgactcagagaaaccctttaggtgcccgcacgaggctgataaaggaagtctaacgttatctccgaactcatcaagaacagtcacgagagctcgacaacagttcctacaagatctgcggttgagaatatgaacttgctcatttgcattgaagtcgggggctactgtcagggttatggataccatatacctaatagtagttgactaaatatgggcaggacccaccacataccatgtcctatatggaaacaacctgcggatataggaggagttccggat

SEQ ID NO: 32011 - DNA, 322 bp, Oryza sativa
acagtcaaatttgagttaattttttgtggaaaaaaaggaaaccaatattaattaaattcagagagggctaaaaacattcccttcatatttttggaatggcatgttgggctgatgcgggaggcctgatgggctctttccatgaattggaaggtagtccgcgcattcgcgcgggcatgtattataggttgtttttcaaacacggtaaggatcttccgttttgttttcagccgtgtatgtatagaagaacagtagtacgtttgtatcgtataaactcatatttacggcagaacagtgtagcactggtatgatatataaacatgag

SEQ ID NO: 32012 - DNA, 1051 bp, Oryza sativa
atatggtagtttagacatggtgtctacattacgggatatcattatttggggttatatatgccggtgagaggtgggccgctgatgatgacagctcagtatgggtattcctccgtatttagcaccggttatatggtcatgacgggctgtcgtaaggaactcggcagttaggggtggcttctcgaagtaccagtagggcatcggatagagggtattagctagtatatcaggttaactagtgtatgtatactatgtatattagaagtataggaatatattttctttctcttttctttccacttagcttagatgatatattatgagaatgagtagttaatgcttgtgtgtcactctaccattggattatcttaacccctgtttagaatatgattatcacaagtaatatataaattattagtcaatgttctctctacatgatcttcccacaggataaaataaatacgatacccttggaatactctcgggtgaaatgttacaatggtatatccgtgcgcttgtggatgaactctgtagccataatataccagaagtatttatgcgccattgctgggaattatatatattctattgcccattatctaaaaatatattatattgcctatttaataaaacatggttttagtaaaactatagattcaaagggtctattaaacctcaggtcttctgttcttcccaaacaaaaactacatttttcaatattccatggtataaaacgtacatgctattaactaattcctccccctcttataaattcattttttaaatcctttatactcgatatctctaatccaattagatacatatggattgtattttattatggggtcaaacgaggaagcgattatattttttatttgcattagtggcagtccgccccttacatttttggatgggatgtagggaatggagggagtacggatcttttgtatatattgcttaatgtttgactagttattgccaggacgttataacttcagaaatcattttccacttttcacatcaattgaaaatatctactacaacctaaaatttt

SEQ ID NO: 32013 - DNA, 811 bp, Oryza sativa
ccgcgcctcctggttctacatgcgtgcacatgccacttttctaatagcttgtgcacaacacttgaaatttagaccattaaacacttttaaaaagttgtttttaaaaacattttgccccctagaattttcaacagctctaccttacggccattgagattggtcatatgatgagatctgatgtcatgtacattggacctgagaaacttgtcgagatagcacactctcgaggtcggaggggtttggtgccaacaccttagttttgagtttaatgttttttgcttctattatttttttctcttcttttgatggtaagcactattaaaaacatgtagtccgtacaatgcaccaaataaaatatatatatatatatatatatatattaattagccactcacagaatatgttgttcagttacaaaaataagaaaagaaaacatgggcaactttgaagaaaagacaaactcatttccgtggctgggaattgatcgagcctggctcgataggttgacattatcacatgagtgctcttctaagtaccaggttgtttctacgcaattgtctaactggtacatgaggtcagcccagatgacctgcagtttatgccaacacagcaagtttctctgttccaatgtacgtggaactaagatgttgaatcacagagttcaacctcgatagggctgaggctgaggctgaggtttattgtcaaatgatcaaaatttcagacataactaggtcacaaatacttatccttctaaaaaaccaaacctcaactatccccacttaaacgactcgtgaccaacgactattcttct

SEQ ID NO: 32014 - DNA, 9003 bp, Oryza sativa
atatatatatatagacacacacacgtatgtatgcaaatgcatatgtacatgtacaaaatagacacacacacacaaacacacacacacacatatatatagatatatatatattaaagcacttaacattttatgtgcatatatgacctatatatatatttacactaaagtaaatgtgtacatatagaaaaatagacatgtattaactacaattcattatgtcctagctaactacgacttcgatgtagaagtcgttagctcagaagctaacgacttatgaattgtatttccatcgtagtagaattcaccctcgggatcaaggacttgttcgttgatgaatcctatgagttgttcttgaaccgccgcgataaattccttgtgtgtgaggttatccctcgtgcgaataacctatgaatgtatgaaattaattagtaaacaacaaatcgatacgtacgcaatgaaattttgaatttatttgtacgtacatcgagctctcttgtgggtgatgatttgggttgtaaggcagtggcaatactcgcatacatagtagccgcacaagttagttccctggtcttgctttgtacagtatatatacatcacaaacggcgagagatttaattaatatacacttatatttgagttggagattcaatataaatgtagagcatgtactcacagcaaatttaaacttccgcctaagtttttctttccaattgccgcagaccaaatgacagaactgataccaagccctacatggagtttaaagctatgattcgtagtagcaattaatagcaaaaatcgtaataacattggaacttatgacattacctgtctataagttcaaaaaccttgtcaaaagtagactcttttttatccattgagtcatagacattgactatgcaggcctccaagtcgaagagtaaaaggacccagtggaatctgcaatgtgcgtcgggtgcatgacatatgaaacacttagcatgtatgtacgggaatgaaattttttaggaagacagtaaaaactaactctgtgttgtacagcaatagtgtgaatgtcttgtaatgttgctccttcaggagatggatgagattgtcctctgtggcttgcggatatttgtcgatcatttcgacgtttactttccgagggtcgatgaatccactatcgaaaaccccccgccgtcgggccctttgaatctccattctacaatgataaaaggaattattatatatggtgtacttatatacaaggacctaattaattaaaggaaacgtaataagaaatctaaccaaacgatacttacaaaatccaacaactcagaagagagacgtcgagggcgtccagctggtatagttcgtagatacccttgaaattgatccggataatatcttctccttgcaagaagtccatgtgcctgatcctcgctccgatcatctctctaccggtggcgctcatttccatgtatagttgatggaatttgtacatctgtgtcggtagggactgcagctgctcaggcttgacaagcggtttaccgagttcgtactggtgtctcacttctgcctttgggattggtgcacctcgtagcaattgagccctagttagcccggtgtcagaaataaattcttttattccaatttcttcctcggtcaccaacggctcgacctcctggtttggttgctccccaagctgagggactggtttggactttctataatatgctttcttaagtgttcgctcatagtccgttagctttatggccttcttggctggtgcaaatatacccctgaagaagttcctggcactcgggtctataggaatcttcttttctggactccgaggcttcaattgcctcttcacttatgctgccacataagcgtcaagctcctcttgcgtgcaatcgtacggcggcggcttgttttctgcggtgtcaactttcgtcttctcgctgcccttgtgtgggcaggcggtggagcttggtgagaccttgacttggaaggtgccggacgaggagcttgaggaggagtcggcgcaggagcctgtggaggagtcaatgcagaagcttgagtaggaggagcctgaggaggagtcggtgtaggagcctgaggaggagatggtggagccggaggagatggtgcacgagatgccgcttgtcacccaaggaggatgatgtacctcttgcgccatagtataatggcgtggtttgtctctcgtagatgcgtctcaccgtctcctccagggtagtccaactcgaggtcctcgtacgcggcttccaccagctcaacttcgaccctcgagtatcctgctggaatcgacctgcagtggtaagtccctgaagggtccgttgggatggccattcccgacgccaccttcacgtgataagaggttatctattagtaatcaacctaagcagcaacttgcgaaatgtacaagtcaaaaatcataaaacaacgagcataccttgattgataagttcttgaagggaatatgcagctcacatggtgtccgctgcgtgatctcatcaacggggcatgtggtttcgtcctgagtttgcatggcgtccatgctctgtgatcctacctgccccgttgaggcgcagctgctacgattgcttgatgggctgaccattgtaggaggaatgtacggctagggatcctaggaccgatgtgcgttcatgtgttcatccaccttccttgccacctcctcttgcatgctgagctcgttgctcgatgccctatactcaagatctgcaatcttcacctcggtatctctcttgctcctcatcgaactcctgtacgtgtggatgtcctccttgaatccaatcttccaaggaaccacgcctttccctcgtgttcgtgctggatgctcgggagtctgcagagcgagtgacagctcgtccttctctctgtcgggttggaacgtgccctgagaaaaggcttccactgcgtccattagtcgactggcagcctcgcgtatctgatcgctgaagaccagggagccatcaactgggttaagtgttccaccgtgagcatagtaccagaacttcgatcgatctggccatttagcggtggccggttcgatacccctctcaatcaagcttgcctccatctcctcccacttcggcattgcgacgctatagccgcctgaccccaagtggtgatggtacttcttcttggcagcattttctttgtttctgtccatcatctcttgcccttgttgccctgtcttgtaagcaacgaactcgtcccagtgatcccttagcttcggtaatgtgttgaagttcagtgtctgccccttcaggatgtatttctggcagagatctcccttgaagctctgaaactgttctgccattttctttagagtccacattttcactatgttctctgtacccacaggaagggtgaacgtctcgagcattgtggtccacagcatctctttctccgaatcagggacaaatctgtcatgatctccgcgtgcccttctcctgcgccagtacaccgtactgacatgcacgttatccctcacaacccagtcgctgtgtcgtacgtaattcttggctgcttctgccggggcactaggtcggccgtcttcgtccacttcagttatgatgtgttgaccctctatcttcttcgcggcacctcgttgtccgcatgccctcttctgtacagcggagggttgacttccactagcctcctcctcctcgttcccctccgcatccctctctacgttcccctcctcgttcaagtacttgtttggatcctcgttcgactcttcttcgttccagtactggctgcttccctctgcgattgtatcgtatagtatctgttcgtcatcgcgatcagccatctgttcatacaagaaatatttgctaagtctataggtcatttttgctaagtgtaatattcatatgttaatactctaaaaatattatattagaactcaaataatcatatatgctaagtctaattaagtttcttatattacaactctaataatattaaatgctaagtctaataatcataaatgctaagtctaataatcacatatgctaagtctaataatctaataatcttatgttaaaactctaatggtcgtatattaaaactctaacaatcatatatgctaagtctaagtgtcgtatattggaactcaaataatcatatatgctaagtctaagtgtcgtatattagaactcaaataatcatatatgctaagtctaattaagtttcgtatattaaaactctaataatcgtatgttaaaactctaataatcttaaatgctaagtctaacactcacatatgctaagtctaataatctaataatcttatattaaaaatctaataatcttatcttaaaactctaacaatcatatatgctaagtctaagtgtcgtatattagaactctagataatcatatatgctaagtctaggtttcgtatattaaaactataataattgtatattaaaactttaacaatcatatatgctaagtctaactgtcgtatattagaactcaaataatcatatatgctaagtctaagtgtcgtatattagaactcaaataatcatatatgctaagtctaattaagtttcgtatattaaaactctaataatcttatattaaaactctaataatcttatattaaaactgtaataatcatatatgctaagtctaacactcacatatgctaagtctaataatctaataatcttatattaaaactctaatagtcataaatgctaagtctaacactcacatatgctaagtctaataatctaataatcttatattaaaaatctaataatcttatattaaaactctaacaatcatatatgctaagtctaagtgtcgtatattagaactctagataatcatatatgctaagtctaggtttcgtatattaaaactctaataatcttatattaaaactctaacaatcaaatatatgctaagtctaagtttcgtatattagcattctcgataatcatatctttacatcacttgcctgcccaaattccttcgagggctagctaccacttctgcttgagggacgacgacgacttcttttttgcaacatgcaaaaaaatgtattagtctaaacgcaaaggaacatatattttatgttcatgttttcaaatatataatcatatatatatgctaagtctaataatcgtttaattatctcgttcgtactcgtttcgttcgcgttcgttcacacgtttcgttcacgtgccttcacgtttcgttcgcgttcgttcacgtttcattcacgttcgttcacgttaagttcacgtttgttcacgttcgttcgcgttcgttcacgttcattcgcgttcggcattgacggggcggtagcggaacggcggggctgtggcgcggcggcgtggcgaggcgggggcggtggcgtggcagtggcgtcggcgtcgttggcagtggcggccgcatcgcggggtcggcaacgacgggccgggccgggtcagcgttacgtcgtcggcaatggcagccgcgtcgacgtcgggatcggcatcggaaggaggcggagtcggggtcgggttcggcgtggcgctacggcgttggcaggcatcgcaacaacgacggtgatgaggcggtggcagtttggagagagagagagatcgagagagagagagatagcaggcggcggtggcggctctcaccccagagatgcggcggcggcggcgacgacgatgatgacagcgagacgacggcggcgtcggcgcgggggatgccctaggtagtggcggcgaaggagaagccgagatcggagaaaaacttctaagtgttggtggagaagatgagggcgcaacgggaatatatataccccgagatctttagtcccgattgatgagaaaaaccgggactaaagattttttcccgctattttcaaattcttttttaactcggttagggttaagaaccgggactaaagataacagcactacatattaaatttcattacatatgggtttctaaaaaagtaaataatgcattaaaatgatttaaagtcacaaaattaatgacaaaaacttcaaaatatattgttgtctatagtaaatgaagtggataatatataataagcacatgaatgatttaaaattgttaaaagttctaataattaatcatatataattagcatatgcatgatttaaaattgttaaaaattttaattatcatatgtaaataccacatgcatggtttaaaattattaaaaattctaataatcatatataactagcatatgcatgatttaaaattgttaaaaattttaataatcatatgtaaacaccacatgaatgatttaaaattgttaaaaattctaataatcatctataataagcatatgcatgatttaaaacttttaaaaattctaattatcatatataactagcatatgcatgatttaaatttgttaaaaattctaataatcatacataattaacatatgccatacaacaattgatttatatggatattcaatacatccaaaatagtttatatcgtgtacacaacaattacggcaatacatcagcggtgacggttgaccgcacgtactttctcctcactagtgttccttccttgtgatcgctacgtgagtaaggggtgtctttatttgataggaggatgctagggtgaatcatcgccgtgaaagggggttgctcatcaaactgatcataatcctcgtcagtcttgtcctctactccgacgatttttcttttgcgtgggagaaccacgtggcgctttggctcgttaggccctttgcccttcttccctttgctagacatgtccttcacgtaaaaaacttgcgttacaacattggcaaggacaaaaggttcgtccgagtatccaaccttgttaaagtcaaccgttgtcatcccactgtcatcaatcattacgcctccaccagtcaacctaacccattggcaccggaacagagggaccttgagaggtccatagtcaagttcccatatgtcctcgatggcaccgtaatacgtgccagtggtaccatcgtgtcccacggcatcgatacaaacagcactgttctggttcgtgctcttaatgtcttgggctctcgtgtagaatgtgtacccattgatctcatatccctggaatgtcgcgatcgagccagatggtcccctcgccaggaaggccagttgttggttaatcgtctttttacccatgagatgttgtcacagccacgcggggaaagtatcaatgtgatgccgtgtaatccatgcatcggacttaccgatgtttctggcacgaactagagccaagtgctcctcaatgtaaggagccaccaatgaagattgttgcagaaccgtgaaatgggctttacggaataaattgttgtctaccatcattattgctttccttccgagagtcccctttccctgtagtctcccttcatggtgtgattcaggtaccccgattgggcgaaggtcttcaataaattctacgcagaattcaatgacctcgtctgttccataccccttggctatgcttgcctctggactagcacggttacgaacatacttcttcagaacacccatgtacctctcgaaaggaaacatgttgcgtaggtacacaggcccgagaataccgatctctttgacaaggtgacaaagcagatgcgtcattatattgaaaaattaaggtggaaatatcaactcaaaactgacaagacattgcactacatcattttgaagggcttctaatctatccagattgatgaccttctgcgaaattgcgttcattaaagcacatagctttgttattgttgcccggacattgtttggaaggataccccttattataactggtagcagttgtgtcatcaacacgtgatagtcaagagactttaggtttgtgaacttcttctctttcgtgcttattattcgctttatattcgtggagtatccaaatggtaccttgatgctctccaagcattcaaacatactttccttctttgccttgctaagagtgtagctggctggactcaagtaatggcttcctttctcctttggttccgggtgaaggtctgttgatgtacaacatgaggcctgggagatctgcttaactccagtacaggtccaaaacttgcctttgggtgtgtaagcatgccagttgatttgatcctgcaatcaacaagaaacaaagacaaagaaaccgcggttaaatccataaacgatagccggccggctaattgccaatgacatatcatttatctttgagcctgtgtcatatatgcgtcgatcggcagtcattaataagtaacaaagaactaaatctactcaatcagctgtagatatcaatggtatataatatttatgtcagtatatgcttaaatcaagtgattgggatagatcggtcgctatgccgagacagtataaatcacttagatcgaaatatatatgaataatgagattatatgtgttcatagcatagccgatcagatagatctagtatgtatcggctaatactccgatactactctatattaagatattaaagctagaagaatataccaaacagaaagcctaatatatttgaatgcaacaagatcttaacataaagggcatacttaacatgtcaataaagtgtataagataaagggcatactactctaatcagcaaccaaagacaggctagagattgagattctaatcacgactcataagttcaaactcaactgatgcagctataagtatgaaaagaaggacaatatatagacaatcaagccgttggatgtgtcacagagtggtggatatcctatataatctagagaaaattccttgtgtacacctcaaaactctctcagtcccttctatgcacctgaaaaatactgaatcccttgtgtgtccttgaaagtttgtttggaacccttgcatgcccctctcgtcaagtctctgtcagccccagttccttcggaaatggtaagatctttgacgcagtctaaatattaatttgcttagaaatgtccattataccctt

SEQ ID NO: 32015 - DNA, 2261 bp, Oryza sativa
cagcaagaaatcgacgatgacccatgtagacaaccttcctacagtgcttaagatacgtactttctgtttcatccatacagtgagtgcaagccttgtaccccttgttagactgcccggataggttgctaagtgcaagtcaatcgttgatggttacgaacagcaacgatcgtaggttaaactcctcctgtttgtcctcgttccacacggggacaccttccttcttccacaacagtttaagatcttcgaccagtggtcttaggtacacatcgatgtcgttaccaggttgcttggggccttgaataataatcggcatcattatgtacttcctcttcatgcatagccaaggggggaggttgtagatacacatcgtaacgggccaagtgctttggccgctgcttatctctccaaaaggattcatgccatccgtacttaaaccaaaccgtatgtttcgtgtgtcctatcaaaagtctttaaattttctgtcgatgtttcgccactgcgaaccatcggcagggtgtctcagcatcccgtcctgttgacgttcttcagcgtgccaacgcgtcattctagcattccccttattcctgaacaaacgacttagccgtggttttatagggaaataccatatcaccttagcaggaattctcttctttgttggctgcccgtcaacttcacctagatcatctcgtctaatcttgtatcgtagtgctttacaaacagggcatgcttctaggttctcgcactcctcaccgcgatataggatacaatcattcggacatgtgtgaatcttctgaacttccagtcctagagggcaaactatcttcttagcctcgtacgttgtcttaggcaatttgtttctctccagaagaatgttcttgacgagttacaataaatcgccaaatgccttgtcactaacaccattttttgccttctattgcaagaactccagagtggtatccaactttttgtgcccctgctcgcaacctgggtacaacgacattctgtggtcatctaacatatgctccaatttatgggcctccttttcactttcacactcctccttggcgtcctacaacatctgaccaagatcatccgcagcgtcattatcgtcagcatccctgtccacctcgcccatttgatttccttcaaatgcagcgtactgagcccagtcgggaatgttcccgtcctccgcttcatcttcttccatttcaaccccttgcttaccgtgggatgtccaacaattatagcttggcatgaacctcgactcaaacaagtggaaatgaatagttctggatgtagaatactccatcttgttcttacacttgttgcatggacaacaaataaaaccgctacgcttgttagcttcggccactctaaaaaaataatgcacaccgttgataaactctttggactgccggtcagcgtacatccattgctgatccatctacatgaaatgaaaaaaaatcgtacataaataaattttcgtacaattttgacagtggaacaataatgataaaatatttaaaaactctttcgacaagcatacaataatgacatatcattactcatacaattaataattataaaataatccaacaaacaattcttattaactatttttgaagttctaaactaatattaatgttgtacttctcttaattttcaatttagtttgttttctattttttaagattaattttcattatattttaaactatgagaataaaacttttttaagtaaaaaaacaaaatttctatatattcttcttccccatataaattttctctctcatcaacttacaacaaagttttggagaaacaaaaatgtgtgaaacatagctccaaaagtaatataacaacaaaaaacattggaggatgaagttactaaccttttagacacctccgacttgtatataatcactaaaaaaatttcacaagaaattttggcatgacctcccctctttttttgagaaattttaaagcttgctcgggctggaggaggaagaatacatatataaagggggggatttttagtcccggttggtgttaccaaccggaactaaagatcacatatgcccgttgtagccaccagccgggactaaagatcacctttagacccggtttttagtggaaccgggactattgtggatttcggccgaccgaccaaagatggtttctccaccagtagttcatgaattcacccaccactattcaaattatggtgccaataaatattactcactccgtccctaaatataagg

SEQ ID NO: 32016 - DNA, 1300 bp, Oryza sativa
gtttcgtcttgtgtctaatgttcaggaatatgcatttccaaattagtataggtatagatagaaatattcattatctttctttttttttggtttgttactaattcaggaaaccttcactgttactgtatcactggcaggtcagaagaatctgcaggaggtaccgacaaaatttcgggtaagtctgtcacatcttgtaatttcctgatggaaaggggcattcatattttggatcatatagtttaaatgcatcattactcgttagataaagataagctgctccatgttgttacctaagtgatgttgtaaatatctttcagtggccaataggaaaccccgacgcaaactttctaccttctgtacacctgtacaactgtttcgagatccaattaggccttattcggttacaaaaggattcaatccgggccgggaatgacaagtatagtataaatttattgtagatacaatgagagaccgggatttatttcaggccgggaacaaatttacccataatagggataataagagaccgggaatcaatccactaatcaagaggtgtgaaactaatctggatgttttgttatacctaatatgagtaaattggttccggaccggaaataaatcacggtctcttgttgtacctattataaattccttgttatacctatcatttccgacctggaacgaatccttgtgttactgaacagggccttactcaacctaaaacatattgtatcatctctaggacatatttcaaaacataaggtgacatttgtttcgttaggacgagacatggaccaaccatatatagccagaatagaataaaaacttttgtgacacgaaattttatttactagattcgtatctaaaattatgtcgttatgattatgttttgtcacgtaactgatacatcatagtgctgtgctaatagagttatagttggttaaagtatttgttacactcccacttcatcttcaacaaatcaacacaaacgcattatatggcaccaataattctcactagatttctcaagtaacttgggtaaaatgcagcagaatgaaataagggggtgaatagagcagttgctgctaggttgatcctcttgtatatgccaggttgctactaggttgggcctaacaggcctcttctttacatgcgatatagcccagcccatgtaagtgatattccttcccacttaaaaatcagcttgtcccaagctgatgcaattgagcctgcgagctgatgcaatttcccaggatcccatagccttgaccttgccttttctccaacatcggcttcataa

SEQ ID NO: 32017 - DNA, 644 bp, Oryza sativa
ttatatagtaccctctagtatatgtaccgaccaattggaaagctcagcacgaattttatatgaggtcttaaaattgacgaagacatgtattagtgttgttttcttgtgccgctcagcacggatagtcgagaaaaactaggtagcgttaaactaaaactaagaaataaacgtaaaaaatttatcgacgtcattaagagtaaaacctatattttcaataaaaattttactcatagttaaatctgattagataacgtggacaaatctccaacatctatccaatggtagttttcagattattttttattacatatgatttgcaccacatttttttttccaatagtcctcccagaccagaatatggtggctggcggatagtagcgggctcgcactgacgcatgcactgtcaccggcatttggtcgtgcacaaacagaaaagccgagaaggccggatggtgcattgtgtctgcgggtttgatgatccaacaaatgaaggaaaaagttgacgaggcggtgatgtgtgtttgctgggccggatttaggtaatgctcgagatcgacctttcgatctagtaaagaaaaaaaagaagactattagtgccagtttggatcggaggactaaaattttagtccctatcacatcggatg

SEQ ID NO: 32018 - DNA, 3079 bp, Oryza sativa
accaaaatatttcaaaatatctcttacaagcatcgcacgtgcctcaaataacacagatcaacatgacaaactatatcacatatgaaacaaaataaatgttatttacatcaatccataggaccaatctgaaattcttaatacaaatacaatttctaaacacaaggttagagagtatctatttgtacagtgtgtataaaactatttgccgcacgcttcatccattgatgagataaactactgaataatcatttttgctccaagacaaactcctctgcttgcatatgcgtacatttgcattgtatactgcagtacaatacaagtcttgaatatgtaaaaaattatagtacctgcagttgatgaacatgaaggtatcttaatgtcagcccatagaaatttacatggaatcgtatacatcaaacaagtacttcgctacagattgaattaaaccaaagaagtaactatggcatatactgaagttgttttggctcaaaaccaaaatctcaaaaaggctccattattttatttcttattctagccaaaacaaggtacagtctagaaaatgatatggcagcattgttggggtaaggagaaaagctggaaagagaatttagaaatttttcagaacaagatttttctaggaataacaccgggcagtaatgactttgaggaacaatataaaggcagatttttaggagacattttaaccagagtgcactaagctaataaaaatgttggatgaataagaacttctccacacatattatacaatgcaatactgcacctttgatatccattatctatgtggatcagatctgcatttgcatcgactttttatttgcctaaacctggccctgaactagactactgaggaagccatgtaaggatgcaaacaaagaacgttgagattttactgttttttatcacatccctctgcagttagaagcaaatgactatgagttttagaaataattggaactgaaacaagtcactattggagaagtgatctttgctgggtgagacaatttccacaatagttccggtttcaaaaagaaccgggactaaagaggttttttagtcccggtttattactccaacgggactaagggatctttaccgggacaaaagttgcacaactttaccaaccggaagagatgaggagttctcctagtgagttttagtactacaatattacaatactagatcttggttcagtaaactaaacaacattgatgtcgctccaacataatgccctaagacaacattcaccctagcttactgaactacagcttgtattagtattaccatgctagaaatcagttccgtaaaataaacggcatggtagttgctccattatatggaggcaacattcatcaattcaccctagtttgctggatcaatctaaaatactaatttataagcttatattagtatagtaactctagatattgctgattaacatactctgggtttctcctacggtcaacgaagatcagcaacatcacagttgacaatcaagataatcattattcagtaatagaagtaaacatcgtcgtaactatgacataaataggtagataaatactatattagcatcgacagtcagaaacttcatgtttttttggttctatttaacctcagatggataagaaaattaaataaatttgacaagttcccgtaattcacaaattctgtggccatatattagtaacttagatgtatggaagtgtgtgttgtgaaatctcctaaacagttgaagacaacattggtgtttaatgctttgattgctaaaattaaagccaagtattgttcggaacataaggaatctgacaaaatgatgacgatgaaagcttgcattacctgcttaattaggaagtaacgacaagtcatcgtggcccctgcttccactccacccaaaatataaggggaaaatgcttacgtatgtgataaataaattaaagttgtgaggaattcagcattaataaataaaccaagtaacttacggtttaacagaaagtaaaagaaggcatcataattatcatgccgctaaattaatcactaaaaaaattaccactggactgcccccaaaatctttttttattttttttatctttatcattctagctctgcttgcaaccacatgtcaaaacttgtgccgcttgatccaacgtgctgggaaggtggagaaaagcggctgagagctcggtgcttcagcgtcggagctcgaggagggggtaatgccataagtggcctgcgtgtcgacgttgggcaagcaggttctggtagcgtcggagctcggggaggggatgacggtgtagcatggctggccggcgacgtcggggctcgacgcgggcgagaagagaaggagaagaatcggccgtgggagaaaagagatggaagacagggcctacatgtcagcgaggtggggacagacattttgggcaatacgaaattgagtctcattctggtgccttctacttgtagtagaaagtaatccaaaccgttgatcttatttgatcaaagggctgagatctgtttctactaccaccactcttaatggtagtggaaaggtggaggggtatttttgtccacggaaaagattttgtagagggtgtattcgtaatttatcactccccgaacctagcagccattctgtgtgtcgttcgtcgccaccaccccaaatcgcttccccccgccaccgcctgtcccccgccctcgccgcctccaccgccctctccgactcagccgctggttccgccgcctctgccgattccgcctcctccgattgcgacgaggagatgattagcctgttgcgccggtggcggagcggctatggtgtatggcgaactgcatggcgttgacgaggttctcggtgcgagtacgagccggggcggtagctgatgcacgtcagagacggggaagcttcctgccctgcgtcatcccgatatgtaaggtttaatatatcgcccctttgctttgctgttgagatggtaggctttgtgcggttctattcatcaatctgttgatcgagatggtaggttttgtgcggttctattcatcaatggccagctacaatatggct

SEQ ID NO: 32019 - DNA, 11975 bp, Oryza sativa
gtgtgatggcacttttgtgcctggtaattctgaacttttgtgaaccattatgtgtgcaaggaagctagacgtactcttgttgtccataggccgtgtttagttgccgtccaaatttttttttttgacgtttcgttacacacaatcgaagtattaaacgtagacaaataataaaacaaattacagattttgactataaactgcgagacgaatcttttgagcctaattaattcgttattagcacatgtggattactgtaacacttatggctaatcatggcgtaattaggctcaaaagattcgtcttgcaatttacagtcggactgtgcaattgtttattttttgtccacatttgatgctctatacatgtgtccaaacatttgatgtgacggaaaaattggaattttaaagaaaaaagttggaatctaaacacagcctatgttgatatgttgatctgaatttatatgttgaatttatatcacttaagaagtatataatcatgtgaacaaagtctctgatacaacaaaataaaaagctgaagaaacatcaatggtccatccccaaccttcaattgtgttgatgcttcttacacatgctccctctcatagctccggcttggggattacttcgcaagttgcaaacatgttcaggaaagtgaaaaattctgtgatacaagtgaatctggcaatcgcggctgctttaaaatctcatctcataatgaaaactaccatggtggtccgcgcagattacgcggctagcatcattatattttctctcatataatagcatatatgttttctcattatattattcaaatatattgaaatgacaacataattttaaattttacaataactttacaaaactacaaaactactaatgtgtaatattcatattatattttatatacgtgttagttattaattatttttaatatcaaattttagttagttgtaaattatatatattcctatatagactctagactcgtcttttaatatttctttttttttaattctgaattttctgtaaattgtatttctatataaactctatgctcttccttcaatattatttatttttatttctaaatttttattatttctaattgtatttctatgtggactctaaactcatctttcaatattctttaatttttaatttcaaattttagttacttctaaattgtattcctatatttgtattcctatattgaccttaaactcttcttcccatgtttttcttaatttcaaattttagttatttataaattatatttttatacagactctaaactctaattttaattttattatgtttattccaaattttagttagttttaaattcctatatcgactctatactctacttctaatattccttattttttaattccgaatttctatttttttcttaattatatttctatatggactctatactctacttctaatattccttatttttaattacaaatttatattatttcctaattgtatttctatatggactctatactgtggacccccgtttttataacaggaatcaatcgtgtaaacagtaccatttccctggatcaagtagtctggtacacacgaattcatagctgaaataccaaatgcacatacacgaatgtctagtacgaattattacatcataagcccgcaggcatagtcttaaatcatcggaccgagcggtccggaatacatccaaaagcagaaacaggtaaggcagcggaatttaggcagcggcatgccattgccacaggcaacgaccgtactaagacctactgggcgccatcgtcttcatctcccttctggtagtaggcatagggatcctccgaagcttcatctcccgcttctaattaattttatatttgcaagggtgagtaccaaccgtactcagcaagccaccacagcaatgatgcacatgacagaggaattcaaaggatggctatggttcgtttgcgcaaagcaagttttgtaattcttttcacaagcctaagacctagcatagactgatcaagttttaataccattgttcatattaaacaatgacggttctgtccaccatccattgtgatcccaaggatagcttcccgccattgagtcgttatgattttctgaggacgtccatattcccgcctctcaggagtggctccatgagcataaaaatcatcatgccatattccatcccacacaagttaagaatttagagtctagccaagtgtaatacatgtcccggtgctcattaaccgcgagcacggctattcgaatagatttggtttactcacactgcagtggatgtacactttacccgtactccgcgactacccaacacatgagcctcgtcccaacacatgagacgcgtcacggcaaagcttttcgataaccttgtattggcagtacccgctccatgaactttacatcctcatgcactccaggtgtacacggtttctagcagtgagaggagttctggcgcacccgggagggaaagactcacatgcattaagttataattatgtttaaattctcacatggcagtcctaccaatggcgacaccactatagacacccgtctcgcggttctacctatggctgccccaccgtagagcccctgcctcacacatcaagaaaccactatgcatggatactgcctccgctcagccatctactccgctaggtctatacccatacgagaagcggggttgtacgggggtcgtttcatgcttaacttcatggctcggtccctaattgaccagggacggcattagccttttccggataccacccaaatcctccgtccgccccagtcgaaaatagttgtttagttttatttctcttttcacaaatcatgtcatcaatatcatggcaatgtggcgctcatgtctccacatgcggcatctcaattaccttcccaaaggtaattgcccaagcataaagcattttgataaatatgagtatgcatgattctagaatagcatttctaagcaattgtcatagttgactagggactcatacgtaaacatggttacgaaggaataaggggtaaacaataatcaaggcatggcataatcacaagtaggatgttcatcattgcatgcaattttattcgtaaacaaaacaatttcacaattgggatcaacatgttcaaggaatagtgatgacttgccttgctcgaggtcttgcgggtcttggccttcacccggatccgcggctccctcggtctctatagttacgtgcgtaagaacaatttgaattcgattagaattcaaacaaaatccaaataatgaccgaattgaaaaacgagcgtgggaggtgaattctatataggctactttattcgcgaagtggaattattcttcttcctaagatattttgtgatttatagtcatgtcctaagactcatcgaattattgagttcttaattacatataaattagtaccgcgaaattgatttcttatggagattactaaaaataatctataatctataggaattcatctaattatattctcattaatcctataattaaatgctagtattttaggtatttaattagtaagaattcatctaacaatatgttcattaagcctatgattaaattctaatatttttaaatattttaaaatttctcttaaatttttcctttcctttctctccctctttcttttcttttctcttttccctttttcctttcctctctttctttttctctctctctctccccctttttcctctcctctctttctttttctctctctctctgccggcctctcttttcctctccctctctctcggctctctcccacccgagcggcggcggcggtggacgcgacgggaacggagggcggctcaccggcggcggcagcggcgacgacggaggtggcgatggtggcgcacggcggcgcgggagcggcggcacggcggcacgggaacggcggcgcggcggcacgggaacggcggcgcagcagcacgaaggcggcggtgtggcagcactacggcggcggcgcggtgaaaagggaggagatggaggggaatgggtgtgggggagaagagaagggctgggggttttatagggtgtgagagagggaagagagagggggcggtgaaggggggtgatgcgacggcggcgcggcagcgcggggcgcgaggcggcaatgggacgcgcgcggcgacgggacgtgcgcggcgatgggacggcgcggcgcgacggcgatgggacggcgcggcgcgacggcgatggcgacggcggcgtagggctcgaggcggcgacggcaacggcacgtggcgacggcgacggtgatggcgacggtgcgcggcgcagcggcgggcgatgggacgcgcgcgcgacgggacgggtggtgacagggcggcagcggtggcgcgcggcgtgaggcgggtcgcgatggcaacggcgacagcgccgcagcggcggcacagggcgcaaggcgacgtgacgtgtcacatcctgatttttgtttcaggatttataaattatctaataaattattattagaatttatattaaatgttctttaatttacaagtaaagttaaatgtgggaaataaaatttcctaaatttaaagcatggatggatttaattttcattaaattctccatgattaattatactctctgaaattttctcggatttttcggagctcaattcctaaatgatacaaagaacagttcagtaattatttaatcattaatgatctaattataattatgttaagtgcttttcttgtttaaaaaaatccttaatttataaattgttgtctaaaagggaattattagaaatgatcttaaaagcctaaaagagaagatctaattaataaattccaatataaaatggggccagataaaatttcattaaatactttgcttaattctataattcctagatttttctgggatttatttgagtaaaggaagtatttttaataaatggaattgcatttcatgaataatttaaattgaaaaaggtttttaaaagtctcttttggctttgggccgaaagtcggcccaaaaccttctctccctttccctcggcccagtcggcccagtccgcagcagcagctgcccgcgcgagcgctctcggtcgctgacaggtgggtcccacctgtcggacccgtcgtcttcctccggccgcccgtcgcccgaaccctagcgccgcgccgccgccgtctctttccaaattcggccgcgcctttccttctccggtgaaatcaattgagggtaatgtttcccgagatctcctctaccttttcccttttggaaacatcgtctaaatcgctttggaaattcgtggattcgagttcgattcggatcgatctctctcctccgaaccctaaaccttccatcgcgttgccggtcgccgtgggccttcgccgtcacctcttagcccctataaaaggacccccggtgtctccgctacccgtcgccacctttgccttcgtctctcgccgtcggtagcgccctagcaccgtgagacctcgcgccgccgtcgtcaccgtcgctccagccgtgcgtcgccgtcactccagtcgtcgccgtcgctcaggaaggccgccgtcgtggtcgccgtcctcgtccgcccctccgtcgttgctatagaccgccggagcaccgccgtcgtcgtcaaggcgatcttctccgccgccttttccacgacgccgtcgccgtccgttgatcttccgccgccattttggtcaccggtgagttcgccgcgtcgccctctatgtgctgtgtcctccgtttgtgccgtcgcgccgtcgttcgccggcgagcttgcacgctcgagccgccgccggtggtgacgtcaccgctgacgtcatcgtcgtcgtccatccgtgagccacggtggatccgatcgatcttggccgtccgttttggataggatcgatctcggccattcgtttccgtgagccgccgctgtgcacccggtccaccgtgaaccctagccgctgacgcaataatcctcttttccttttcaagaataattcattattgcgtcataattccattaaaacccatataagtgttttaatccgatttaatctttaaaaattcataactaattcatcttagctcggatttagttggttcaagtctctaaatttttctaaaattgagatctacatgttaaaaatatccacatgaactgttcatgcttgtttatgtgctgttttggtgttttgctcctttctgtttagattccgacgtttccggagagtccattttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctactgtttgtttatagcccttttgtttttgattactttattctttgataccttgggttatgataacttgactagttaggctttatatattggttcagctagatattagatatgattgcttagccatgcttagaaacattagcacactattgggataattaatgtttcactattatttaatgatggcttaatgatagctcacgatggccaatcgtgattggttaattaattacttgccaactaaaacttgataatggtgggttgtgagcacatggttttgagagtcgtgctcatgacaattaaggaccggttcacgattttcggttgtgaaatattaaccgtgccaaccacaagccagcgtgggcaacggctttaccttttgtatagcatggttcattgcggagcaccagactgagaagtggcggagataagcccacgggggtcgctggggagtccatgccttgtttataagggggtgactatgatccgggaacggtgcactgtggtggattgtgttgtgcgaggggtaatgtcacagctcctttccgaggtaccgtggtggtattgaggcacatggtgacatgttgtggggctgtgtcttgtgggtacagtggtacacctctggccagagtaaaactataaaaatagccgtgcccgcagtcatgggtgggtctaacaatgtctttcgtggttagtctcacacttctcaccataataaatgatgatataattggtaataatttgtttagctcctggtttggagatagatctgtgcagccgggtatggttgttcaggatggttgggcctgtgcagcatgggtgtgctgttcagtgttgattaaaatttctgattaattactccactgttttacttctcttaaatgttttgctaaatgctgcttttgcaattgagcctatattatgccatcctttggtatccttgtgcacttgcatatttgctgtgtggcttgcttagtatgtcatatgctcaccttgcaataatcaatcaaacctcagttgaagacaagttgcgaaggagaagacgtttggcttatactccagttgagctgcctgtgggagtggagctgaagccatcgctagaccgttattccgctgctgttttcttttcttttgtaagtgtgtaacgttatttttatgatggatttgaatattaaattgtcagtttgtgtacctcggctgattcctggacgaggattttatgcacaaataagttcggaaattactagtgaatttccgggcgtgacatgacgggcgagcggcgacggcaacggccgaaggcgacggcggtagcggtggtgcgcggcgcgaggcgtggggcgcgggcgcggcgtcggcgcggcagcggggcagggttaggctaggggacctcgtcgaacacctggcggccgatgaatagtgccgttttctatttacccgatttaagcctatttatttatttaaaattgattctataaacctaaattttgtacaaatgaagttcactcaatatttgtgttattccaaccaatgggtccatccttgattaattttacccatattttatttttatataattttcttgaatttaattagagttaattcttattccgatactttcaaatttaattgatacaaatatagtcgtaataatattttactcatttctatcctcaccaaatattattttaatttgcactttaattatttacttagtcaatttactttttagggtttattcctaactaattatccattattcgcgattcataaactccgaaatcagaatccaataaaataatcgaacaaaatcggcatgatgcaattttatttaaaaagtttttgaaggctcatatttttgggactttgatttttgttggtcgaattttcagggtgttacatatactctacttctaatattccttatttttaattacaaatttatattattttctaattgtatttctatatggactatatactatatttctaatatttcttatatttaattctgaatttcaggtattttctaattgtatttctatatgaactctagtctcatcttttaatattccttattttttaattccgaatttcagttatttcctaattatatttctagatggactctagtctcctcttctaatattccttattttttaattccgaatttcaactatttcctaattgtatttctatattgactctagtctcctcttctaatatttcttattttttaattctgaatttcagttatttcctaattgtatttctatatggattctgctttttctttttcttcgattaatgtgagaatttctaggccatgagagcgaacgtgaaggctcttttttctattcctttaataatataatagatattctagcaattaaagaatatatatcatgatgatttatgagcatgcttgtggacattcatggataaattagtaattaatactactccctccattccaaaatataaggcacaaccacccttaacccaaagactaagaaataattattatcaccttgtagtttggatcatcctaataaatgtaatgcatgcatccaatagagttagagaatgtgagagtgaaggatttaaaaaagtagtaatttaatggagaattgtcatagttaatggcatgcatgcatgtatgccttcttatattatggaacatcttaaaaaaaagtggttatgccttatattatgaaatggagggagtattgagttagtaactatatggaactgctcccaaaaaaaacaactcaggaactgagtttctaattcagaaatgttccctcaaatgaaaactcaggaactgtgtcaacgatcctaaaatcgtgagtattttcttttcaaacaatacttttagatttttagaaatataccataacagatattaacagtcaaaatagtattttatacatactctgaagttcagagattcagttagaactgtattttgttcaaataatacagtattataatagctagcacattacatcttcagaattaatatattgcatccagcccgaatcaaaattcagcatccatccatatcaaattgacatccaataaatcgaattggaacttgtatacaacgctatatgcaatctagcagcagtagcagtagcaggttcctcttcttatcaacaacgaagaaatcaaattcgatttggagcaaacgcacaagaaccatgataatcgaaaataaataccagctgttcagttggaggaggaggtcaacgcggatgtggacgcggtcgtcagggcagaagaaatcggcgtggccgtggtcgatagggaggagatcggcgcagatgcgcgtggtcgccagcaaggagtcagttggcacggccgtggtggctagacagagatcagcgacggcgggaataccaggggcggaggatggcaggataatcgaggtcaccgacggcgagataaaacggcggcggcaggatgaacgccggctaatcgaaatgggtgccaccaccggaatcgggctgtacaggaacggacggcggatggatgcggcgagatggtcggagcaatacgagactaaaacaaaaggaaaatacaaatacccaaattacccttaagcacatagtttgtaagtactaatatgcccttccaaatggatggttcagatcgtttctatttgtagtataatactaccagtagaaagcaccgtagacaagctctacgaaattacaatggtacgtggatccaacggtcttcagtgtgtagaaaatggcatgtctgatacaaatgaagaattataacggcatatttccaattaagtgaattgggatgatattttttaaaactggcaaatttataatgacgtggatccaattaactttttatttatctactaatacttcaatcaaatatctagtcgcgccaaatccacctccatggcggcaaatcacattcctttagcaaattaccggcgccaaattttcattaaggcgccaaatcattgcatatggcgccaaagccctctcacggcacacctaatatctcctcaaattcctcctccctgcccctttgccaatttttttgcttccttctctgtcgatctgttgcacaaaagtcaaatttcacccattattggttgtctaaacttacagtatgatatgaatcgctgctgatgttaggaacatttgtttattctttgtttaaaacatgccttaaacttgattttgtttgtgaagattttgtctcagttatatgaaatgcttgaatttttgtatgctcgaagtttataaatcttaatggtatgatggacatatcgactggcaattttccgccatatgttggacttatctgacgtatataatacggcaaatactgaatgtgtccaaagtatataaatctgaatggttacatggacatattttctaacatatgttggacatatctgaagtatataaaactgagaatgaaatgtccgctgtatgtaaattttgaggtttgaatgagcatatttgtctcatccatgatttgcctttgtaattgggtatttttcaatacaagtttgttccaaagtatgtcaatgtggggtcatagtgcttgtatacatgtattcagtactgatgatcgatttatgacttatcagcaggagaatgtatacagttctagtttcctgagcaatcactgggtataattagttttctatatcaattgataggattatgtactattgaattgaagaatggttcttaagtatgctgttgcagtagtttacataactattaggtgatgatttaccaccccttttgtgcatactgtacatgtaaacttttgatggtcatgccttgtattaaaaggttaattcctgtcatggaagcatattttcgtcttatctaccggtgttagctttgtttgcagaatttattcatgggacgctacttttttaatttaattctaaacactaatcatgagatctctcttttaagatattgattttgtttgcagctaggaatcagagcacataggccgagcacatcatacagtccacaaagttagaaatatgggagaagccaggttatgaagttgacaggaaattgtgatatttgtacaggaaaatatatgcgagttttcctggaccttgactaataaaccaacaaaaatgcattttcattctaaagaatgatgcaattgtgctaaatattttctactatgcagatatttcttgcctatccataatttgtgttgactcgcagcagtatgtagtttggtattatgtcattcagaagaatgactgggccaagaggccgatctgaccggggggcattggagaagagtgggaaaattgagagtagcacgagagttttcacttcgactaaaaatatcaagaatcattgcttggctcttgaaaaacaaccacagccgacgtggatacctactggcttatctcgctctcaaaagaggaggatacaacgtcttcgggccatagatcaaaaagaaaataaggccgaagatgtagagaacaaaacatgtaataatttagaacctcaaacagcacctaagcaaatgtggagacctaaagaagtaaaagttaagagaccggtgattt

SEQ ID NO: 32020 - DNA, 10469 bp, Oryza sativa
atattatacatacatgttgcaaatgccagttctaagtagtggaattggtaagttggtatacaatttgtttaaagtatgatttggctcatgagttctggatatttattcaaagccaaatcatatttgtttttatggatcaccatagaagatatagatttcatagttattgcaccatgaaagctttggttattagtaattcggctaatgtcaaccgtcaatgtgatgatttgttctagagttgttttctttaggaacattggcattgttaatattttgcaagccataacaaatgaaaaaagataaagactcacaaggactaccaggcccaaagaccgtatccttgtcccctcgatccattgccgcccgcgcgctacttagcctcgatagttcggtgtcgcgcaggcatatgtacaacagctagggatgaaactggttcggatagtttccgtccgtccggaccatttttcggattcggatagtttcggtcggaactattcggaaattctcggattctgaaacgaattcggattttttttctcgaagacgaaaacgaatacaataagggtactatccgtcggaattggaaaatggtcggaaactatctggaatttttttatatcagcagacattgagcaaattttagaaaaaacacgtagatatatataatttttttatacggaatcagatgaagacaaactttatatcaacatttgtagagttccatgagatctacaactttcttatttactattttattatttaaggtcatttaagtgtctaaatattcattataatataccatattaatttttacaaaatctcagatctacaattcaaacgacatctgatggagatgtgtttcataccaaagttgtagagctcaacgggatctaccactttgtagtttataacatttgtatttgaaagcatttaaagcataaaacaaatatttcaagtttcgaagatgtgaagtaaaataaataacatctccaatttatacaatggcaagtaagttatacatctagtaaaacgtcttgagaatagaaaatgataatcatatttgcatatgaatctcttagaggaacaaccatgaaaattgattttcacatacggttgtgagaccgtctataaaattaaattgacgatataaatgttggagatgttgaactacaataataataagtgatatctcttccttgatcaagaaattcaatttgaggggctttttatataccggtaaatattcactaccgtattcgttccgtctcgtattcgctccgtatctgtattcgataatattcgattttatttccgtatccgagttttcgattccgattctgattcccaaaaaaaagtatgaaaacgaatatgataaagctagtttccatccatttccgatccgttttcacaacagcaaatcaattcctaatctccgttggatcgcatcagcaagaaaccaacaatgcagcaaaagggagtatgtccgtgtgcatccatcagttcgtgagacgttcactgtgccattacatttcccgactttatttttcttctctaagtttcaaattcatgttataaacacgcaggaatttatttgtttatttcatcaatcctcatcgtgtcttcttaaatgtatgattttggttatgaaataggagtttatttattcaattcaccaatccatattaagtgaagatatatactttgattctatagtttagatctcttgtcttaccaggggcggcagcaacttattactgggcaatttggctctcatgaatttggatcaaggaatgatgtggtttttgatagcaaaattatttcttctcctttgcaggttattttcttgattacacattggctccgatcgtgggttattctctagaaaccaaatttgtaggattttgtcacttcggcttgtctatatttggagcaagtggtcaaggagtttttttaccccggcaaatgggtggtgacctagtttttgggttgttgggcattgatcttccacattggttttttctcttattttgagtgtattgaagtttgttggttgtgtacgctgtcatggtgcagaggccgagagtattctctgaatgactaatctctataaagttttcattaccttaaaaaaaaaactttgattctacagtgtttttaaaaatttagggccatgttatgtgattcgcacacgggtctctaattcctacgtctttccacatgcacggcgaatagactccaggtgcttgcaacgtcattggctcatctccaggttcgttcatataatgcaggtggtttggagtcttatatcccaagtcttcttattttaaagatgatgaagaagaagaaggcttaattaagaccgcgctgaagagacgatgttaattcccacgggcacgtatattagatatagactctattagaaagactgcaacgccaggtgccaacctctagtctctaggttccttgacataatggcacattgtgggagtcttttatattccaagtcttgtttttttaaaaagaagaagaaaattagatgtgtccaagccatcgagaagacgtatcaacgcatttccacattttcatagaataaactccattacaaggacggtaacataaggcgctcgcctgtccttcacttgatggtgaatggtagtctttgtatctaagtctttttcttaaaaaagaaagatcgaaacgaagataaaatagatggatccaagactgctgaggagaaataatgccaacttattccacgggagcctcgaatagaatccattacaagaatggcaatgtcaggtgctcaaccattcaggtcttcaatttggtggtgcctactcgttccgtaccaaaataaatcaacgtgtaataagatgtgacctaatctaataaaacgggacggaacaagtaattcggagtgtttgtattgaagtctctattttattattaagaaagacaaataggtggttccagcgcattcccacaggcacgtcgaaaatactccattacaagtagggatgaaactagttcagatagtttccgtccgtccggaccaatttatggattcggaaaaattcggtcggaactatccggaatttctcggattcgaaaacgaattcggatttttttttctcggatacgaaaacgaatacagtaagggtgatattcgacggaatcggaaaacggtcggaaactatccgggatttttcattggatatccagagatatttttcaaaaaaaaaaacaacaacaaaaaaaaaacccagaaaccctagccggctagccggccgcgccagctgcatgctgcagccatccgtcaccgcgcgagcctgcctgctgccgccgccgccgtccgctgcgcgagctcgcccgccgccgccggccgcgggagcccgccgcggctcccacccaccgacgccgccgcggcgcgagccgccgctcgagctcgcccgccgccgccggccgtgggagcccgccgagggtcccactgccgccgccgccgcccgtcgccgcctgccccgcctcgcgagcccgcgcgccgctcttggccggtcgccgcctgccgcgccccgcgccgctcttggctggccgccgccgccctgtgcctgtggatgagaggaagtgaaagagagagagagtagaaagtgtgtgtgagagagagaggagaggaagagtcaagaggataaggttgggggtgaaaaaaatggtggattttttttcaatgtaaaaatcaatttttattttatatgtggctctttaaaacgaatttaaaggcactaaatcaactcatataaaaaagttgttaaaaataaagttgtataacttattgagatctattatttttattttggtcatttctccatccgagtttgattaaactatataaaatttgaatttaaaaatataagaaattcaaataattttccaggttgtaaatgatttcaaatgaaaaaattgtcaacaacaaagttgtataacacatcaacatctacaacttttgttttggtcatttttctatatgactttgtttgaaccgtttgaatttgaatttcaaaatatgacaacttcaaataatattttgaaatactaaataatttcaactgaaaaagtcatcaacaacaaagttgtataactcattaagatctataacttttattttggtcatttcttcatccgacaaagtgattataacattgtacacaaaatttgcatttatctcatttggtttattaaactataagagagatatgtaaactttgtgaaaaatattattatcaatttatcggatgaagaaatgaccaaaataaaagttgtatgtcttgatgagctctgcaactttcatgttcgtgtacaggtgaaattaattacatcttcaaaatattatttgaagttttgaaattcaaatttttaattgataaaacaaagtcacaagaaaaaatggccaaaataatagcagcaagaacacaataacatgatagagtatgattttagaaacatttagaaaaaagaatcatctaatttggagttcatatgagtgagataaattagtttcaaatttccaaattttatttctgcatacggcttcttaagtcacccgtatgggaaaattgatttttttcatgcgggtccttaaatggtccacatacaaacaaatgaaaaaattcaattctgaaaaataaccaatcaaatatttaaaaactttcaattgaaatgttcaacccaaaatttaaaatattcaaccaattttcaaaaatttcaatgtgcctatgaaaattttagtgatacacattaatttatttgtttcatgataacataaatttatatggaaagtaaacataacattttctatctcctccttgccattataaatagagataaaatttaaaaatactgatgttttgtttttgaaaactaatggctacatatcttcctcgttttaagaagcttattttgaggggtattatattttgataattattcgttaccgtattcgtttcgattcgtattcgctccgtatttgtattcgataataatcgattccgttttcatatcgggtttccgattctgatttcgattccaataaaaaaaatgaaaacgaatgatagagctagcttccgaccgtattcgatccgttttcatccctaattacaaggatggcagcttcgttcactcatggaccactaaactatgatgcctggttcaatgtctttttatatccatctcttttttttttagaaaggagaaaaaaaacaacaaggttgtacgggtgctgaggaggggcatcaacgcgttcccaaaggtgcaccgaatagatcgtctctaattacaacgcgcacacatgtctgtttgcccggtagcatgtgacaagcatcgactatgaagcaatcttattgaaactggataaaagggtggaaggatttctcctgcaaacataatcccaactcaaacactatttcgtagttcccatacttaccatgtcatacaaacactctttatacaaactatatgtgtcaaaggtttggtttcctcacaataaactcatccaatcacctctcttctctcatcatttctctctcttctaattatctatcttgtcaacttattttttttacagcttatttaatgctacaaaaactagctaggtatatggctggaactaccctgacaaacctcaccacctccatgcccttcactggcaccaccaaaccacttgttggatgacattaaaggcaaaataaacttcgttaatctgctttgaaattttaatgtgtcaaaaaaaatccatactttgaaattttgttttaagcttttaaccggaaaactattttaaccccacaagaggatgttccttcatttgtcttaaaaaaatcatccaaatagttatgcagaattttgaaaaaagaaatataacattcatacttacaacatatatctgctgaattctttttctatctcattgtgttggtcaaatttgatattaattctggcggactgctacatttcccttcatttgtcttaaaaaaatcatccaaatagttatgcagaattttgaaaaaaataaatataacattcatacttacaacatatatctgctgaattctttttctatctcattgtgttggtcaaatttgaaattaattctggcggactgctacatttcattatactctacattatcaaaaataatatttttcaataactattcatatggaatttggaagaaaaatatacatgagagaacattcctcggagatattagaatctattccaaatatgatcatatatatactaaaaatttaaatgttcatgacagtaattcgaattggattgcattaagtgcttactttatgggcaacaacatctctttacaccactacggaaaggctcatcactcccggtttgcaacccattttactcccggtttgcaaaccgggacacctaatccgggactaaagttatctatctttagtctcggctaaaataacagggagtaaagatggatttttaagtcccggttggtaagatggcggcaccattagtccggttggttagtttttttttctttttgttgttatttttctgctcgcatttattgtcacccttaaatgccccacaaatcattcacaacaaatcatacacaattgcctatccataaaatcatccacactccacaagtcattcataaaatcatccccaaatctaaaataatccataacaaagtttataaatcattcaaaaaaatctaaaataaactcaaaaaacacaaccctgccgccgccgcccggtggcctcccctcccgccggatatggaggaggggaggccgcccggccgtgcgccgcatcgctcccatcccgccgccgctgccgctacgaccgcccggccaccgccggaggggaggccgccacccgcagctcatgcgtggccgcggccgtgcgccgcctcctcgcagccgccacccggcctacgcccgccgtcgccggagtgggaggagtggggagggggaggagaggggaagcggccggaggaaggggaggagagagggggagggggaggaggtagaggagaaaatgagaagggagaagtagaggacgagttcgatgggaggagcagaggaggaggggatcggataaggactgctggaagcgcgcgcgagtctctggggagtttttcgattttttttattttgggtttcggttggtacaaacaaccgggactaaagatgataggggttggtaacaccaactgggaataaaaatcacaaaagtacatgtaggttttcaaaccgggattaaagttatttttagttccggtttttactcaaaccgggactaatgtgatttttgtgtgacctagtaaagatcatttctccagtagcgttattaggcaggttcatgaattcccttattttattttttttacgatatattacccccaaatgaggtaagacgaatgtcattcatatatacaatactagtaatattagtatcatggtatatattatggacggtgtgaaacaagttgggatgagcatcataaaagattctcaaaggcaatatataaggagaccatcagccagcttctgagcaatactaattaactctcaaatccctcgcgcacacacacacgcagacagagagagagagagagagagatggcgttatttggggtaagagagatgagacgatttgagagaatgacgccggaaaggcgagctgaatatctactaggcatggccggtgtcgtgacgttggtaacgtcgatcctcctcctgttaagcggcagcacctatgggtacggccctaaggtttgcaccggccgtggcgtcttctttagccccacgatcgctctcggcctcctgctgatggccgccttcattttgggtacgtgcggccagaggtacggtgatgagtgcctctttggttgctacctcctcggtctcctcatcgccttccccctcctccttgccttcataatcttcggctacgtcgctgttggaggcatcgacctcggcggcgtaagtattcgcgagtacaatctggaggagtacagcgggtggctcaggggccgtgtggccgacccgcactactgggaaacaaccagcgcatgcctacgcgacgggaacgtctgcagcggcatgacgcggttggtacgcgacccagacaccggcatattcgtccctgagttatcccggtatgaaaggtggctcaaggaacatgggattaaaaaaggcgtgcacgtaatgtcgcctatcgaggtatgtacgtagcagctagcttcgatataattgatggatgatatccccgagcccaagctcaggtgtaacttcggtattagcctatgtatgtccaaccttagtgtacaaaacttgatttattttgaaagggagagggtagtatcttctttgacgtatgggccggtccacctttgaaaccacatgaatgcaaccgcgtgcgtggtgacggttttttgtttaggtccgacaaagatgaccaccatcgatgacggctctaacacatatgagtttccacatcgctgaccactaaaccgctaccagaccgtctgacatagatgagggttcccgccagacagaaatgacttgattcgcactagcgcactcgggatgaagcggtgcaccactttgttttagggagttcaaaagacttccagcttagtatacgtacgttgtgctaggttaattatagcttgcatttcattttttttctttcctttcctattccctgctttattttttcagtgatgatgatatattttgttcaatacttctttatttatgagcaattctacggttcttaggaaggtaccatgagatagcaaaatttacacttaaatttcggtacctcacagtacctagataccatgagttaccaaatttacaatagaaaaaatggtatttcatggtatctcctcaaggactttaaaattgctctttatttattcatttcgatatttcacttaattggaacctcgccttataactgaatatatatatgctgcacttggcagtctggatgctgcaagccaccgacatcatgtggtttcagatatgtcaacgggacgacgtggataccaacaccagcagcagcaggcacccctgccgcggcgaccaacgtcgactgcagcaggtggagcaacaaccaacagacgctctgcttccagtgcgactcatgcaaggctggcttcctggacgacatcaagaaagcctggagtttcgatgccctgtatccaattctcgcgttggtcggagcctttctttcatgctttgcaggcgtcaagtattggagaccaagactagacactgggtactcactaattagagaacgagcagtggcttaatttagacggctaatatctgcgtataatcttttcacgtaatgcataggcgacatacttatagacgacgcgtacagtaagattataagagtcgtctctcttttatagacatgctatttgtattatcaatatgctttgactctgtaaatagcatgcataatgagtgtatggtattaagccatctatattgagaaaggctctctagtgtaatatcatactagttctggaatttaatctgaatcgtcggtttttataagtgcatatatcggtactttattaactcagcgattagggtacgcaatattaattttggcattttggttattatccattcaccagtctgtcatttttccattcatttgtgcggtatcgctactttgatgtcagcatccttccgctgccggtcacgctcagcaaacttccagccggcgtcgtcgatcgttaaaactactactacctcctccgttttagtacgtaagatttacttgtatatgtatatatatatatataactagattcattaacatctatataaatataaagacttataatataaaacggaggaagtagtattaacggcatgaataaaaagccgaatatgatcgttaaaggtcattatttttctcatcgttatggtattaactataaagttttccttccgtcgttttctgttatatattaagagtccattaatatttttcaaaacgatcttaaaccgtcacgtgacgctctaacaaattaaaaaaatctgagaaaaaacaaaacatttatccctcggttttaaattaaattaatggttctaatattataaaccgttatattagattatcttaaaataaaacgaaaaaccaaaagtgactatactgtcccatctcaacttccatggtacggacgtacgtgcgttagtatgtaacctttttttttcttttcaatgtctatagttgagacgtttattattattattattattattattattattattattattattattattattattattattattattattattattaaaagtgataataaattttaataaaggttactttaaaaaaaatagaatatatctgcatacaactcttttacaagtagacaactagacata

SEQ ID NO: 32021 - DNA, 10608 bp, Oryza sativa
attacacatgtgataatctatttacatgtgttaattaagaacatactttgggaagaaaacattctgtgccacgtgtccgacgcatgagagaggagcggcgtgggctcatgtaaaataaatgagtagataaatttatataaaatatggtctatacaactataaaaagataatgagtgagtggaggatgtcaccaagcaataagcagactcaaaataatgacaaatagtttacttctatattttatcgagtgatggcatgatgtgtcagttgtataaaaaagtttttctttgattatgaataatgacaaagacagcagtatgaagggatgggaatatgtacttattttttaacttaaaaaaatataggcaaaccatttattttgttaaatagtcatggtacaaagttaatgattataaatcgtatggaacttattgattataatttacatgacaaactatattcttgatataaccgtattacatgatagaaaaaactttacttaaaagaactccaaaatttataagtaaactatacatactaattaaatgtacataattatggtcttattacaaaaaaattattgtttcaacaaaaacaatcgaatatgcaaaaatgaaagaaattaacttcaaacaattttatgttttgcactacaaagccaagcaattatgtaagtatttgtgtgcaccaaaaccctttaatgttctttaaaactatagataaaatattgttgaacttatgtagaggaaaaaaaatctaatttttaatctacccttgatttaatctacgccttcacgaggtgattcaatcacaagaactttgagtaacttgatcttgtaatttccgcttctagccgtatttacacggcatgtgtactgcatgatatgcatgataattacctagcggtagtttaatatttattttatacaaaagttgtatgaagttaatgtatcatctattcaaaagtgaatgaatggtttttgagaaatgctaaaaaaaaagaacccaggatatattttaaaaggacattcgttgactatctatgagataattgttgaacaaaatataatattacccttcaacatataatgcccgcgcaaaagcgtgggctacctttctagtgaccgtgatattatgtcatcgtcttcattaacgatcgtgatattgtcattgttatttaattaagggctgttgctatcattatttcactgacgatgggggtattatacatccttattttatttatgaacacttccttatataaaatcaccgaaaatatcattaagcaataatatataattgtgtgcactcacaaagaaacacttcatttattcatagaattattggaagcttacagacccctccgttccaaaaaaaaaaagtccaatcctagctacagaactggacatatgcgtgaccagattcgtacttagagtttgactttttttttcgacaaagtagtacaaatttatagcttcttggtttcacaacgggaatacggctagaagaataactatgctggcatgtgtttgttcatcatcgcggattgcacattaggtgatcaagttgatcgatcttattcagcatcatccctcagtacataggtatcctgccattcaatcacttggacacaaagtagatttgtgggggcagcgcacggtgcggtgcgagtggtgtgggacggctcggcgcgtcgcttgcccggcttggcattttgtctaccaggtggcgggcaggtggcccggcgaggccgtgtcggcccaggagggaggagggtaaaaagtgcgaaatacctaataagcagaacgttcgctctaatactttaccgcgaacagctcggacaggttgacatgcatgactgaaaaggctgtcacgcgtcagctggggcccttgaatgcagtgtcctttcttttatagctaaactgtgtacgtatatctttttttttcctttttaatctccgattttttagggattgatcacgtatgtgatttttttttctgaacaacacatgcacaagaataggaaagattcttgggaattcttactcaatgtgtgcccacatccgccactttttatttaggttagttttgacccaattgaaatttaatagttttttatttttgaattattttagtttcgttttaaattcatctgtgtataaattttgtatatcgaaagtttatttatataaagtttacatgccaaaagtttatatatgtataaagtttctatatcaaagtttttatatataaagtttgtatgtataaagtttaaatttgggtttaatgtttgtgagtagagatgctagtaatttgaatatgattttatttgaatgaaaagcttaaaaaaatgggtaaaaaatctattgaattgaagatgttgctataaaataaaataaaaatacatttacctagcctagttacgtagtataatggtttaattacagatcatactagttttatcggtagaaacaacatgatacatgcagctgattaagtggcagcatgcatggttgcatgctcgatgtgtgcatgcaggtgcctggctgcctgcaaatcatgccactaatccctaattaaaacgcgtaagcgtagaaggttaaggtgatactagtagatgataaagtcgatttgtggtctgaaagtgatcgcgatccgcgaacgttcgcgtattagccccacccgggcggctgctatgctgggctgaggcctgagggagaggggctaggaggagagttagggcctcaaatgaacaggatttttgttttatatttgcttggaattttgtaatttggaaatgaaaaaaggattgaattggaatgtaatttgtattcaaaatttgaaactggactgtttaattggacattccaattcaacatggttattacggggtgcagggattagttatagaatttcgagaaattgcttggatggatggattgtttttgaaaacagatttagaattgtcgtcacatattaaaattcatcggcagtttttttggctatgaaggaagggactattacagggtgtttcggataaagttgaaatatcatgaaaatggatccgaagaaaataaatgcaaataaacgaaattgggatttagatccaattttggcattcaaaggattcaagggaaggacatgatattataaccattggaacgggttttgggactttgattaacttaaatagaatctattaacttattaaaggaataaaaaaataagcctccatgtttgctcttatggcctataaaatcccacattaattggaggaaaataagaaaaaaataaaagtcaatccgagacggtaccacattaaccgtagaaaaaaagaaaaaaaatcaattggacaccctatagattgcttacatagtaaataaggattctttttcagtttggaaatagtattttattttggaaaacaacaatcatacatgatttatcaaagtgaaataatcagaatcagtaaccgagtattgcatatgtatctattccgaattgtactctctacattcatgtcaaaaaaatacatagacttagcaaccaaagcaaaatacaaacacacaaaacaatctaccaaagctacgtttttcaattcaaacttgtcacttaccttgacacatctcgtagtaagaatgacaatagtagaagcatcaccaaagataatcgattccgtttcgggtgcctgtttgagcgaggagaaccaatttttatcactggtcatgtgctgcgaacaaccggaatccacgatcacacgttctccttcctcgccaccaaagcctatacacaagaagatgccgaagcctcagtactgcggttagataaaagaaatttagaaatccaatactaagacacatgaccagtagatccaatagatatatatctgcgcgtgaaaatagtttgagaatttttagaaaatttttccaaggtcggtttgaccgagggggtactgccggtctaaccaggggtcggtccgaccgccactgcactgtcggtatgactggtcgccggcctaaccattgtgttctggccgatttgaccatgccaatgtcgtcagtctgaccactagtgtcccgctggttggaccgccgatcccgaccaaacacaaatcgaagatctctcaaagtagattgaaactttattagttctctctgtgtttacaaagttggacaacggcactcctcacgaaaatctttactaaactcgaaaccctaactattctctcaacattactctcagaaaaacaataccgggaggacacaccatccctctctatatatacctaaggtaggcatcctaaagccacgaaccaaccttgtacaagaatcttaatcccctacgaaaccttcccatacaagaaacaaactttacaaacttaaattgtaccaaatttggactccttccaaattcgactctccatcccatacgcacacaatatctccatcgtatgccatatggaatcttcaccaaccacgtgcattgatctttagcctaagcatctgtcacgcccgaaaattcactagtaatttccgaacttatttgtgcataaaatcctcatccaggaatcagccgaggtacacaaattgacaatttaatatacagattcatcaaaataactaaaacaataaatacttacttaagaggcacttagtcctcaccatgaagaaacctgcagcggaaaataaaatctagcgaagctccggctccactcccacagacagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaacatttaagagtaataaaacagtagagtactttaatcattaattttaatcaacactgaacaacacgcccatgctgctcaggcccaaccattccgaacaaccatacccggctgtacagatctaactctaaaccaggagctaagcaaattattactaggtataacatccataattgttgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagctgtgacaataccccttgcacaagacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttgtggttggcatggttaatgtttcacaatagtagctcgcgaaccggtccttaattgtcatgagcacgactctcaaaaccatgtgctcacaacccaccattatcaagttttagttggcaagtaattaattaaccaatcacaattgaccatcgtgaactatcattaagccatcattaagtaatagtgagtcataagttatcccaatagtgtgctaatgtttctaagcatggctaagcaattatatctaatatctagctgaaccaatatatacatagtccaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgcctttgcaataatcggtcttcaattaatcttcttgaatacttccggcgcactcgcgaaccttcgtaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaactttacaagattaaatctatttaaagcctatttaaaaaggattaaataaatttaattcaatttatggataattttaacatgtagatctttattttatacaacttttgcaacttgaaccacattaaactgagttacaatgaattagttatgaattttcaaagattaaatcggattaaagcatttatatggattttaattgaattatgacgcaataatgaattatttttgaaaaggaaaagggaattattgcgtcagcggctagggtttgcggtggaccgggtgcacggcaacggttcacgggaacggacggccgagatcgatccatccaaaatggacggccgagatcgaacggtccacgaccgggccacggcggacggtcccgatgacgtcagcgacgacgtcagcgatgacgtcaacaccggcggcggctcggcaatgcatgctcgccggcgaacgacggcgcgacgacgcgaacggaggacaccaacgggtagagggcgacgcggtgaactcaccgatgaccaaaacaacggcgaagagcaacggatggcgccggcgacgaggaagaagcggcgacggtcttcgggtcgacggtgacggcggtgctccggcggtcttcggcggcggcggagcggtggacgaggacggcgacgcgacggcgaccacgatggcgacttccccgagcgacggcgacgactggagcgacggcgaagcacggctggagcggcggcaacgacggcggcggctagggctacgcggaggcggcgctagacgcgacggcgggctaaggcaaaggtgacggcggatagaggagagctcgggggtgcttttaaaggggcaaggaggcggcggcgaagacccacggcgaccggcgacgcgaaggaaaagttagggttcggaggaaagagaccgatccgaatcgacctcgaattcacgaacttccaaagcgatttagacgatgattccaaaagagaaaaggtggaggagatcccgaggatcatttcccctctattgatttcaccggagaaggaaaggcgcggccgaatttggaaggagacgacggcggcgcggcgctagggttcgggcggcggcggcggcgcgaggaagacgaacctgacaggcgggacccacctgtcagcggccgagagagaggaggaaggggcgcggcggactgggccgactgggccggggagggagagagaaagagagaggttttgggctggctttcggcccaaagccaaaagatacttttaaaaacctttttcgatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcctttaagcttttaagatcatttctaattattccttttaaacaacaatttataatttaaggatttttaaacaaggaaaagctcttaacaattataattagatcattattgatcaaataattactgaactgttctttgtatcatttaggaattgagctctgaaaaatccgagaatattccagagagttgacttaatcatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagcatcccggattagctgatcatccggacgtcatcttctcccaagttgacttccgatccatcatcggcaatactcttccgaggcatcaaaaccacctacacatgcagcaaccaagaaaccatatctgagcacaagttctcaccaacatgactcattgttagccaacaacagtattatatacgcatagtatccatatagaagttataaacatgaattatccaaggatatccaaagaatcaacccgaaaccgaaacctacatagagtcagccgatcagaccactagctggccggtccgactgcacgcatacatccgatcggactagcagcacttgcccggtctaactggttcaaacagtcaacaccagttgctgttcatcacctgcaaatcaatcatctccaaaatcacttcgtcaataatctctaaatatcaaaaccaataatcccatatgccaattgttcacataataaggaccaaacacactttgattttacacttggtccaacgaacgagattcaccaactttggtcagattggatagagccttttttgcacagtttgggaggagatgtttctggattcgttgttacagagctcagcatcagttgtcttagatcattgcccctgttttgccttcgcacaagtgttcgggggcaaaaagggatttcactttgagagttttttcacctaaaacgagggttttcttgaggtcgagcaatagatctaggtagctcctatacaatcctcttgtgcaattgagggtttattcctcaagctaaaatgattgggcaaatggattgcagagttggagttagaaaaaggtgggcaactttaagattcagctttcgatggcaaaggagatcctcaaccgcattaagattgccagagattgtagacctctcactgttggggaggaatggttgagaatgaaattgaatctgcactgccttggcctggcatctcttgagcgtactattgctaggtcaagatctcagataacttttcttagtgaaggggacgccaacaactcttattttcttaatcagtcctgctactgtaagaaaaaaaagaatcatttctaagttaatggtggatgatcgggttgtcacttctcaggaagaaaaacatgaggtagtttttgagttctacgagcatattctaaagtcagcacgtgatagggatttcttgttggatctcccggattttgacgataaaaagtttgatattgatgccttgatgagccattcttcgacgatgagatatggtctactgttaaggcttttcacctcgacgaagcttatggtctcgatggttttacgggttgtttctacaaggtgtttgggagattatcaggtgatattctcttggcgcttgcagcgattcaacaaaggcatatttcttaattcaaattgttcaattaagcctatatcactcttttgtctgaaaaggtggatgcttgtcggtcatcattataatcgatcatctggtagcaagcgtagtaaaagaccctgccaaccctagggttagacagaagtgctatggatgaataccccaaagatgacgatacctgttaacaatttgtgatgaaaatctcaaaaaattatgataaattattcaatatatagaaagatggtgtgtgcctctgtgccactaaaaagttcgagcctccctctccaccatcgtcgaactttatcacaccctccacaccattccatcgctattctgcttgggtttaacagtttggcagttctgacatgtgggcccaggcaggaaaaatgtcgctcttgccctttcagtcgctggcataactattcttttgttctttgatggtgaaaaacatctgccatgtgatgaaacactcttcttttgttccgttagtttgccatgttgttatgtggatgcaaacaagtaatgtatttgataagtcatgtctattgccgacatttagtgctatcatgtgatgaaacagctagttatgtgaggaaacgactagttatgctatgttgtttcattctggacaattacactttcaccattcaacattgaaaattcattcattcatccatccatacatccatttatccatgactactcacacacacaaccacctacttcttgaaaatagcatacaaagtaagaaaaatgcaaatatagactatcttttcaagccacttaggcttagttcatttccctagttcccaagtccccactctcttttttcacgcgcacacttttcaaactgctaaacggtgtgttttttgcgaaaagtttctacatgaaagttgcttaaaaaatcgtattgatcaatttttgaaaaaaaaatctaatacttaattaatcacgcgctattggtccgctccgttttccgtgtgcactgttccggtcaggaacaggcagcaacaaacacaaccttaagctactgcatcaccctattgcccacttgtgcattgcctacaattccagcagcctgagaaccttcctgcatgatagccaatggagctgcagtagggaaaccaccaagtggtgccactgccattaggggaactgcatgaattggagtaggggcatgaggtgtctgcactccagtgtccaccattttatcctcccactgataatactgttagcctccaatctgaaagccaaaccattaacacattaattgtaagcaaacaaaaaaaaaaccaaagacaag

SEQ ID NO: 32022 - DNA, 5216 bp, Oryza sativa
cggacagtagagttgtgattgcaaaactccacccaatgagcctcacagatacgaggaaaaaatattaattaccccctaaactatcgcggtcgaccgtattacaccttagaccacaaaacaagacattatttacccccaactatacaaaccaggcaaataactcggtaattcgttcaggggggtaattcatacttttttttccaaatataattatgtgtattcttagttggtgtagtgaacagaagttttatactttgccaattattttgttgctacctccatttataaagtggtgatggatgtttttaacatcgatgagtttttcattaaaattctcttaatataattttcacaatttaatcatgatattgttgcatctattaatgacttcaaatttttttgacatgtgactacacacaatttaggacgccatcatttcgagatcggaggtagtgcagattattgttttttacacacggttttggacgtcataattatgttgtcacaatatagttcgatcaagtgagtattatataagaattcaatagtaaaagaacaaatctcaacaaataggtacttacccactcaatcgaagcttgatgacgagcacctcgtccagactcactcattccactaatggtctcaagtagtgtcacaccaaaaccgtagacatcattcttcaaagagacagtaccttctataatatattctggtggcatatagcccctaaatatcacaaaatacaaattcagatcctatcaagggtatgtagagaaaatagaaagaaaataatttcagaggcaacgaatgaaatgccatatatcttacagtgttccactaacgcttgcattaatgtagtcatcttgtaattcttcagataatccaaaatcaccaatcttagggttcatgttagaatccaaaagtatgttgtctggtttcaggtccagatggactataggtttctcggagtgggtgtgaaggtaaacaactccctgggttatcccttcaattatttttaatcgggaggaccaatcaagcaacccccctgcaaaaccagaacaatttgaagtgggacaatcagtaattataaacaacaaaagttaggatcaaattttctgtttatagtgcgtaccatagattaagttgcccaagtttccatttgtcatgtattcttcaaccagcaaaagaaattcttctttggcagaaacatttccatttgtggcattttctttcggcatttcaatttccctgtattcgtggcaatatcctacaagtttaactatatttttatgctcaagcattgaacgtagaaggatcaaaggatgctttttgggcatctcgtcatattgagatggaaatccatctgtatgtttcttgatagcaacctgaaccccatcagataaaacaccctgaaaagtgcaaattacacagtcaaaacagcacccaagaaagtcttatcaacgtgggagtagccatgaggcatacagtacaccatgacactagattaccagcagacatctatcagtaaagataaagaattattgatagattttggcaaattatgtgttgacaatactgcgtaataagacatgttatatgttaggaaatctaaatattttttggatcaaaataacagcaatattatgagtagaaacaaattatatatccagagaacttaatgattattatccatctgtcagcaatgtttcgtctgtcagatcatgatctcacagttaagatagagtgaggtgaaagctcaggcggcaaattcatttaggtgtgcgggaaaataaaaaaaaccgccaaaattttttccacgccaaaaagaaaatcgacgcaagaaaaaaccctgggcgccgccacctcgcggccccttccatggttcaccatgcattgccacctctccctccttccactgcatgcgcctctctccccatccaccgcgcacaccgcctcctcctctgccaaatccagcgcacgcccgccgccacctcactcatctctccccctccaccgcgtgccgcctccgcaaaatccacagggcgactgcctccaccacgcagccccctaaccggttgcctgtgccgatggtagataaggagaaatgaatcctacaaacctatacaaatcatccttaacttattatagttaatagcaattctctgcctttttttcttcttccatgctagtatcatgttttatcaaagttgttggctctaaatcaagctatcaatcaatcacctacacactgacacacgtcaactccttttttttaagcctaaggcggaactttgttccacttttatatttagaagagaattgacccagtttataaggaaaacctggcccaaaaaccatacaactgcacggttaattacagaaaaaccggctgaaacccgccgttacacaactaacaacaacggcggagcacaaacgcaggacgtcgggccgccaggctaaacacaaaagcgacacaatagctcctacatcgcagaagaggtgttatcattgccgagctaggcgcccaagcgacctagcagcgccgacttcacaaccgcagcgacactgaaggcacaaaggtcgccaaagcgaaaagcagcttcggcatccaacaatgggcatcagccaagccaccgaggagccacttccttcacacggctagcaccagaactccttggaagagactgcaacatgtcatcattgccaagcattgcctggattaatgccatactgctaggacaaattaaaaatctattcgattcttgaaaaaccgctaccggtccaccggttcccataaaaaccacccggttcacccgttttttaccggttcgattgcagggcggttttttgttgaaccaagccgccaaggtccctagttctggttttttccggttcaaccgccggcctggtccggtttcttgtactatgccgtagatcgagtcatgtttagtttgtgctttgttgacatcatcgcatggatgacaaacaatgcatcataggaaaaaatattcatttgtcgccatgaaaaaaatcagggcatcaatactattgaggcaatatatacatgttgctacaattttaaaattgttgctatccgtggtaataaatagggtggtaataggttattgcaatgatttttatttgatggtaataaattttgatgttgccacggaatggatgtggcaaaaaatcatattattgccaccactccatatgtggcattagttctacgtactaaattaaaagttcaaatattaatctatcatcataactatttattttttataacttgtattggctaggattcgaacccaagacttatcctcacatgcgctctcctttaccaactcacctcacctagacatcatttctgttacaaaatgcatatcgttccatttaagcctacctaactgagatttgaatctaaaagatttcaaatgaaaaagttatcacctataaagtttagatctcgttgagagctataattttcttataaaatttgtcccaatctatgtccatatgaaaaaaatatgttaaattatgagatgacaatttttttattgcaacgaatttgttgatcgtggcaatagaaaatattgaaaagtaacttgccatagccatgtactatgcaaattaccaaaaaattaaaattgtggcgatagaacattttttttcaacaataatgttttttggtgatatatcattttctattacaataaaaatactaaataaaataacgactgtaaattgttacaataaaatatagttatttgcctaaaaattatcattgaaatagtacattatattgctatgaattattttttgttataataatttaatggcaatagctcaattatcttgtaacgattttctgtttgttccttgcatcgtggctactattctaaaacatttcaaccatgttcaaatacacaataaagattaaatggctatttatgtgcgcatgatcccacacatcgaaaggtatctggtggacaattgtgaattggacaatacgagcctcatcggttatccatattttctaataagccaaaacggcttataggaaattaaaattaatttataaataaaacttttatatgtatgttcgtagcaaattaaaagccaacgctaaatgaaattacgttgagaaaatcttaaaatcaacatcaaaatcaagtttaaaatttcaagttttagcttttactcttattaggtaaactgatggggctctataatagttgtgcctgacataattgaactgggactaacgagccattgctatatatagttgctatataattgatcccaaaattaactaacatgatccaaaactgaattgctcccaacccgagcaaaccaagacgccaagttagaattgggactgaccttgtagacagttccagaaccaccttgaccaattgttgttgcaaagttatgagtggcagcctccaactcaataaaactgaagttcattaattccctctgtcgaacacggggaagttttgggattcctacaggaagtgaacttcgtcttgccctgatgacggcgaacatctctgtaaatccagctgaacatcaagaagcgttttaatttgcagcaagaagagaaaaaaaataatattctctattataaagaagtttgaagtgtattttcattcgttagaacagctaggaagctagcccgtgcacatgccggggtaccttaatattatttgaatttttattatgatgatttatgtgtggtgatttatttttctaaatattcctggactcattttaaatatgtatttttagtattttatttgagcattggctatgattttcttctaattaccctttcaacatttaaattttaacctaaaattactttgaaccatgtagtgttgaatttgtgagaaaatattatgttacaatcaagaagttgatttctatgcattttctaccatgtgtttcttttttaaaaaaatatttagcatatcatttttttccgagttttcaaacttcaagtaaaactttttcttgtactataaaaaaatttcccatgcgttgcaacgggtaaaggtaattttaatcttattattattatacggtttagttaaggcgaagttgtaaaattcactgtagaaattgcttggatatatatatttctagaaattcataaactgagttaggagtccaatcatctcaagttagcatgcgagtttttaaagagatat

SEQ ID NO: 32023 - DNA, 317 bp, Oryza sativa
aatggatgtacaccgtggatcaatggtcgaaggagtttattgatagtatgtattattcggtactgctctttatgtccaagggagccacatccagtacgtagtgaccgacgaagtagtgcaccatgtctgcaacgtctaaagcatagaggagctgttgatgctagcgctcgacgcgtggcgggtgtagactatcatctcattccggatgagtgtgttaacacaaaatttcgttacggttctttagtggatttggttaagaaaaaaaagtcaatcaacaaattgaagcctatcaagaagatggagtttaagaaagaatc

SEQ ID NO: 32024 - DNA, 8270 bp, Oryza sativa
tcgtgcacgcgattggattttccacagaagagaatactaactcttctgtttttggcatggttgttttttccgttggatttggcccagtaacagtctcgcaaacacaaacgcatgacgtcatcgccctttttcccctttttttaatccttcgtcggttccttttttttttcttcttgtgcacgcatgatgtaaagccaaatgcagattctctgtgcaaacgccaaagtcaatagtctcacagcccaaatcaccgttttctctttccctctttatttttttattatttgtatatggatatacatgaatttgtttctaaaataatgaagtttaaaatctattttcacataaatgttctctaagattagatttaaaattacacccacgagcaagtctaattccaaattggactttgtatcctttttaaaaaaagaaaataccgaaaagtctctttttttatatattttgtgcatagaaagtttatagatattttgtgcacagaaaatttagagacaaaaaatttatatgtataaagtttacagataaattttactcgcataaactttatatgcatagatttatgtagaaagttaggtttaaattataaatatatatatatactgggctacatatatacatgtgaactttttttctcaaatttgtacgtcaaaaagaaaaaaaaatgcctaaggatttttttttgtttgaaagctcgtgtgcttggtactgccatcgcgggcttgcgtgggctctaattcaaatagccaatggaaactactaaaaagttacgtggaattggaatggctcgatgggctttgccgagatgcatgcattcacgcagatgtgtaggtgtgtttttattgtcaacaccaatcgcgctccttttcggaagcgatcgctcacccattagagatacccaaaatatgccaaccttacttgaggtggggtgcttacaatcattgccataaataggtaagacttgtcccccttctttagtaggtttggttacttttgttcgatcctactatatctccgccgtctcgatcccttccctccgcacttctttctccgtaactctccacatgtcttgtggcgcagcagcggtggatgtggctacctagcacagcggtggcgcggtggcagccacgtctccgtggtgctgcaacggccaccaacacaacggcgcactggggggccacgttgattattaatagtttatttcgtgatgattccaactggattgggtctcttctgtatttgtgattattttgtgatgatttcgatttgattgggatttagttttttttgttagatttgtgatgctattttggtgcgtctgattggattgggattcagatcttaactgtccactgcagccacattccacatccatccccacattccgctctgctctacactgcattttacatcgacaaaactacatgcgttccggtagcacaccacgttcatcaaagattcatttcgatttcgacatgtttcgcagacaggaatgcaaatacacgcaaaacatgccgaaacctgttcgtcggcatggctgcaggcagtcacgatgccaggcagcagcaccctacgtgccaaccgtcccatggcgtccctgatcgacggctccgacaccacgttgcggatgcactggcctccgcaagccatgacgccacctctcgacccaagctggacaagattccaatcctcctcactcatatccaggctggacggagtgacgacgccacgctgattccgccttcgtgctgctacaaagctgcgtccgcgcccgaagacagcgccacgaagccaccctgggccatgccgcaccgggtccccatcaacgactccacatcgcatgcttcttcacacaacgagtaaccggggcatcgttatcattggcatccaagctgcgcgcggctcgtccatgtcacactctagtagatgtcacgtccactccattctaggctccccataaatgcgtgaggaagaaccttcgggtacgactatagtgggtggatagatattggaagcaagatgaaggtggcatgtgttattccttctccattggatggttaaatgttttaccgtcaacaattataccctcggtggaatgttgcaggatgttggggttttagcatacaataagagcataaatgagaagttcattagcttgtgatagatttagagacacatgtttaccttgggtgcaagccaaaatacacgaagttgtcttggagcttacgaagcttatggtaagtaatggatgatcggataagtctatcacataacaagacgttctggccattggggttggaagtcagaagaattcattttcatgtccgaacgactatggccccgtttggcacaactccaacttacctgcagcgggagttgtgccaaacggtccagattcacctttttttggagtggaattggcagagctactcctagaaaataaactagggggtggagctgggtttttgctgctccacagctccactccaccccaaaagacccactaccctctaatattttagtgtatttacacgaaaatgccactcaactaccccttcacccctcctttcctcacgttctctctcctccccccaatcttcctcccaatctcgagctagtgcggcggcgtcggcgggctgcggcggcagcggtagcgtcgacggcgacaggcagcggcagcggcggctgcgggacgacgaaggacgacaacgggcagcgcgcgtggcgcgcacgcgcgaccggaggctggcggcggcgggctgcggtagcggcggagagcggctgttgcgggacgaggacgggcggcacggcggcagggccagcaggtggcggcggcccatcttcttccccatcctccgacgacggccacaaccggttgtggtagtgtctgcatcggcagcatacgggggcagcgagcgcgggctatggcgcgttggcggcggcaggcggtggcggcggctgcaggcggtgttgcagtggccacgacgggcggcacgtggtggcgtcggcattggctcacgggcggcgacgtcggcaggcgactcacgtgcgggggcgtcggcaggaggcagcctgggcggcggcttgtgcggcggtgcttgtgcggcggcttgggaggcggcggagatgcgtgggcctcccggcggcggtggctcgcgggctgactggctgtggcggcaacgtcaaggcgacgcctacaaggtgttcgatgaaatggcaacaaaggatgtagaaatgtggagctgagtaatcttgccaaacactttttgacctacctcagctcctagaggagccagctctcattagagttggagtttggagttgggagttggagttaggagctctaccaaacagggcctatatattgtaaaaaaagaaaatatcgatttgtatgcgtcccttgtatgtggtggtgcttcttggttcaagagagagaacgattgggtagaaggtaagaagcccatgaagggtgccactgtaaagtttgtgcggtatcttctgattgcacattatctcatatgaaagtttatcaaagataaggagattgagttagtctattgccatgccataggtcaaaaattgcacagtatgcttaggcaccatgcgaatttgatatgatggaggaatatcaacgcattatacctagaatccttttggtgatatgaataggcacctttggtatgcatgaaatagggcctaacttacctgtgatgggttatttgtaaaaaaacttatcacatgtgagttacctgtgactattccacgcccatcataggtattttcactgtaacaggccatatctcaacagctgtcacaagaaacttacctatgatgggttgtgagatacgtcctgtcagggatgaggttaaccagccatatgacctagtaagagccatatggccagtttaccctagatcttaccaaacgtgccggacaacaacctcaatcctaacctaacgcagcgttcttatcacacccagctgccacctcctccttaagcctggtggtgctgcatcctctccaagccgagatgctttcacctgcgcactgttacaattgcacctcttccccgagcatggtagcctcgtcctcccgtatgtggttgtaattgtcaaatttagtgattttagtgacttctcagtgatttattagatattgcaataatgctttgaaataaaatattagtgacctattagtgactttagctttatatttgtgagtttggtggccagacatatgaaggtccaaattgatataacgatgaacaattgacatactatctcctagatatcccaccaaacaatgacattataacatggggagcgggggcacatgtatccaatggtccaagataaatctagtcacgaagataaaagcgcggtcactttacccaccttggcaagctcgactgcctcttccgaaacctccggctcttccaacacttccttaacatgcgtttatggaactacaatttggtgccggtcctatggacttctaggacgatgatatacctgaagatttcactggtggagaaaccatctttggtcagtcgaccaaatttcacaatagtcccggttccattaaaaaccgggactaaaaacgatttttagtcccggttaaaaaaattttgatctttagtcccggttggtaacaccaaccgggactaaagatgatttttagtcccggttcatcccctgtcagatgtatgtcagggggtcgaggatctttaatcccggttgatactaccaaccgggactaaaaattaccactttagtcccagttggtgataccaaccgggactaaagatcgatctttagtcccggttggagttatcaaccgggagtaaatatttctctcccacatccgatcggttaagtcccagacagatatttagataagattggaacatcccctctcttcctcttctcagatccaatcctcttcctcctcccctcccctcacttcctccccttcctcttctcctcccctctccttcctctttctcccctctactccgtcttccatcagccagccggcggcgggcggtggcggcgcggccacgaagggggaggcggcggcggcacggccgcacgcggggaggcgggcggcgggcggcgcggccgcgtgcgtggaggcgggcaagcggcggccgggcgccggctcgtttgtttttgttttttttataatttgtctttcactggatgtataattgtttagattttgtgattcattgcatcgcatggatctaagatgtataatttgtataatctatgatgtatttaatttgtgtgtagttttttaggatttgtgatgtatttgatctgtgtataggatttgtgatgtatttgatttgtgtgtataagtaacttaatatttgggatgttgatttggggatgtgcatcccattcgattcggaagaaaatacatagattaacactagccattagcaaatcaacaacaaaagaaaaaaaaaaggatctcgaggaactgtcgcgaactgtcggttcctctctttagtcccggttggtaacaccaaccgggactaaagatagcgatctttagttccggattcgtagtcccggttggaaaaccgggactacaaagggttctaaaccgggagtaaagagcatttctccaccagtgcaaatttgccacccatgaaggtctccatcaggtccaaatcttctccattgataacccacaatataggttatggaaggagaaagtgattgttgacgacgatgaacaagtacatatgggtacgttgcctgcgaataactacacccttggtacattggggatgatgaatgccaataggtctcaaaaggaaccatccttccttggtcaattaacatgataaaaagacattccttttgtcaggatctctctactcgttgtgggtatcaatgatctccataacatatataggctctgagcgatgaacacacgattgctaaaattctactatttgtaagtgctctttgcaatacaatatgttaaaatttgaactgaagatgttctacagtagtttgtaatcattttagggcttgttgcctacaaaaccgtaggatgggtaaccaggatggtttgctatatgcaagtatgatccacaatctcagagtaaataccaaactagataaagtaataagatatgtgagggtagaactattatcagtagcctagggcgctagatctggccactccatctcccggtccagtacatatggcagccatgatctaggggtccgacagattaggcccacccaaacctcaatgggagaggaactcctgcttggtaaaaccagaactacgctaaggactgtgccactgtggcaggactgttcgaatagtttgttaacctccacagtggagtacactttacccacatgatgctactaacaagtgtcaaccaccctatgtagaaagccgacacatggttacttcctacactgaacattaccaggtgactttggggctttcgtgacatgtcatttcgtaacctgatacaggttttcacgacaagtcctgttgtgccatgaatcctcagtattttccctaactcccctgggatcgacatccataggcattcaaggattccctgttttagcttgttacttagccaagggtgttccacttcacccatgtggtcgcactttttatatgctcgatatgttctaaggtatcttacgttgctcagggcttcacggattttcctgaaatccaatcccggacagaattctggcaatgcaagctatacacaaacaaacaaaatccaacacagggaacaagaaaaggatgctacttaactactaatagagccacttgatagagctcaaataaaaaaaaaggtggaacgaggtcaatcggagctacgaattaatttcaaagattaattgattctctagacaaaggacaaatgatatatgcaatttcaggaggggaatattccatgtagatgttgacacgtggggtcaaatgtcagagagacacaacccattgggcacaccatggaccaagttcacgggcgactggctcgataggaaatagatggccatcattccataggcctctaggaacgatggctcggccaattcggctggggcaaaaacgcaatctaacagggcaacgctcttgaaattttttatttaagtattttaataatattttttgtttaaaagttacagatctggatgcctctcgttgtctgggatggttttttcttaaaaaacaccctcccagaggaagttttttgtgatgtgctagacgaccattagccacttgcaaatgactgctttccgggggatgtagttttttgtaggcggctatgttgcgaccctccccgaggctttttttccctcaagagtgggctgtctgcaaaatagcggtgagggcaggctggtgtttttttaggggtgcctttgccggccttacgaagagcatttattttttccatagggggccgcttgcaaacctagttgaggtggcctgccattttgcaagcatccccttgccgcccttctgtagaggtcttttttggcccagggtataaaacccccatctctctcctgaaattttttttactattccatattataatatttcaacctattttacatattttacaaatacaactcttatacccacacatcaaaataaacaattggcagggaaaataattatgcaagaaaataaacaactcaacaaaatttccttatctcacaagaaaaaaacacactccccgagggcaaaaggggccctcctgcaaaatgccagccccctcgactggggtttgcaggtggccacctctggagcaaaaagtgccctctaggagggtagcaagggtgccggatgagagaagagccttgccacctttgcttccctttgcaggcagcgctttgcggggaaaaaaacaccctccttgaggtttgcaaggaggctacctgcatattctacctctctgggacgccctctgggagggcattttctagagggcgttaggcatctagtttgtaaatttatcaattgaaaaaatatctttgaaaatatttttaaaaaatatcatctctgtggtctgcacaggttagtgactagtgagcaatccagtgagataacacgccttttccgtgttcagttgcttcgtttagggcaagagatggaagtccatctcgtaggtcttatatgaaaatggtggcggctagtattcgccactcacaccgccaccattggaattttctatggaccactgttggtgtcgt

SEQ ID NO: 32025 - DNA, 1828 bp, Oryza sativa
aatttaatgaaactaatttggtgtacagatatttctattttttttaaattcctataagcttgatcaaatccaaccacgtttgacttaacataaacctaaaatatcctattaaacgcaccactacttaaaaggagagttgtccgtctgctccccttcccaactccatgacgcagagagcgacccatagacctccttacttgagagtaatcactctcccttaaaaacagaaaagaaaacctaaaaaccattccatcatatgggccgataaaaccatgaaatggcatctattgcaacacatgggcatttcgacctaatcaatgcgtctggtaactaaggatgcccaatagtttggtgtaccataagaaacactattccatttcagcgataaataaaaggaacaaatcagggaaaaagaagtgtacagtgaacaaacatgcagcacctggatcgaaggtggtcgttttataggcagcggccgacatgcttgtggtcgaatgccacttgctggctgttcctgctgccgtccgtgttgaggaaccgaggtatgctgaaaaaaatatttctgttgtaaatattttatagaatactatcgatcgcgagccataaagatcgggcgccaacaaaaacatgcacacaagtaaaaagtacgcataactgtatacaagcaagataaaaagaaatggcaagagacctcaagggatatgatttaaatttaaacatcaagacatttttgctttcaaaccatatatgatctaatatatgattatcatgttgaactgattacaatcaaatattttaaagaagatttatatcctgatgaaaaaaatatatgtatgtttcaacaattagatttcggatgtttcataggtgagaagaaagtgtttaactaaaatttgtcagtgtttcatatttttagttctcttgttgttgtggaattttttaatgttgcacaaaatattatttgaatgtttgaatgagtattttctaatgtgacactaggtcatttgcaaatattgcacataatattttgtaatgtttcaatagttacaactcaatttttcatgtatgataataaaaagtttcaacaaaaaagtatttgcaaatgtattttatgttttcatataattttttgatgtttcgcttgttgagacttaatgtgtcatgtgttggtttaattgttgcactcaatattatttatgctgcatctcattgcagcatttgataaaatgatggaatttcttttacgagtggtgaaacaatggttgatttttttaaaaaaataatatatacttttcattaaatataatcgtgcaagatcttattttaaatattttgttgcaataaatataattatgtgatcagattatagattagataaataattcaaagaaaagtttgataagaaaatttttatacatttgggttggagggggaggagttcactgtcatcattttgccaagctcctttccattgtcaccataattatagtgattttttttgtatttttatggtcccacataccatgaactgaaaaattatggcacaatcttcttttgctagtaaaattatgggtgggtcacttttttttctagtcacaagttatgcgaatgcggcacaatggtatggtgaaggggtgacaatgtcagtacaacttatttgcttcttctagcgtaggtattgcatgaggccaaaagattgtgatcaatgatggcattggtatgacggagagcagtgcacatgaagtctaaggcgacatatattgtatgtacggaggttatgacggagagtagtgtacgtgtgtgcttgtcaggccatgtgggccccata

SEQ ID NO: 32026 - DNA, 4731 bp, Oryza sativa
  unsure (1)..(4731): unsure at all n locations
cgcgcaagaacaatagtaacatgaacactcgttgcaagcattccctccatcatctgatccgagatgtcatcttgcacccggcgcaacttcttggaaagagcagtggccgcgcagaagaggcacacgatgttcctctcctggcacgccgcgatgagcgtgtgggcgtggcggagcgtcgagtcgagctcctccagagcagctgccatggcggggttgctcctgatgatcaccgtgtcctcgagctgggagagtatgctgctcaccctgaccactcgccttctgatctggacacactcctgcttgttctggcgaaccgtctccacggcctgcctgattttgagcgctaattccgcgatgtgcctcacgctgcccaatgaatcagccatcgatccttcctaccgccttgcagcatgtacaatcaacaaattaattcggatttgcgactaaaccaaccggatcaagaagcaagagaaaaatatatatagcactaaaagtttaaacaagctcgcactctatcaccaaccttagcctataatcttgcgaatttctgctctcctcgcggtctctgcctcttccaatctgatatgaactgctcactctcctcaagataggccagcactggaggatagctatatatgtactcttttcatattactccctcctctaaatgtttgacgctgttgactattttaaacatgtttgaccgttcgtcttattcaaaaaatttaagtaattattaattctttttctatcatttgatttattgttaaatatacttttatgtattcatatagattacatatttcacaaaagtttctcaataagacaaacagtcaaacatgtttaaaaaagtcaacggtgtcaaatatttaggaaaggagagagtatattacaagttgttagatttttttagttaaaattatttaagtttgatcaagtttatagaaaactatactaacattttcaattcaaagtaaaatattacttcctccgtttcacaatgtaagttattctaccatttctcacattcatattgatgttaatgaatctagatatgaatctaaatagatatatgtctagattaattaacataaatatgaatgtagaaaatgttagaatgacttacatttttttaaacggagggagtatcagaatatattcaatgttaaatgtaataaaaataatttggtgttgtaaatattacttattttaaaaataatttaaaaattcaaacgatttgtaatatgggacggaaggagtagtatatatatacaagataacgaaggtagatgctacttcctccgtttcacaatgtaagtcattctaatttttcccacattcatattcatgttaatgaatctagataaatatatatgtttagattcattaacattaatatgaatgtgggaaatactaaaatgacttacactgggaaacggagggagtatattatattatgctggagatcgatgcaaaacggactaaactaatgatgccaagtacacggtgttggctagctaggtcaaacgtgtgtttgtgctaatttcttaattgtttccgtggaaggtcaactgtgttaattaggatcccgaactaccgaaggccaacacaaaccattatcgctatcggtttgagaaccaaaagaaatcgccattcctggcaagtacgtgcagccttgacagttggcaccaacaccaacgtggatgatgtttcgcacacatgcacacacacacagctgatgaacaagacagcagcaaacggtgattgctatcatgtgcaaatttagtcatcgttactatttaattacatccttctggaaatcaaattaaatatatctgcacaaataaaaagctttatccgaccgttggttgtcctacgtacattagtttgttccattttttagaatgcaataataatgtatccatcctcaagttagactacaattaattgttagaaatttggtcataatttagcatattttaatccaaaattttaggacaataatcaagacatacacaatgagaagcgatctggtgatgaggctaaacataaacatgagcatgcttatggcaaaataagcatagacatcgttgacgttcacatagaatttcaatcctatggataacattgtgaacatgtaaataacaagaagaaaatcaaataagcttagaatcttatacccagggaatggtgcagaagatgttgaggtattcatattgcctccgttgatgttgtctcatccgttctctccattagaagtgatcgtgaagcagaaacagaggaagatgcaacgttatcgtcgaagaacgaagaataggagcagtcgcgcttgaagcgctacccaaaaatttgatcgcccgcctacccatgcagtttctcaagcggacggagttccggaagcacatgctcatcccgtacacctgtgcacgcaggtgaacagaaccgaggaaggattctacagcccaagaacagagggggaggaactcgaagtgcaagagtcgggaagaactgatgttcttccttctggtcgctgcggaatatatatatgcgagtgtgagagtaacgttcaggatcatcaactgtaacatcctgaaacactaaaatttcaaactttttaaaacttttgcatcatgctggatgttatggttgttattacttgccaaactgtaaatcatctcaatggaaaaatcaaattaaaggtgcgcatctaaataataaatacaatttacatgaatacattgttttacaaataaattcaaccaatgtgctaatgtattattaaaggtcacattagaatattttaattaactttagaaatatcagagcctccgagttatatagggtgaatttaggatgatataaagtaaagccaatttcattttgggaaatgatgaataaataaataaataaatattcaaatcaaatatttcaattcttaaacccaaaatgtataggttacatctcaattcaaaattccaatccaagacattttgcagtttggcccctccatcttttccttttcccttttcttccttctctctcttcttcccagccgccactgttcctgggccaccaggtgctcgaccagagccctagcccaagccgcacaccgagcgccacacctccgagccacgaccgtgtcgcgcacgacaggtgtgccctcccggtcaccttgcaccgtgcgccgcgccgtgtgccacgccacgcccgtgtgggcccgccgcccgaccgagccccggattcccgcgagtggctgcgccgccacgagcgcctgcttcacctcgtcccatcacgagtcgccattgaagtggagggataacggccaccacgtcgcccggcgtcaccctagaaaataggcctgcgcctccctactaaagccgttaccactgcccgtcgctgccaatcatgttgccattgcatcgccatcacattgccatctcgtcagccctagctgagaccgttggataatgcgatgtttcttccccagctagcactccctcttctggaaccttatcacataggcaatcatgcccgatcgaagcattgaacccgaatcctgggaggatcgaaccttagccgcgtcgtccacccttgtccgattgccattaggactctagctcagctattgtgtgttgccaatcttatccccaaggtttccttacaccctaagctaagccctcatataaaccccatccgtctctgccttcttcgtgaaatgcatttcgtcgaacaccttgggcgcgtgttgcaccttcttctccgctccaccactgcagccgatcttcgccgtcccgccgtctctcggtaattcctcactcctgtgacttcttatagtccccaagtatctagtttccccgtcaatttaatcaattagggccgtaaccatgccaagcgcgacctccgaagctccgcacatggaggtcgccgtggacaagccatcccggagctcctcctctccatctagctagcaaaatggaaccctcacacgccgtagatgccaacgccctcgtcgatttggtgggaaaccctctctaccgctctagcccatagctacccgaactcggcttcatgacggctcttggcttcatgacggctcttggcttgacgccgtccacgcgccgctatgcgccgtggctgccgtcgggaagtcgtcggagcctcgccgcaccctccccggcagccgccgtgccgacctcgcgccgtaccggctgcgctcggtcgagcccagccgtgccctggatgctgcctcccgttcggctggaggtagaagaagggtaggagagagaaacagaaagagagcagccgggcccacatgtcattagctccatcctatttccctttagaaaattaatcctgtgaaaaagaaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32027 - DNA, 4109 bp, Oryza sativa
ttcatttgggcgaaaatagaccccgtaccatagcaatcaactacagctttctacaggaacagagccatgacctaactgaccttgaggaccctttcatagaagatgaaataaaataagcaatctttcacgcaagatcagataacgccccaggtcctgatggcttcacaggtgcttttttcaaaaaatgttgggagattatacaggaagacgttgttctggcgataaatcaggtggctaaccacgacactcgaagcctttggttactaaactcggcctacattgccctcttgcctaagaggagtgaagcacttcgagtaggtgattatagactgatcagcctcattcatgcctttgggaagctcttctcaaaattattagcaaacagattggcccctaagctccaacagatgatctcaaaaaaccaaagcgccttcaaaaagggaagaaatatctaggacaatttcctcttcgtcaacagcctggtgcgcgaactgcattcctccaaaacctcggcgatcctcctgaagctagacattgcaaaagctttggacactgtcagttggccataccttcttgatagactcagacacctggggttcggagacaggtggattggatggatcatctctatcctatctacgtcctcttcaaagatcatcctaaacgggaaagcaggtgacagcttcttgcacggaagaggtcttcgtcagggtgacccactctcccccatgctctttattctggcgatcgaccccttacagagattacttgctaaggcacaggaagagggcctactccaacctctccaaaggcggacatctcgtttcaatgtagccttgtatgctgatgacgcggtggtgttcacaaggccagataaacaggaacttcagacagtacaggcgattctccataactttggactctcaacagggatggtcactaacctatctaagagcgaaatctacgcaataagatgtgaagacctggacctccaagatattatctcccctttcccagcgcaattgaaggccttccaatgcacatacctaggtctccctttgcacatcagaaagcacaaaaaatcggatgtgcaaccactcattgacaggttttcagctcggcttccgacatggaaaggaaaattgctgaataagacaggtcgaacggttttgatcaaatccaccctttctgccctcccaacttatcaccttacagtcttccccctaaagaaatgggctaaaaaaaagatcgacaaaatccggcgcggattcctctggacaggatcagaacaggcacagggaggacactgcttagtaaactggaagagggcctgcagaccaaagaacatgggagggctgggcataacaaaccttgagctcttcgaccgttacttaagacttcgctggctctggcaagaatgtactgcagtagataaaccttagcagggatctacccttccttgtgatgaaacagatcgacaagttttcagggcttccacggtgatcaccttaggaaatggcaacaggacaaaattctggcatgacagatggcttgaggggtcatcccctaaagagctatacccttccctctaccagatagcaacaagaaaaaacaaaacggtggcacaggagcttcaagacaaccgttggttgagacagatgcgaagaatgaacaccacagttcaagtcagagagttcatccccctatggcaccaaatccagcaggtcgttctacaagagcaaatggatgacacgattatgtggcggtggacttcaaatggaacctactcggcaaaaaccgtgtacaggattcagttcgttggaggcatccaagataacaggtcggatttcttttggaaggcaaaagcggaaaataaatgcaaattcttcggttggcttatgatacacaagaagattctcactgccgataagcttcacattcgtgcttgggacaacagtcacatctgccctctttgtggtgtagaactggagacagccactcacctcctcatggactgctcctttgcaaagcaagtctggagactcatttggcagaaagcaggccttcatatgccactagcctctcttttcaatggagacatgctagcatggtagacagcttgcaggagagagatggtgaaagaacagagaagaaattttgatggcctcttcatctacacagtttggggcatttggcttcaatgacatgctaggatcttcaagggtgcttatggtgcaagtcgtcgagtcaataatcgacatgtgcaaggcctatgatggagcacacaatttagatgagtagttctcgtatcctcctgctagttgctctacactatctaaaaattcctgtcaactcctctgtcaacacctcggaagggggtccccatgggatccttttgtaaccttacttgtacaaactcggtttccctctcttctccttttatgaaataggcagagctcctgcctttacccctcaaaaaaaacttgtagtgattcttcccattggtgataacttgttcagtcaacaagtttattttatcttctttagatggccaaaccttcaacttgatcaactctgcaaatggcctgggctctttagaaatcagcactatttggcaaatttacacaactgaccggcaccatatgagcttcaagatcctcattagcgcatctgaacaagtacctactccatttatcaaatactagcccttgattgcaccagaaggatagccatggttctagctgctactcggaaaaggtacgtgtgcaaatgactcgagaaggaggtacggtggccttggttggagagccctaaataccagcacatttcgactgccttggatcagtcttggaattgaccatgggttcaaatccatcttggtgacgtaccacgacatgctctggctgataaccggatagagaatgtgaacgcctacgtcttgtactttgtctcaagcaccttgtggactacttgtcagcaattgctttgcgactaaaccgttgaagcttgcattgtaggatcgaacaacaagaactaagccaaccacaaggggacgggtttgaatggttgtagtaccaaaaaaccaaaacttttagtggaaatgaaagtcaccctcaaattcgatgtcacgcggtctaaccgaagtagatgcgccggtctgaccgagattattgctctggtcttaccgccgagatcagctgttgtcacctgaggctcacgctggtttgaccgccgttactccgctggtctgacagtcatgatgccgtcggtctgaccaccggtatctcgccggttggaccatcgaacccgagcaaacacaaattgaagatctctcaaaatagatgacaactttattacttctttttgtgtttacaaagtgcaacaaaagcactcctcatgaaaatctcggctaaactcgaaaccctaactattctcacaactcaatgctctctaaagcgatatcgggaggcctcaccctccctctctatttatacatgaggtaagcagcctaaaactacgaaccaaactcagacaagaagtcctaatccacctaggaaacctttccgtacaagaaaccaactttacaaactccaacagtagcaaatttggactccttccaaattcgactctgcatcccatacgcacacaatatctccatcgtgtgccatatggaatcttcaccaaccacgtgcattgatctttagcctaagtatcccgcataatatctaaccgttcggacgtcaccttatctccaagttgactcccgatccatattccaagaccaagctatcaccaacttgactcattgttagcaaacaacagtattacatacgcatagtatccatctagaagccataaacacatattaatcacggatatccaatcaaacaacccgaaatcgaaacctacacagagtcagccgatcagaccgtggtctggctggtctgacagctcgatacacgccaatctgatcgcaacccatgcccggtctaactggaccaaatcatccagcagcacctaggcccgggccaagtcagtggggggaccctatcgggctccttcccccccaaaacaaactgtacgtgggcagaaccgttgttgcctgatgg

SEQ ID NO: 32028 - DNA, 1137 bp, Oryza sativa
cggaataagaataaaaaacactttcattttacatgcataatgcaggcacaatagtgagcttggcatctgcttcagcaaacacaacacaatcctcagtgacattgtcaccgccatcaccatcaacatcttgactggcctccagtgggaactggatcggtgttactactgagaggtgccgcaactccagtcagatcagcgcttgtagttgattgaaccttgatgtcacagcatgtcttgagcatactgttgagcgtggcaatcgtccttgtgcacagtttgtttggaatatcaccgctggttcctcctcgacttgagctatgtcacccttggtttcgtcggtctcaattgaagacaatgttgttgccgtggcaaacaacatgactgagggcatggatgaactcgtggcaagaacacaggttcaagtgtagtaggagtgctctcagccacaaactcagtgttggcgtacatcggtcctgacatcgaccaattggtaggcattaactctgcgccatccgtgggacaagcccatgcatgctggacatcgagaggcagtagatgttgcggccctaggtgactgctcgagccctctccacatcaccactctattgacgcgaaattcgtcgttcacatgaaagccgagaagatctgcttattttcagtgcacgtcatatcaatcgtttttagcgcataccatttatttcgatcctatatctaataagatggacatagatcgatgatcaagaagccgatcggccagtagaaacgtgagatttatgctatcatcggctagcactaagctatgcataataaacaataaacgctatttatcaaaggcaatcttgatagatcagaccgaactgaagatagtataagattggaattaattgagatagatttaattgaagattatacaaatttgagtataagccaatgcaactcaagatgcaatgagataatgtaatatgaaccaatcgtcatgatataacgtgatagatgtaaatctgatggttaaaatgtacattggctgagatatatgttccgatgtaagtaaattaaagtgtatatcgactaactaaccgatatatctgatagctcaagtctaatataaagataactcatcgtctagcactacaataa

SEQ ID NO: 32029 - DNA, 979 bp, Oryza sativa
caggtctgacacccctgctctgcataatagtaatgagtgccctagcatcatccatacgattttgctcacacaggcattttatcacgatattgtatgttaagacagagggctcacagccataagccaccagcttccccagtagatagtaggacacatctagcctcccctccgagcacatggcaattatcatcaaattgagaacgatattaacagggagcacattgcttgtcactatttcatcgagaagatggtcagcctccttctgtaaactcatgttcgagcacccaccggcaagcgaagaaagctccagcagcttggcgccacaatccaacttggcaacagccttcaatgctttccgcacaaataaaaccacccagcctttggggaagaacctcgctatcgaaataaacataacatggtcagggaaaaggccactctccagcatcttatcaaacagattctcggcctcacccaacttcccatccttgcagagcgatgccatcagaatagtgtagcacctcaagtcaggtgcaacacccgtccttatcatcaccttgtagatatccatggcagcaccaacccacttgctcttacaataccacctgatcatcacattgtaggttgctgcgtcaggctgaatgcccctgtcaatcatctcatggtacatctggaggccatgatcgacacgcccatgctcaaacaatccccatatcatcgtcgtgtaagcgtacgcatccaactgaacatgctcatcccccttcatcctacggaacacatccagcgcaggctccagccgcccctcccggcaaaacacccggatgagcgccgtgctgagctccctatcgagatacatccctttgatgagcatcagctggcacatgtcgctggcatcgagggagcgcctggccttgcagtatgcgaaggcaagcgacctgtagacgcggacggggggtgtgagcccggagcgaagcattgcgtc

SEQ ID NO: 32030 - DNA, 1764 bp, Oryza sativa
atacaatgcatgatactatttgcagtttctttgatagcatgacgataaattgtgaatggtgcattttcgtatatgttaactggtgggaacattaaaagaacattgtagtgtacattaacacaaccttttgaaaaacgaacgttgttgtgttgtgtacacattgttcaagtgagacccacttgatgactataggcctgtttagtagagctacaaatttccgatcgtatatgtttatatgttaaattatagcggtctaaaattttattgttttatctaaaacatgaataaaatgatttattcaaatgttgatcgtaaatctaaatttatggatttgtagagccaggaatacccagcaaaaaatatcttaaatatgtagtctaagaagctgtgccaaatagggatgaaaacagatcgaatacggtcggaaactagctttatcatattcgttttcataatttttttcggaatagaaatcggaatcggaatcggaaacccggatatgaaaacggaatcgaatattatcgaatacaaatacggagcgaaacgaatactgtgacgaatattaatcggaatataaaaactcctcactactcacaaacgatttttgatattgtgtttctaaaatcatgctctatcatgttattgtgtttctattgctattattttggcctttttgtgactgttgttttatcaattaaaaatttgaatatcaaaacttcaaatgatattttgaagcagtaaataaatttagctgaaaaaatcatgaacataaaagttgtagaactcatcaagacatataacttttattttggtaatttcttcatccgataaagtgacagtaacattgttcataaaatttacatctatctttcaaagtttataaaaacaaatgagagatgtaaattttgtgaacaatgttactatcactttgtcggatgtagaaatgaccaaaataaaagttatagattttcatgagttatacaactttgttgttgatgactttttcagttgaaatcatttagtatttgaaaatgttgtttgaagttgttatattttcaaattcaaattcaaactattcaaacaaagtcatatagaaaaatgaccaaaataaaagttatagatcttgataagttatacaactttttttttgacaatttttccatttgaaatcatttactacccaaaaaaattatttgaatttcttatattttaaaattcaaattttatatagttcaatcaaactcagatggagaaatgaccaaaataaaattggtagatctcaatgagttcttcaactttgttattaataactttttcatataagttcatttagtatcataaaatttaatttgaagttcttttttttaagaagtctgatttgcctcctctttggcttgggctggcttatgggccttatgtgttgtcggatatccgatggaaaataccggataatatccgacggatatcacctatatcatattcattttcatatccaaaaaattatccgaatttgaaaatttccggatatatccgaccgaaactatccgaaccgaaaaaaggtccggtcggacggaaattatccgaatcactttcaaccctagtgccaaagaagacctatgaatatagctttttgtagtctgtagggatacttgcatctcgaattttttttatttttaattttttttattaaaagttttacaaaaataattttccattttgaaaattgacggaagtagtcgcctaccgccctctgggagggcgatt

SEQ ID NO: 32031 - DNA, 1529 bp, Oryza sativa
tgcaaatgggcggcgagggggcatggaattttgcaggcggcccccttgccgccctccgctagggcgattttatactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattatagtgaagaatgttctacataatctcaaatctagattacgtattaccaatgaataggcttccattttcgtgtgttgtgtgctagtgggaaagaaaatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcatcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccaaagctaggggcgctcgaaggcaaacgaggtcctgcgaggatggatcatcaagttacgacgggg

SEQ ID NO: 32032 - DNA, 3268 bp, Oryza sativa
  unsure (1)..(3268): unsure at all n locations
ccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctataagagcggcaaggagtgaccggtctgcatcccaccgcttcgctgggtcacggtcgtccgccgccgcctcaacaagcctacaaagtggtagaaggcctgccgcacgcaacctgtatagagcaaaattcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggtcttgcgcgcctgcttgttgttccttcaccaggtggtcgcctaccatcacttgcctgtccagatggactagcatttgcgccgcttggaacttctgcattcttcgggcatttcttgtaagtatggccgagcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32033 - DNA, 5741 bp, Oryza sativa
ttcagaatatagcacttctgcttaagcatctagtcaaattttacaaaggacatgatctgccgtgggttcaactgatatggaactcttattataacttcaaagtgccacatttagtttggaataaaggacctttttggtggagggatatagtggctctatctgatgtcttcaggggaatctcaaactgccatatcagaaactgccatatcaggactggatcttcagctcttttctgggatgacatttggaatgataagataagaagcaatgtttttccatctttatatatggttgctttagataaaaccctctctgttaagcaaatgggttctactcctcttgaggattgtttcttactgcccctgaacacccaagcttatggagaattcactgttctagaggaggaatggtcctctctctttgcagaacggtaaaggtgatgaatggtctttcatccggaactgtgataaatacacagctaagaggttttataagctcacatactcaaatgtgcatgtgccaaggccttttgtctggatctagaaaacaaaatgtgtaatgaagataaaagtttttgcttggcttttattcagagacagacttaacataagagatatgcttgatagatgacattgtgcaaaggaaaacaaagacctcacttgtgaattatgcctgaataatatcagagagacaagagagcatctctttttcttctgccctttcagtcaacattgctggcagcatttgggaattgcatggaatcctgacctagaatttttccagatggtggttttggctcgcattcagttcaataagagaggtttcttggaaattttcttcattgctgcttggcacatttggaagcaaaggaatgggaaaatctttcgcaatgagcttccctcgttcagctcttggagggctttattctaagccgatgttcttctgcatttgtgcagaatgaaagatccactaaaacatattattttttattggttacaaacagtgtaatcctttgatctttttgtttcccttttgttctcttgtaatttgtatttataaaattacactatgaggcaaagtcctggcagtatttccagtcaaaaaaaattaattgcttcagtttagagagttttttcctacaggcaggtgagatgaccaccagacaccagcacagtagctcattacaagagcagaaaccagattgaagattgtttggcagctcaaactgcactgtgtaggcagtagcccttgcttgagaagtgatggccatgaccttgagcctttgatcatctggaacagcaacacttaggtacgcaagaagctcttggaagtggcgatatacattgtgtaaaatatccatcaattactattatccctttcatccatcagaattgtgttacttgctgtctacggtttaacatggcactctaccaccaaattttgttgtaaacatggtatctaaacactgcttgagcgatccaacaatttagcactcagaaaatctaccactaagttatgtcgacatttattttttcttattaacattttaagcttctagcaacaacataaaataggaatcaaactaaacaatatgcaggaggcgtgccattggtgttggtatttcttaacgacattactagaaatataattcctaacaatggcgcagaaatacttctaatatattatggttacatagtccatctgcaagcgcatggatataccattgtagcatttcacccgagagtattccatgggtatcgtatatattttatcccgtgggaagatcatgtagagagaactcaactaataatttatatattacttgtgataatcatattctaagcaggggttaagataatccaagggtagagtgacacacaagcagtaaacactcattctcataatatatcatctaagctaagtggaaagaaaagagaaagaaaatctatttctatacttctaatatacatagtatacatacattctagttaactgatatactagctaataccctctatcggatgccctcctggtactttgagaagccacccctgactgccgagttccttacaacaacccgtcatgaccatacaactggggctaaatacggaggaatactctccctagggaattaacttaggattatataccggcgcggaggaatacccgtactgagatgtcaccatcagcggcccacctctcatctcaatatataaccccaaataatgatatcccgtaatctagacaccacgtctaaactaccagatactactctaatatcatcgtcatgacatagagtaattgcatatgcaaacattatacccgcaccaaagcatctcctagataagctagccgtatattcagtataacatgaacataatataaagtaggtactcatatacttgaaagtatttcaataccataaatgtatttagaagagtattctaataaaagtacaaagcttacaaaagagaagagaaaagctactagagccatacccgaactcttccgaaggcttccggactcctgatttctactctatccctattccaccagctagatactactaaactaaacttaagagaaatgagagagctattgcttgaggtgtgtgttgaagtgaagagagtgaactccttaaataggcaggtaatgacggttatggtggttagaaaggtcggtaataccctccaaccgccatagggagtgaatctccaccgttcccccaaaaccctgcatccagcggcttcacggtaggttcggccgaaccaggggccggcccaaccagcccacatttttgctggtggcctcctctggtattcctctcagtagacttgtgaattttggcccagtgtgtcgtgttaattctgagttcttggcccattcatacataagtctggttctcgacatcgtccgattgatttatcgtctgagttgatgtcgattctcctccattttattgtcattctctgcaaaaggttagtatacctactactagtggaatattattattctaacatatttatgctttgcaagcatcactagttctcctctattttggtaatattgacggtcgaaactgatcgataacgaccatcaacaattggcgtgccccgtcatctagttattagaatgtctagttaacagatcaatcttctctctcaattttccctccccttcatgtcgtacaaaatcgtaaagtggcatcttctcgcagaccatgatactttggattgcttctttccaatttcatttgatgtgctcaaatctctgtcagattctattccaaagtcccttggaatcaagaatttttggaacgagtgctgcgaatgtcttttgccacttgtctaatgtaacatgcctttggtgccgccttgtacttagatggaacactgggatcattgaagtcaaatccttgctgttcaagtgttcatttggagactctttaagtacatgtgttattatttgcacttctttggtaggcattccctcgcaagtaatcaaagtcctgaagtttcaaactcagtactttgtttaatctgctttgtgcgaacataaacagcagtaaaatattgcaattacatactagtgatttttgatttgctgatcttgtttgggataaagaaaattacctgtgtacagtttgttcatattttgcttcattatgcctaccactcccctggctggtgctgcactgctctgcctccccacactgcctgtacctcgctgctccaggacatataaatcttcctgctaattagcaatgatcagtagtccagtacatactcaagatcaaatcaatttttgggacctgtacaaatttcctgatggttccttctacaaaaattgaatgtgcaatatctgaatgttgcctatttttgcatgtattgttttgctgaaactgagtgtgaattgattcttgtgatttttttttacagtatgtcagttccatttcagaaagcttagaaacaatgtgatccaaactgaaatttagttttcctaagttgcactatgtgattagttttatctgtatacatccaaatgaaaaatagtatgcatctaatcttgttcacattgagggatatctctgaggtaattactgccctgctatttcggtatggtatgcatatattgatatatactggtccctgcttaatttatattgggctttacatcttcagaatagtccagaatgctttacatttcagcttttatgagctaaattaacatttgttcttaaataagttcaccggccttgaaatatacaagcatttgccagaatacattctaaacatctctcttttgtcgaaatgagcgtttttgtgtgtcgaaatgaaccggtaagaaccagtttggtatgctccgatctttttgtttgtttatgtataataacttaaatgatagtattattatttgtagaaactatgatgatgaaacctataacactttaaaacatgatgaattcaaaccacttttatgaaattgataatgatcaattgttggtggaagaggaaaacaaggaagattcttatgcataacgtatgcctggatcttattcaattcttatgtgtccaacaataggtgtgtcagcatggaattgaatttggattggtatggtgtgaacctttgatcccatatttgtatttttctttggacatttgagctgaatgtcagttgaattagacttattgtaaagcaaactttatatgtaaagagggcatatctgttaaaagatatttggttaattccactgacttgaaaagttattttttaaaaaggaaaatgtgtgctcctgcttctgatgatattctgcaatgagtatattcttgcagttgcagtgtattagagttcatttatattgcctaatggcatgcatagcacgtacacgcttactaatgtgtagcagggtttaccaaaccgtttgagggtaaccctacgtttgacggttactggctttgtttggcagccagttctgctgcagcagttgaaaatcgctgcagctggcagccgttttgaactgctgcagccgcagctgctgtcgaaaaatctcttccgaacacacccactgcggtaactgtgaggtataccgtggtttcaaaaactgaaaaggttatcgcatgtaataacctggataaacgcatgataaccatatggatagtattatgttgtatattattagaatgtcttgttaacaaacatcaatcttctctcaattttctttccccttcatgtcatacaaaatcctaaaaggtcattttccattttctctcagaccattgtactttggactgtttcttttggaacttcgaacacggctttggtacgtttgagtaaaagtgtacaaccacctaaccctccgtctcaaaaataaggatacagattcatagtatcatagtattatcttaggatgggggtgtcctatagtatggactaatatattaggatggtgaaaaatgacgtaaaccttgaattactattttttatttatttactgcgttcaatttaatttaaattaatctgtccctaacaatgtgatgctattaggcccatagcccgatacattaggccgtcccgtttcgaattttttacatttttaatttttttaatatttacagaaataatctatcggcgaaaaaaattaaaaaaaaatagaccctgccgccctccactcgggcggcaagctgacgtggcaaacgggggagggacgggcggtgacggcagacgggtggcggagggttttt

SEQ ID NO: 32034 - DNA, 18132 bp, Oryza sativa
acatttcaagtttaccatggcctaggaaacgtccgttacgggccaactggggtagatctgtcaaaatttattgtaacaccaaggggaattgatagaccggctgagaggagtgtaccttctataaaaggatggttgatgaggggcttgagagttgatccacagacaagtgacataacaatcaatgttatagtaagtcgggcaactgagggtttttattgggaactaatgccagttcaaaactctcgtatgtggagatggtatgtggagaatgcattgcaacgcgggtggcctctagctatggttccgtttgttcacccgaaggatctaggtgtgcagatgaacatggatgatggcgagggaccaagtgctgaagtaaatgagacttttgtggaagaggtcaacgcaccagaggaaggtggcgtagtagctccagtaggcattcaacctggttgagtagccaacgagggggagactgtcggtaccattgtggatgaaatggagagagaggattttgacaacgagcgtgtagaggaaggtggttcgtcagatgatgagacggatattaatccagccgaatgggctagtgaggatttttctggtctggtcgtctctgaagaggatagtgtgagatgggaatacaaagaaaatgaggttattcagggagcgatttatactagagcagaagaaatgaaggaggcggtaaagcattttgtagtgtcacttcatagagagttttgggttgccaagtccaatcggtcgcaatatgaagttcggtgtgttaaggaaaaagatgggtgtccctggagagtgcacgcttataagggaaaatggaaggattactggacagtgtcagtcattaccagcatgagcatttcagaaataccacaggtaacattacatgtgcatttgttgcatctgagatgtatgcgcatgtcatcaataatctgacatatgaaccaaagtcaataatccgacatatcgaagagacatacaagtatactattagctatgccaaggcgtggagagccaaacagaaaataatagagatgagatttggaacttacgaagcctcgtatgacaatttgccacgcctgcttggtgttatcaaacaaagataccctgggagctcttacgcagtgaagaaattcccctcaattgaacatcctggcaagagtgtgctgcaaagggtgttcttagctctacatgcatgcaagatggcattcgtgcactgttgtcctgttctctacattgatgggacattcttgactggaaagtatcggggccatatactaacagcaataggggtagatgggaacaatcaggtattgcccttggcatttgcttttgttgagagtgagaataccgacagctggtactggttcctgaaactggttaaaacagaagttgttggtatgaggcccaatgtgtgcctgatacatgacaggcacgccggcatgctgcgagcgatagaagagttgcagtttgggagtatggatcgaggataccctggtgaatgggaagatgtacagagtaggtggtgcatgcatcatatgtgagctaatttcttcaagcaattcaagaacaaggagctcatgaacatgttcaagaggctatgcaatcagaaccaggagaaaaaaattcaatgagctttggaagagattagatgagttgacagccaaatgcagttatctgcatgcagcgggaccatcgaccgccgttattgaccatcctcaagctcttggacctctcccaacagatagtccaacattggttagaagaactggagtagagatccggaaattttctcagtggattttgcatgaaccaaaagagaaatgggccaaggcttatgacacaggtggttctagatatgggataatgacaacaaattttgcagaagtttacaactgggtgatgcgcggtgtccgtggactcccactagttggcatagtagagttcattttacatgggacatgtaggtattttagggaccggttccagacagttcttccctctatgccgaacaacgacattttattcggaactttcatgcagaaaaagctagaggagtgatgtaaaaaggccatgaaacatcgagctctagtgcaaggtacccaacagcataggtttaagatactatgtcaagataaggcacgcaggggtatctaccgcaagagagtgaagcagggatgtgttctcaaagccgacggcacatgtcattgctcatgtgcaaagcctaagctgctccacgggccatgcacccatgtcattgctgccgcatcggagtgtggcataccagatgcagtatatgtgtcacagtacttcagtaagcaaacaatatatcatacatggagtggcgagatttatgggttcggcatagctggggagttcacagagactaatgatgaagtaatcaatattcctgacccatcgaagctccaaggcaaggctggaaggaggaagactcgtcacatccacaacgatatagacgagtcggaggcgggcagggtgaagcgctgtagcaaatgcgatgaacgtgggcacacctacaagcattgtcctaaagacaaggaaaaaccaagtgcagcggaggcaggactatcaggatcagtagcagatggagctcgccctacgggtgaaggcactacctcaactcgatcccgtcctagacgtcgtcgtgccacgtctggctacgtggtgtagttcttgtgttctatgttggcatgtggctttgcttgtaatttggttcaaacttatcgatgtgtttatgtttcatcgtgtaatgtcagacttccgcatgtaatgtctttaggtctcgtgatgtaatgtcagactttggcacctactgtctttaggtatcttgatgtaatgtcagacttcggcatgtaatgtctgtaggtttcgtgatgtaatgtctgtatgttttcgactgctcacctgtcgtgcagacgacgttgcttaggcagacgtagcaccacagcggccaccctgactaactagtcctcatctagttgcgcacgttcctaagccgactccccctccgcacggaggtaagtatatttaaggattttttgtacatgcctcgcacatctatgtgagccgattgatccaattgcttcaggatttcatgcaccgttcagcaccccgccttccacgggtaggccatctgttgtgcccctcacagctatttaaaaaaacaatagtacttcgacaatcaatttacatgcattttatgtcttagtttacaagggtcccgttgtcgatgtctaggtttcgcccagtttgctccgacgcaggtcgcccacttctcctaggctgcagggtcagcgtctcaggcagctgcgtcgacctcgcactcagcgcagttctggcagtacaccgggacttcgtcacaggcagtcggcacgtcgagtcagggtccaccactggacaatgctaggacctcgtcggactacggggtggcttccaccttgctcttctccatgagcgacttcgacttcgcttcagtctcgacagaggacgtcatcggcccctcacagctgggaggcgcaccgccggtgcagacgcaggaccagtcgccatccactccagcgccagacactcatgctacccgtgctgtgccaccgaatcgtttcacgtactcccaggaccacgtgcgagcacaggctcggaggaccaagcgtggtcgcggcgcggggcagggccagtagagcagacttatctttgtttatttactttacatgctagtactgtatgcttgtgtaatgaatacgttgttgttattcgggtttctcatccctgaacttcgctgttaatttttacgaaagcacgatatctttcggcacatgcatgacatatttctgccgcaccgatgcagcctcctttattcgcgtgcgatacgactgcggaatggctgacccaccagtgcccacatacaactttcggcgccaatcaggcgtacccaccatggcccgcgacgttgacatgtcagggatatcactgcgatttttggtgcctatataagtcgccttaacgagcgaggcctctgaagcatctaggcccccgttgttaattttggtaattaatgacaagcgctaagtgtggactaaccattgctattaagatatattttaagttaggtccacgtcatgtgtgcgcatggatgattatcgatggattaaaatttgatggagcgaagcgaagaaaagaaaacggtaaaactagtgctttagttttaaaattgatcgaggtgaagggcgatcaaatttgctagtttatttttagtttcgccgtactatcaaggggggtaatgacctagaaatgagatgattttaattgccacattaggtcattatgcatttagacttgtgctcacatttcatctcacacacacaattattcatctttcactgggatcgtcctgaccaggggcggtcagaccggccatagagtgacggtttgaccggagtgccccggccggtctgactggccccaagcgggcggtctgaccggcgcataaggccggtctgatcggaggcacatgcgcggtcagactggccccctggaggccaggatggtgttgctcggggtggccgatacagagccgacggagccgtatttggtcagaccgagctgatggcagtctgaccgagccaaggccggtctgaccggccactcactatcggtctgaccggccaggccgatggggccctctaacagcgctacaacggctcgttttctagccgttgcagagtagcacggtctgactggccacatacctccggttagaccgccagagcattgagttggggaatttcgcccccaacggctagttttggttggtgggagtataaatactccccctccagcagcaaggggctctcttggcacccaattcaattgcatacaccccttgcacctctctcacacccacttgagctttgtgttcatccatctagtgtgttagagggttaattagccaagagtcaagtgcatttgcttccattgtagagcttgtgtggcacttgattgatcatctccacgccggatcattgcttgttactcttggaggttgccgcctcctagacggcttgtggaggagttgcctggtgacctctccgagaagattgtggaggaggcccggcgtcggttgtgagtggtttggagttcaccatcttcggagtgaaggaagaactaccctagtgatcgaggcttgggtagtcctctccgtgggccggctcccgccttgcccaccccttgacaaagggggcgtgcggtggcttcgtggttgagcggtgtagttgggctcgcctcaacggggagtaggaaaccgacgagtttccgaacctcggtgaaaaatcttttgtctccttgtctcatttacttgttgcatttacatttgtgcaatttacatttctagatatatactagagaccatttcaccttaggattgctaaacattaacataggaatgtgatttactttcctagagatataattgagccattatcacgctaggtttgcaaaacataacttagttacttagttagagttgaccctcaccaagcctagcaacttaggttagttttgattaggtgtcatttagtttaaatcgcctattcacccccctctagtcgacatctcgatcctacagcctcacaatctttaataactcagtcacattcggtactctcttccccacttgcttcattacaaatcctaccagctttcgtcaatgggtagacgcctgggcattgaggatccgaattggcatagtgatccttgtgtatacctactaccaccttggtgccagcgtcctctctgcctatgcggtgactgatgccaactaatggcttcgaggaatcctgatattcgaggaaggcccttttttaggtgccctaactatgaccgtgaggtattttattatttgcatatgcttattcattccgtatgggcaattattttattcttcgtaatactactctattcgtcaggcccgcactacggcttgcgtatatatcgagtgggtcgatacagaaaatcccgttctcgacctaaccacttgtttacaagaaggatgctggtatttcgcattcgaaagtactgagcaatacttgcagagaaaagcggcttacgaacgataatgtcgtgaacaacagtgcaactagcgggtgctaactacggcactccctccatgggaagcccgtccaagatgcacaagcggtgatcgttgtcaggttcttcgttccataaagcctacgagattgggtcgaaggttctttgtttgtccaaatattcttgacgacaatttcatggtaagaatattttgattatcatgattccttattttctcacaacatttactaactttgttcgcttcacatctattctttcccccccggaaccaccaaggagatgtcaatagagagaacggatagacaccagaagggttctaactccacctagccgtgctgtgcagcttgaactaccagagcaatacagggatactaaagcgtggttttagagaggagagggatcctcacgtagggattagctattatcagacaacttggcatattgaaatttgtactttcatgcttccttgtcccattatcacatcgtcgttgtgttcaactcttgcactgcctccctcctagttcgaatataatatcatctatgtaaccgcaatggaaatagatgtatcatgttcaaattctactactatttcttcatgttacataattctccttgtttaagtctatataatgtttctacgaccgagattgcgataggcctatatcaatttcgtacactaatacgttgaataagttacaaaataatatcttacttaacatatgaaattgcgaaaacaaccaacttcaatatatttttaaaacattattaataagttttaccaataaataattctttaattattattaacataatagagaaaaatcatttggcttgtacttagtacgagccaaatgctctttagggctgcaaaaattgcatttagccccttgccgccctctagaggtggcaagggtgtaaatgcaaaatacgcatatggcaccgtccctcccccgtttgccacgtcagcttgccgccctccattggggcggcagggtctatttttgtaattttttgcgccgatagattatttctgtaaatattaaaaaaatttaaaaatgaaaaaaattcgtcctgtttcccattgtccatatcatacaatgtcttttctcaacgggccggatataacaaggtttttcaccccatcacatcgaatgtttggccacatgcatgaagtattaaatatagaaaaaaaactaattacacagattgtgtgtaaattgtgagacgaatcttttaagcctaactgctccatgatttgacaatgcggtgctacaataaacatttgttaaattaggcttaataaattcttctcatggtttataggcaggcactgtaatttgttttgttattagattacatttaatacttcaactgtgtatccgtatatccaatgtgacacggcaaaaattttcacccctggatctaaacacagccagtcatcatggcacgtttccttacaacgcctacgtttgaatcgaacaatgaaacgatggattatatggtactacctccatccccaaatacttgtcgtcttgagtttttgtttgtaaaatttgatcattcgtcttattcgaaagattatagaattattatttattttgtttgtggcttgttttattatgaaatgtactttaagtatgaattatccttttttatatttacactaatttttcaaataaaacgaatggtcaaacgttgcaaccaaaagtcaaagtgacatctattatgggacagaggtagtagtccatttacatgggtaagctatatttatatagtatttatgtggactggatgtttctatttctatgttgtttgaggagaaagagtcaaaacttacactataagtttcatatatttgcactataattttcagtattatgatgtaattggttattggtttaatttagtatataagtaaaaaaataaaaagtagaagggaaatattagggatggtctatgtgtcaaacaactttaaaaaataaattttataaaaccctatatgatggtccaagttttgcaaaattgcgtaaagtttggcacgtggcacatttctaggtattatggttataaagttttgcaaaaccacattactaatcattttgactttgatttaccacacttttaagatctacaatcatatctcaaatttatgagtgttatctatcatatagatgttacacccacgatttctattttgatataggagtatgtaaaaatggttaatggtgtagttctgtgaaattttcgaaccataatatctatggttctatgctacgcgctaaaatatatatggttttgtgtaatttggaccataatacctgtagttttgtacaattgatataacccaattagttaatgtgtgaaacaatagaactccttgtattattagttatcacagaacaaaatatattatagaattttttttatcacaaaatttcagataacatagaatgaccacatgttgatgagttgggaaaatggaaattaagaagtataattgtaatgtggaaccggagaagggagaacatcagaagcaaaagtacacgttatcttggactagtcaagaatatatatactgaccaagtatgcgaagttgatccaacaaaaattaacaccccaaatgtactgaggagagcttgataaatattttacgggggcttctaaactactccctccgtaaaaaaaaccaatcctaaatttgaatctacatatacactatgtacagatttaaactgaagatgatggcagcgagtcagcgacgcgtgtgagaacggggacgagttcagctgctgacgtgagtggaggaggggggcaggccaaaacatactcggaacaaaaacgggtcaaaaacccaaacctaactgcaagtcttggtacgatccaacggtcacaaatttggaaaaaaaatacaaatgaataaatcttttcattttcttcaactcttgctcccgattgaatctgtctccctcaaccataatactacatccgtcccaaaatatagctacatagtactaggaccagattcgtagtactaggtaatgccacatctagtactaggtagctacattttgaaacggaggaagtactgagtataacacctccccaactttcgaaaccagagcaaatcgagtctctttggatagaggtttcatccttcatgacgctcatgagactgtcggtgagaaaaattaaaataataacagcccccacctctccctaggccctagagcaaatcgagtctctttggatagagatttcatccttcatgacgctcatgagacctacatgttaatgagaaaaattaaaataataacagcccccgcctctcccaggccaggcccacttacatttggcaactttcatatgttgtagactgtcctcacagaccaacacaagtcttttctgcacactaggccaagcacgcttaacctcagagttctttagatatcggtttctggaaaataagttgcaacttgttgatgtaagtattctattaattctattaagccttgggccaagatgtcacaatccatgagccctgcgctgcatccgctggccttcgacccggttgccgaggtcgctagggtggtagacggcggccgacatcggcgagctcgcagggagtgcgggtaggaatagcgaggagctactatcctgaaattgttgtcgccgtccgacaaggcatcgttgccttgctcctctcctgacattcgatgggagtttcccggactaggatgccacatcagtcaaatcagctatccatattgtcttactacttcagggcctgtttagttcactaacgaaaatttttagcgtgtcacatcggcgatacggacacacatttaaagtattaaatatagactaataacaaaacaaattacagattccgcctaaaaattgcgagacgaatttattaagcctaattaatccatcattagtaaatgtttactgtagcaccacgttgtcaaatcatggcgtaattaggcttaaaagattcgtctcgcaatttacacgtaacctgtgtaattattatttttatttatatttaatactccatgcatatgccgaaacattcaatgtgacagggtgaaaaatttttgtttgggaactacacagggccttatttaacccggttttgaaagatggatgtttaataatttctgaagataaaggacctacagtgaacttattccatcccaaaacagtgtggtggtgtggcttggatgggccgggctgggcctcctacagtccggctcggtccaactatatatctctcccacctttatctattctattaacaaaaaagtgaaaaataaagaaaaattcattcttcttctccttctccttcttctcttcttggaggatatttcttccccctccgtctccggcgccgatctgcatccacccgccgagcagagaccagcgccgccgccgccgccgtccgttcctcctgtatcgcgtcctggtgagcatccgcccctcgttacgcacatttttttattcgaatttttttttcaagaatgaatttctgtgcgttaaccctagatagtacgtagcttccgttgtagatctggatctggaaagcttttctcttgatttgttcgtaatgtgatactaatagcagtttctttgcttgtttgtttgtttccctaaagaaatttcttttttctgggatgtccgacgttggagacgcccctgtgcagcgccgctcttgttcgaatccggccggtggtctgtaggattgggcggctgcggcggcggcgagatggacgacgacgccagcatgagcataagatgggggggattcttcgagtcgccggcgaggaacctcggcctgcagctcatgtcgtcggtgcctgctgagcgtgacaccaagcagctgctctctggtagccccttcctgcatcatcagcatcagcagcatgtcccgcaccaccaccatcagccccatcacccgcgtgactgcggcgccaatggcaatgccaatggtggtgctatgcctcctcctcctgccacggaggctcccccttcaatgccgatgaacttcgcgcgcagtgacatgtggatgcacccgcaacagcagcagcaacatcatcatccccgcgagcacaaggctcttcacaatctcactgttggccatggttcttcgcacattgcgcatcatgacccagtgggctatgggatgatccccggtacgcataccctgcagatgatgcagcagcaaacagagcctcaactgcaacccccaccaccgcctcagcagccaaaagaggaatgcatttcctcgccattgatcgaggaaaatgtacctgttattgatgagccaccacctcccaagaagcggcagcagggccgccaacccaaggtaccaagggctaagaagcccaagaagtctgctgctcctcgtgaggatggcgcaccacccaatgcaccagcaccacggagaaggggtcccaggaagaatatagggatggtaattaatggtattgatttggacctctcaaggataccaacgcccatttgttcttgcacgggcgcaccacagcagtgctatcggtggggtgcaggtggttggcaatctgcgtgctgcacaaccaccatctcaacgtacccactgccaatgagtacgaagcgccgtggtgcacgaatcgcaggcaggaagatgagccatggtgcgttcaagaaagtacttgagaagcttgctggtgaaggttataatcttaataatccgattgacctgaagaccttctgggcgaagcatggaacaaacaagtttgttaccataaggtaaaagacaatgaaattctaaaatttgttggctttgtaggttgctctgcagctgtttggtctgagtaattgtctgtatgtactctagattacaaactgcagaatccttttaggtgtaggttttaggcatgtcctgtccctttgcagtagtttacatgcctcatctgtgacctgggtgctgacctgtatggtggctatctgcatgtatctttgtcattatctttacaagtagcagtgtaatgcgacaatctctaatttaggtggcatgaaagttaatctgttcaacgtttctcattatgcttaagtcttctgttatacaatgctccattgcaatgcctggatgttttacagaatacaatatagttgctatctcatgaagtagaaacgttatctttttcatgctgtgttctgtatgcatgcaaagtttatatagcctatatatacatgtcttttcttttattgaactgatgtttgcatgcatgatgaatgtgggcaaaggttctgtacctaatctggattacttaaccagttctaataatatctttactgtgagcaaggttcttgccaatttcatttgatgtgctcaaatctctgtcagactctattccgaagtcccttggtatcaagaatttttagagtaaatgctgaggaatgtcttttgccacttgtctaatgtaacatgcctttagttctgccttatacgtagatggaactctgggaccattgatgtcatctttgctatttagtgattaccctttaagtccatgtgttattatttgcacttctttaggaggcaattattggctagtaatctaagtcctatgtttcaaactcagcactttgtttaatcaactttgtgcaaacagtaaacagcagtcaaaatattgcaattacattctattattttttgatttgatgatcttttttgggataaagaaaattacctgtatagtttgaacatattctgctctattatgctgcaagatatcaagctatctgcataaatcttgtcatcctgaaccttcaaaaaatacagtaatatttcacatgttatgcattcaaaatgttgatcctgtctactagggcaatttaactctgtcaaggctaattgcattataaggtatgcatgttctctattttttctatttgtagattacagagaaagtggtgccatttgtaataaatgatgttatgattcagcaattttcttttttataataaagtactataataattagaatgctgatatgagaatgaacgatgatgattaatgagcatcagaattatatgaaatgttagataattaattatcacaaaagctattttctttccaacttcatatatgctgaaatgtgggttgctgctagtttcgtgttgcctaaactgcagtgttacatgagaatattgaatgtttgcacatatgttttagaggccttgagtgccacaaacgatggacagcacctttttgtaaaatgtaaatacccagtaaaattattgtgcaaaatatttggtagtctatgaagccattaggaaaataatgtaattctgagcaaatagaagctaatagtgccaataccagagctattgtgatagatattgttcactgatatgatatgtgtgaaacgttataacttgagctattgcgaattgcggtagcagagtgtgcgatttatcagcatcatcatcgtacatctgggaatgttgtcttgggtgatctgtacatgtactctagttccatagatcttacatgctagcccctgctgttttttcttgatctgttctgttcttggtgtgcattcgccagaccgatgtatgaagatatattatctgcatttgttgatcgttgtacattttttttattttttgaaagaaaagtatgctatgtttagtttgctgagatgcaaatgcaatgcatcatcaggctagagttgatgatcaggctgagatgtggctgcaaatagtttttactgtgatgtttctcattgcttccatgttctcagttaccatggaagcagcagtattcccatcatcaatgccatggaattttgtgtatatgatgtgatatggttttccctactgttcatacttgatgtgttctaaatgagagtgtgacactacgtatcttgaagctacaaaatgaataattacccttttattctgtctatacatgattgttcctccatttggtcatttcattgtctcgtgtggtcttcacatggcttcattgttacttgctgagatatatcgaaaccaatctcgccatcattcatccattctgatgcattttgcagtagtgcttattgttttgttgtacaaaagattattatttattagtattgtatagaagaaataaacaaaagcagctctaataaggtgaactacagctgcggctaaaactgggcaagtttttgcattttaacttatggaaaatattgtttgtgcaactctccaaggaccaaagggatctgtattggccatgtttcagcacacggcaatgaggttcagacttcagaagtccaaactgatttgtgtcttcccttcccaccatgtactactgataatcttgcaacttgaaactcatcattgaccaacagtttcatcgatcagagcctattaacatgcagagagagaatatctaatagcatatgtggtcaagtttgctcacatcttaagcttttcttagatttctaagggcgtttacagtgtgccgttgtggctttcagccttactcccaggaaccgaatattcgtgtccacgtactcaaaccgtttggcctcctcaggaccaaagcacccatctttttatcctatggcaggattggtgtgtaggcagctcaaattcctagccccacatttctgccatacagcacccctttcatgaccctggtactactaaagaggaaggcaatgtttgatcatgctcctcctgcagtaaaaagagcacattccagctgggccttattgccttccctctctgataatgggctttctgatcaggagattttagatgttgcacctttgcaagcccagccatcaagtccagaagtcaccctagtagtgcttcagattcctatggctcctgtgaaaaaaaaggattggaagactatcctatacaatcctactagaaggtagagctctaggcttcttaatgccaaccaagagctcaaatttgatcatcgaatgggaattggcaaacaaaggggaaaatcggctaaaaggctgaagaagttggcaggtatataaaaaatccttatccctggcagcaaaattactgaatctgatttcaatgctctggaagatgatataaactcagattcttcccgttctgattgttctttatctttgttgcaaaagatgggggtggacctatgtggcctgaatcctgaggatgtggctgaataaagtttagggggagaaaaaaaggaagaagctttcccagccaaacatggatgattaggaatgaataatgtttctttgctcagaacatgatctttttgtttttcagtactgtcgaactgtgatcagtgtcagtgctctttgtgtttgcttggaacttattttatatggccctatgcaggctaatttaattagctatgtatctatatgcactcctaaatgttttcctcatgaataatgtgtttaaatcctggaatgtgctgtgctagaatataagaggcatgaatgctgatacggaactgttgtctttgaggcaaaagatagaggaaagtggttgtcaggttttctgtgtccaagagaccaaaaaacaaaatttctctttggctgatattaggacttctgctcctaagcgttttgatgcgccctcaaggggtgcttcagggggaatcttagcggtttggacctctaaagtgtttttaggaaccccaggggaaataaacagtttttctgttacagtaaactttgtttgaaggcaatcttcagaagcttgggccttaacttgcatatatggcccatgtagtggcccaaaacgtatagagtttgttatttggctgaaaaatatctcttttgggacaatggataacatgatttttctaggagactttaatttataccgatcggttgaggacagaaataagtcgggagccgacatgaacgatatattcatttttaatgatgtaattagttctcttggtctgctagaaatccctttaaaaggaagaagttttacctagagcaatatgcagaccagtctcctcctggagcggcttgattgggtctttacaagtccagcttggactttagttttcccaaacactactgtccactccctgacccggaatatatcagatcatgtgccctgtgtagttcaaattgataccaagattccaaagtctccaattttcagatttgagaattattgggttgaaatggaaggattctttgagcttgttagcagaatatggtcaatagaccctggttatgaagatccggcaaaatgcattagcttcaagttaaaatgtttgaggaaaagtttgctgcattggagtaaaaacttgtctaagttaactgctcttttggttaattgtaatactgtgatcaatttcttagacctaatagaagagcataggcccttgtccatccttgaatggaatttcagagaaattgtcaaaatgcaggtttttaagctccttgagtttaaaaggctttattggagaaaaaggtgcacgaataggtggatgttattgggtgaggaaaatactaaattcttccaagccattgctactgaaagatatagatcgaactccatttctcaggtgcaggatcagcatgggcagatagtcactggtcacaatcacaaagcagatttgttcttccatagtttcaaaaacagaatggggatttctctcttgcctccaatggactttaatttgagggatcttttccccaatccggaaaacttggattgtttggtggatcagttctacactcaggagaaggacaatcttattaaggtaattctatcagataaagcacctggccctgatgggtttaatgggttttttcttaagaaatgttggcaaatcatatcacaggacttctacaggttagcagctcactttcatgcctgctatactgatctgcagtcgataaacatgtcttacataaacttagtgccaaaaaagtcttctctagaaatagtaaatgattacaggccaatttcactgatgggcatcagtttaaagtttataaccaaattgatggcagataggctacagagtgtaatgcccaaactggttcatcaaaaccaatatggttttatcaaaggcagaacaattcaagattgtttagcatggtcttttgaatatatccatcaatgccagcagtcaaagagagaaataatattactaaagcttgactttgagaaagcatttgattctatagagcactctaccttgatatccattatgaaatgtatggggtttcctgaaaagtggctgcagtggataagatgattttttttcctcggcacattcttcagtactgctcaatggggtacctagaaacttttttaaatgctaaaggggggttaggcaaggagatccactctcaccattgctttttgttcttggtgctgagttgctgcagagaatagttaacaaagcttgctccttaggtctgttgaccaagtcaattaatgaacttgatgagaggggtttcccaataatacagtatgctgatgacacttcaattcttctcaaagcattgcagagagaggtgttctgttttaaggcattgttgaattcttttgcacattctactggcctcaaagtgaattaccataagtcctgtctctacccaatcaatttatctcatgagaatgcagtgctttttgctggtctgcttgggtgcaccataggcacaatgccttttacttatttgggtttgcccatggggacaactaggccaagggtagtggacttttgttgacagaaaacacgaggcctgggagatctgcttaactccagtgcaggtccaaaactcgccttcggatgtgtgagcgtgccagttgatttgatcctgcaatcaacaataaataaagacaaagaaaccgcgattaatcttataaatgatagccgatcggctaggtgccgatgacatatcatttattttaggccgatgtcatgtgtagatcgatcggcagtcatgaataattaagaaagaactaattctactcgatcggctgtagacatta

SEQ ID NO: 32035 - DNA, 11516 bp, Oryza sativa
gtattcttggaatcggctgtatcggctagccctgtctaactcgaactctgccgatcctgaccgtagccgattcggattgcagtcgattcttgctctgtttccacaacgatcttcgtcttcgattccacttcgaccaaatcttcttatccgatgctgatattaccaaatctggttcttaacacatgccccccaagtccggaatatttgataatgtttcggatttgccatatatcgactccgagtgaatatcgcacttgccgttttctgaccgttactctagccctttaaatactaaccgccacccccgagaaacttcacaccgtttcctccgttttcaccactgaagcaagccacgttttctctctctctccagcgatcccctcggtgcaccagcgatttcaaggcgattccgtccccggttagatctccgcccccggcaatgtcgacttccgccgatccatccaccgcgccatcggccgagtacgtagaggtaagtacccatcggctagatccctttcttttgtagcagattgattttctctcacctcatcttgttttcttcctctctatccccatctgtaactgtagcatatgtccaatctggttgcgattccgagtctgtcgcacgagaaccactactttcttggtccaatcggcaaccttgaccctactgatttcatcactggtgaaaccaacagaatcccctttagattagccaaccttaatctgggtcactggaagaataccttcaaatcttggccatctcttgagaaaactacccctgagaagagttggaccacatggtacaagcgtgtatcggctagtaaggcagttcactgggatgagatcgggatcaaccaatcactttccctcaccatagccaattccgctaaggacgaatccctgatggctgccgccacctatttctggtggaacaccatcaacgccttcctattcaaccaagggccgatgaccccaactttgattgacatcactatgatcaccggattagatgtaacttcatcggccaatcctatgagcttgaacactaagaaccaatttgatttcaggaccaaaagcataggtggttggtctagttacgtagcagcatatatgggtaaagggcttgtcactccccgagagcatgtagcctttttgctgatgtggctggagaaattcctcttttgtggatcaagctgtggccccacaaccaattggcactttgtagccgaagccctagaatcacgattgacaatttcccttgggcaaaatcctcctcggctatctatatcaaatgttgaacaatgcatcggccaagatagccgtcggctcagtagttggggcaggtggaccatggtggttgctgcaaacctggctaaacttggcagttatgaaagttgtcaatcaaccatctgtgacagaagctgaattcccaaggttggagccgattgtggaagatgatggagaagaacgcactcatcgtagatgcatgtcatatggagaatatgcatatacgccaactgatgctggagcaaagttgtcggctgagctgcttaaggattggttctgcagcttttatgaaggctttcagaaagatgcccgggtttggtttccttatgaggactcagcagatcttgaacttccatcagatttcagatttgaagatatcaatcatgaaaaataccagaaatccagggaagttcttacggctgcaatcagcccatgcatccttcttgttggcattcattagggcagaaacatccaagtttcttatgaattttaccacccaatgagctcagctagacaacttggattgggacaactcccaatcggcttattctttgctgacaaaatccagtgccgaggagaaatttcatcaactctgatgatggatcggctactcaacatcccaggaccccccttgggcagtattgagaacatagagctggcaaggctcaggagctggaactttgacagatggtggggtgaatggaaacaacatatcttccatcaaccagcttccatgaacataatagatctgttccctgatgttatccctcaggtaaatctttactttatcaatcttgctcgaacaactggtagctgatttgaaccttgactaatcttttcttttgacctgcaaacaacagaatcctctcctcctcaccaaatcaacagtagcaaggatattgaatatgctccaggtctaattccaaatggaggtggaccatctccccctgtcatcggctatcacgcccccattacttcaaccctcctccaaggcctaatcagggaaccagccgatgcaggtaaggaaagaaaaaacaggtcatcggctgtggacacatcagctccggctcccaagatgaaaaccacatcaaagaaaaccaagccagctgatgacctgcctgccttggatccacccatcgaacaagctctggatgaagaagacattgaagatgatattgatcaggctgcaactgaagtgagcgatacagagagaacaccattggcttcgcccaagcaaactcctccaactccttctgctccgactcatttttcaagggtaagcagctctcctctgctccttttgcaatcactttacttatagccaactgctcactgatcttatagttacagaagaagaaaactgctatgaagaagaaatcggtagcaccaactctcaaaccggctccaccagtaagatattctcaatcctctcattaactgatcccggccgattatgtctaacatttgtcctttttacagcctcctcgtcctccttcacctcctgtgcagctagaatcaggcaaccgtactccatcggctgcagacagccacaacgtcgaagaggaagaacaaccagctgcccctgctattccagtaagtttttgttgatacaaatctgagatcggccaatcatgttttgatccttaaccatccacaatattatctcttgcaggtcttagccgatctgttctcatttgatatcaagaattatctcgatgaaacagaggaagacaccaccagtaaagctatagctcctctgtctgatgatgtaaagagaacgcttgaggatatctctcatcggctagaagcatcactagacaatttggtgaccaactgtggctcgatccgggcaaggttcacagatatccaagctctactcccggatgaactagccgatgcccttactctagccatctaccttgagcaacaccaattcaagctggaaaaggccagacagagattagccgatcgccgggagtgcaaggatattgaagctacaatccagcacaatcgacagcttgtgcatgtagagaaatccaagcttgatcagctgtctaagggcccgatcaagtcaaatatcgattggcttgaagctcgtaagattgacctcatggcacaacttcaagaatgcaacgccgagctggatatggagcacaaaaagttagccgatctcccgaagtctatcgaagatcaaaaagccagactcaaatcggctatcaagaatgttgcagatttgaccaagtctctgaaagtcatctctggaaccgatgctcaagatgcccaagctattgaggaagtagagcaaattaggcaaagggctatttcggctatccagcgatacttgtctcaatgaccttctgtgtaatagactttctatgtaattggctaaggtactttagttactttgctgctgattaatacaacttcgaaatttgctcaaaaatttccattatttgtatatatatgcccccctaattttataatgtcagaagcattgataaaattataaaaacaactaagggcgacatatttatatcgaccattgtacatcggcaaaccacaaccgattataatagaaaaacaactaagggcgatataaccatatcggccattgtacatcggcaaagcataaccgattacaatataaaaagaactaagggcgatataatcatatcggccatctcaaggcgatgtaaacacatcggctatcatgcatcggcaacaccagccgatcatgcgttaacccaaacacttgggtaatatttcttcaagtatttgccatttagcgctctgtcataaacttcaccatcgagtccttgcaacatgtaagcccccttagataccaccttatgaatttggaacggtccttcccaattcggcgaccacttgccgaatttgctatcccgagtcccaatcggcaaaatcaacttccatataagttcaccttccgaaaaatctttgggcactactttcttgttataatgccgagtaactcgctccttatctttgataacctttgctagggctcgtaaccgtgattgaaccagatcctccctctcatcggccataaggttggaatactcatcggctgttaaatcattttgcaattccgttcttctagagccgattctaacttcccatggcaaaatagctttatgtctataaacaagtttataaggaggaacctgtatcgagccatgacaagccatccgataagaccacaatgcttcggctaaacgagtatgccattgccgaggataatcagaaatcttcctcttaatcaacttgatcaaactcttgttagatgcctcggcctgcccattagcttgtgcataatacggtgaagaattcaacaacttgattcccatgctatcggcaaactgaataaactcatcagacacaaaaattgaaccttggtcagtcgtaatggtttgagggataccaacccgatagattatatgctcttgaacaaactgtatagcatccccagaatcaactttcttcaaaggaatagcctctacccacttggtaaaataatcggttgccaccaatataaacttatgtcctttactcgatggtggattaatcataccgatcatatcaattccccaacctctaaacggccatggtttaatgataggattcatagccgatgccggcgctctctggatcgctccaaatttctgacaatcttgacaacccttataatatctgaaacaatcctccagcattgtcggccaaaaatatccagcacatcgaagcagccacttcattttatgagccgattgatgagtgccacatatcccttcatgaacttcaccgattgcaacttttgcctgatcggtactcaaacatttaagcaacaccccatcaattgtccgataataaagctcgtcgtccaacaatatatacttcaacgctttatatcttaacttccgagaagccgattgagatggatcctgtaaatactgatagacataatatctccaatcatcggctgttataacagcaacttcaatctgaacatgtttgatcatcagcttatatcccgatgcgccttgggctagatcattagcttcaatattctgctctcgagatacatgcttcaaagttactagccgaaattccctcatcagttcttggcacttctcattataaactatcaacgtatcattcttgcattcatattctcctgccaattgactgatgaccaacaaagaatcccccatgatttcaatagtatcggcttcgacttccttgagtaactgcaaccccttgagaactgcctcgtactctgcttgattattagttgcataaggtttaatagtataggcaaactcaaagcatgccccccgaggggagattataaccaagccgataccacaaccatgagtacaaactgacccatcgaagaacaaagtccatggcacaacctcaaccgagccgatagaatcatcacgatagtcaacaataaaattggctatagcttgtcctttgatcgcctttggtgactcataccgaagatcaaactcagtcaatgaaaatatccactttccaatccttcctttcagaataggagccgataacatatatttgacaacatcagccttgcatatgacagtacattcattggacaacagataatgtcttaacctcgtacatgaaaaatataaacacaagcataacttctccacaggggagtatctagtctctgcattcaagagccgacggctcaaatagaacacaaccctctcttttctttcgagctcctgaatcaagaccgagctgattgacttatcaccggccgataaatataaccgaaaaggtattcccttctgtggaggaatcaaaacaggaggggaacttaaatattccttaatattatccaaagctttttgttgttctgccccccaggcaaattgctgatcggccttcaatctcaataatggtgtaaaaggttctaactttccagacaaaatagaaataaaccttcgaacaaaattaattttgccgatcatctcctgcaattctgtcttgtcctccggaggtttaatcttcttgatcgcattgatacttctctgagttacttcaatccctctctcatgaacaagaaatcccaagaactggccagccgatacgccaaaagcacactttgtcggattcatcttcaagccatatttcctggtcctctcaaaaacttttctcaaatcggctatgtggtcctctatttctttagacttaacaaccacatcatcaatatagacttcaaccaaccagccgattagatcatggtaaatgtaattcatagctcgttgatatgtagctccagcactctttaagacaaaagttatcacaacccattcaaacaaaccgattgcaccaggacacctaaaagtcgttttatgaatatcttcctcagccatgaagatctgattatatcctgcgtttccatccataaaactcaaaatcttatgtcccgaagcagcatcaactagttgatcggctactagcattggatattcgtcctttggggtagctttattcaaatatcggaaatcaatgcacaccctgaccttgccgtttttcttaataacaggaactatgctagaaacccattcagcatatcggcaaggacgaataaaaccagcatcatacaaacgcttaatctcagccttgacaggttcgagcatatcggctttgcatcttctcggaagctgctggtgcggtctaacccctggtttaagaggtagccgatgttcgacgattgatcggctgtgtccaggcatctcataatactcccaagtgaagcaatccctaaattctttcaagagctctatctgcttggttctaaattctgcagataaattcttactaataaatgtcggccttggccgatcgccggacttatatctatttcttccaaatcatcggcggacattaaaccctgtccttgtttgtcatcgagatcatctaccgtgtccttggtgtagacgtttgaaccctccatgacgccctcaaagcaatagctcgggttctccatcttcaattggctgtatatcagaatcacactttcagaaaatctccatcccaaactttgccggataagcaatcaaggccgtccatctcctaaagagctaaatcagcactagcaacattgactgacctgtcggctggcacgatttctatcttgtcgccttgccattgaatcaagcattgatgtatggttgaaggaatacaacaattggcatgaatccaatcccttccaagcaacaaactgtaagaacccttcccatcgatgacaaaaaacgtagtaggaatagtcttactgccgactgtcagctccacatttagaacacccatggtttctgatggattgccaccaaagtctttgagcaccatgtttgttttgatgagatcttcggcgtttctgcccaacttcctgaacgtagcataaggcatcaaatttactgcagctccaccatcgaccatcatcttagacatcggcttcccattaacatagccatttatatacaatggtttaagatgccgattctctgtaccctcaggcttttcgaagactacttgttctggcgatagaatcaacttagccgattcttcttctatttcatcaacatcggcttggtcgatcccaaattcggctggcaaggtaaaaaccatattaaccgatgcaatcacaacgcttttccctttggctaatctctttgcttcatcggccacagcttcatcggttacaggagtgtttcttaacgcgccattcctgcttcagctttgttttccttagccgatgattgatttcctgctcgacttcccgaaagcgctctcggtttctcattctttgaacccttctgttctaattctttgtaaatatactaggaggacaccactgagttttcctctttttgtcatcctccgggtcatgatcctgatttaccgggcccaacctttgatgaacagaaacccttgcatgcttcagccgattgcctttaatatacgactggcttgaactctctgcaacgttgccgcattcaggacagtcttcaatagatggcagcctcataccttcattccaacagaatctaaagaactcacaactctaatgaggatcgaagccatcatcatctttctcgtagcgcttctcctgttgtctatcgtacttcttttggtacttattgatgatcttagccgaattcacttgaaaaccccttgcacggcccccatcggccgttcggccagctgtatgcaccatattgacaggaaaaggattgccatcaaccttcatcggcctcttggaatcatcaaatttgattttgcctccttcgatagctgtttggatctgctgcttaaagaccttgcaatcattggtagtatgagatccagaattgtgccatttgcaataccttttcttgcccaattcctcagcggatggaatagtatgactagcaggcatttgaatctgcttctctcggagtaacagatcaaaaattttgttagcattggtaatttcaaaatcatacctctcctcttttccagaattcttcacccattggcatggtataacctttgtgctccttacccattcggctgcagctatttcagaatcatcatcctcatcatccgatccacacatgtaagaacagacattattaaccttcctagaattcctcctagcttcagcaaacctctgctcgtgcaaagttaccttttgtgtaagatgcgataagctttcaaagtcctcagatgagaatttctcccggatcggagcaatcataccctgaaaagccaaatcggctaactgggcatcagttaaactcaagctaaagcacttattcctcatctctctgaacctctgaatatattcatgcacgggctcgtcatgtttctgcttgatcactgtcaaatcagacaacttcatctcatgtaccccactatagaaatagctatgaaattgcttctccggatcggcccagctgttaatcgatccaagcagaaaaccaagtaaaagccgatccagccaaagacaatcgaaacaacctaaccctcaaggcatctacagccgatgcttcaccacactgagctaaaaatcggctaatatgctcataagttgatgtactatcttgccctgacaactttgaaaaatctgaaactttgaaccggttagggagagggactctctcaaaccattcaggatatggctgtcgatataaatttcctgtctcttttggtttaagcccaaactgttccctcatcacgtcagcaatcacatcggcccatggccgttattgagctgccccttgcgattgttgctgcctgggctcaaattgattgtactgtggagcaaattgaggctgaattaaccccccttgctgatattggtcttgcggggaagggagttgatattgataatttaaattgcccccctggtaattttggtagtttggctgaatatttcgcaccaagtgctcagggacaatctgaggtactaccatgtggtctggctgcatgtgatggaccaaatgctctggaacaacctgattcgaagtatgttgcccagctgatggattcatcaagccttgctggtgaatcggctggatagtctgctgtcttgatggcgtttgctgaatcggttgtacaatctgctgccttggtggcgtttgctgaactggctgcacaacctgttgctgaattggttgtacaacctattggattgggggtgtttgttgaatcagctgctgctggactgggtcaacagcaaattgaggtggtagaaatatggcagcaacctgatcttgcattagctgattcgcaacttgcccactatgctgcggctgctctctcgtcaacagccgaggaaaaagcgtgttgacagaaaacacgaggcctgggagatctgcttaactccagtgcaggtccaaaactcgccttcggatgtgtgagcgtgccagttgatttgatcctgcaatcaacaagaaataaagacaaagaaaccgcgattaatcttataaatgatagccgatcggctaggtgccgatgacgtatcatttattttaggccgatgtcatgtgtagatcgatcggcagtcatgaataattaagaaagaactaagtctactcgatcggctgtagacattaacaatatataactgttatgtcgatatatacttaaatcaagtgattgggatagatcggtcgccataccgagacagtataaatcacttagatcgaaatataaattaacgatagaactatatacgttcatagcatagccgatcagatagatctagcatgtatcggctaatactccgataccacttcaaattaagatattgaagcaagtagaatatatcaaatagaagcataatatacttaaatgcatcaagatcttaacacaaagggcggatttaacatatcaattaggcatgtaaggtaaaagaagttaaatcaggtaagatcggctgaaaccccgatgctacgctaatcggcaactaggaagcaggctagagattgatattctaagcacgacttaatagatcaaactcaactgatgcagcattaagtatgaaaagaagaacaatatctagacaatcaagctgctagatgtttcatagagtggtagatactttatacaatccaagctaatattgctatttaacctaatcggccgccttctaccaacagatgttagccgattgtaggttagatgacgatattaccaaagattatacaagatatatgataacttggcgagttacataaacaagattagagtgtcataaagatggaagcactaatcccgagaatacaagccgccataacaagttttacctcttgttgaagatcgaaaccgatgcagctcaacccggaagcaagaacccgtcgaaacaaaacaaaagtaaaagggtggcgatgcgccgaaattgtattgaacgtgtgttatttattacatagggctcggggtctatttatacctgagaattacaagatatgtctataccggacatgactattatctctaacaaactccaagataccataagtctttgcggcagacttttgcccaaacatatctctaaggaaattacataaaatatcctaattaatagatacaattgccttctcaggactctatccatgcgtggcaatcatcttgaagcatatcaactcaacccgatgatgtacaccaaatcgtattcttggaatcggctgtat

SEQ ID NO: 32036 - DNA, 654 bp, Oryza sativa
ccggcggatcaggaccctcgtcatctcaagcttcatcgaggcaatgtcgctgcggatttttcgatgaaggatacttctactactttggacctgggagatttgacccaaccagagtacatgccctgacaagatcggaaccatcgtcgtcaacattttgatccattgagatcatccaagccacaagatacgcggtgtaccaacagatgtcggattatatgatgtcaaacgagtacgcaacaaggtaattgctagattggttttttaaaattaagctactcatttcgtagatatatccgatatgtatctataaaggtacgcaatattccatatgtgatttattgtacctattcttcagatcaatacaatatagtcaaatccatgatttattatgtttacctagagcatgtttttatacaatatctattgtacgagtgtttctgatgttaggccgactacggtctaatattgggggctcgctctgttcctgttatataaatcatgcttgtttacggtttacataatgcctgatatttaatctgctcgtcatatcctgataatacaagaagattcatgcagttttttttgagtacatattcaatattctatgctacatatcttgccttctagacaatatttttcaggaacaattgagca

SEQ ID NO: 32037 - DNA, 6406 bp, Oryza sativa
aagcaacataataaaaatgtaataccaaagcctgtatcacatcacggagttcccaaccaaggagaaatgggaattagaatacatgaagaagaaaagatagcgccaaaatcagaactgaaaagctaagataataaacatgctttactcattttaaatagctatggaagataagtactatcataaactgcactgcgcagtttcttttataaccataatttcagcacgtatctagttaaatagatcggacgagcatatgattaatcaacccatctagatataattaaaaaatcttggtccatgtatctggctcttcgattgtgcatgcagtctagctagatcaactcatttatagtacgagtcatctactgatatggcttttttttttgcccttttatggcaccaaccatggagtactgtatatggtagccgttgcagcatgctctgttgcaatcaatctgagaaaacagctcgttagtcttgagaaaacaaagcattgtcctattccaaacattggcacacaatcatgtaaaaataccaaaaatgatataaacatacctaacaaaatcaacagttcagtttttatttattcatcactctggcatctcgcaagagggcaaaggcacagaaagaaaaggcacgaccatccatccatacaaaccaaattgtccacaaaatacaatcaactttccgtatcacccaatcataaaatctagtcagctcccattattttatcgattttattgttctgatcttaaattaactcggagataacatgaaagatcgaaaggctaattctgacaagtgtgccccttaaacagtaaagtccatagcaaaatgatgcaactataggatacctagaccacgccaataaactggaggaaaaattaagttcccaaaaaatatcaagggccacaagaatagtctttcaaagagagtataaaacacaaatctctacagtgggctaaaggaagggttgaagtcattcaagtgcatattcaccaaggtactgtttgtacatataattgaaaccaagaaacaaccaaagtaagaaaataatctcagttacaacaataagtaagattttgatgtatcgagagctaggagtacttgaagatactttcctcacacagtgaacattaaacaaaatcgaaacccttccagtaaatcacacagtgaactcaccttcagtttaagaagcacaaaaggaacaccttccagtaaaaaatctgcagaggatgttgtgttctagaatcggaaccctcaattcaaggagttgtgcagcaatgagttactttcatctgggagcaaattaatcaagcatgacaaaaggtatatatatggttcatgtttgcaactccaccctctcttctttcctccatgatggtctccttcgaaaaaaaacctgccaaggagaaaaccaaccaaccaattttagccaaaaaaaagaaagaaaaaaaaaaggaaggaatagagcagagcactgacaccgttttatcttttcaatctctttagtttcaccttttgttgtcacagccagcactgtcttctaaccattgccaatagagccacaacacagcaatcactgaagtcattccaagaagggacagatacagggctatcaaatttcagtttcactccacaaaaagcagacaatatacatgtgaatcaagatataccgtggatgagtcgacgtgtggggatggcggatccgtgggtacaggctatcactaggggacaccgcactcctccatttggaacgccctcactctcacctcatgttcttcttccctgcagaggcgatggacagcaaaaaatagatgggtataaacgaagacaacaacctgagggaaagagggaccgacctaagaggtgacgcgcagcaagcggccaaaagctccactggatttgtaccgccatctaggtttggagcctgcaacgacagcgaggttgagcgaaggacagatcggtgatgaggggcaagctcgagagcctggcaacgtacggctctcctcttctcgctgcagccaccgccttccttgatgtcggttctgtcaccactgccgtttcttcgatggcagcggcaacggagggcggagcagcagccgtcagcgatggcgccgaaggacgcagtggcagcgctcggcgatggcagcggcagtggaggacggtgctgcggcagtgctcggcgacggcggaagcggcggagcgaggcagaggcgttcggcgatggggatggcgggaggcggaggtggtagcatgattgggaggcagagggggcactcggcggtgacgcgacggcggcgcgagggggaggtggaggcggcggcgctggtgacggggacagcgtgaggggaggcagaggcagcagtgggggagagggagtgggagtgggagcaggccatggcggctagggtttgggggtggttagggttagtgggtgtccttttgcgaaaaagccactcggcttccgcattttagagcgtagccctaatccgtgatttttctcttcttcacatgcaatatccatatttcctaagggaatccacgtaaaataacacctcagaggtactgtttgggaaggagctagatcgaattacgcacaaatcggaggactttttggcaaaattctaccgtgcgcgcactgtagcactccgacgtggcatcacccagcggccgcccctaccgcgctgctcaatgttttccgatatacagcttaataccatctactatacagatagaagtcatctctaggatcaaagcattaattgatgtaatctatttgaaatggctaactagacaatccgttgtatgggtttgtctaatattttatttagatatgatgtggaaaattatatagtcaacgtcagattaaacacgaggttaaaagactaattcattaatgtggatagaaaacgaggagggagtattactgattcgatggctaaagagaactagtgaaacccactctaaaattacagtacttattatagttcagaaaagaaaattgttgaataggagtaacatcgtttattcaaatggcaccactttccctgtaatctagaaactaaaaataaataaatatgcatactaatgtaattagccttgacaactacaaagctatggactggagttaaatccccctagtagataggatcaacaatttgaatgcataacatgtgacatttcagtttttttttcttttgcaacagttcaggattacaagatttatgcagacagcttaaaatcttgcagcataatgaggaagcacaatatgataaaactgtagacaggtaaatttccttatccccaaaaaaaaataacaaatcaaaaatcactagtatataattgaaatattttgactgttgtttactgattgaagtaggacttcgattacttgacaaggaatgcttacaaaagaagtgcagaaaataacacatggagtactatacaaaaggattcatcaatgaacatcaaggatttgtcttcaatggtcagagttccatcaatgtattttttagaacacgcaagagatctgcgtattattcattaagacagagaagttccatctatgtataagggggcaccaaaggcatgttacattagactagtggcagaagaaagtccccagcattcattctaaaaattcttgattccaagggactttggaaaagagactgggagatttgagcacattaaatgaaattggaaaaaacttgctaccattcacaacattaacgacacttggttaagcaatacagattgtgtactgaatttatgcccacatgcatcatgcatgcaaagatcagtacaataaaagaatggacaaattgtacatataggctatataaatttcacatgcgtacagaacacaacatgaaacatataacatctctacttcattagataccaactatattgtgctctgtaaaacatccaaacattgcagtgaaacattgtataacatatgatttaagcacaatgagaaacactcaaatgattaactttgccacctaaattagagactgtcgcattacattgctacttgtgaagacaatgataaagatacatgcagatagccaccatacaggtcagcacccaggtcacagatgaggcatgtaaactactgcaaaagggacaggacatggctaaaacctacacctaaaatgattctgcagtttgtcatctagagtacatacagacaattactgagaccaaacagcagcagaggaacctacaaagccaacaaatttagaatttattttagtctcttaccttatcttatggtaacaaacttgtttgttccatgcttcgcccagaaggtcttcaggtcaatcggattattaagattgtagccttcgctagcaagcttctcaaggactttcttgaacgcaccatggctcatcttcctacctgcgattcgtgcaccacggggcttcatactcattggcagtgggtatgttgagacggtggttgtgcaacacgcagattgccaaccaccagcaccccaccgatagcgctgttgcggtgcgcccgtgcaggaacaaatgcgcgtcggtatccttgagaggtccaaatcaataccattaatcaccatccctatattcttcctgggaccccttctccgcggtgctggcgcactgggtggtgcaccatcctcacatggagcagcaggcttcttgggcttcttaggccttagtaccttgggttgcctgccctgctgcctcttcttgggaggtggtggcttaactggcacattttcctccatcaatggcggggaaatgcattcctcttttgggtgtggaggtgatggtgggtgttgcagttgcggttgaggctctggttggtgctgcaacatccgcagagtatgcgtagcaggcatcatcccatagccaactgggtggtcatgatgcgcaatgtgtccaccatggccaacggacagagtgtgaagaacctagggctcgcggggatgatgatgatgttgttgttgcatgtgcatccacatgtcattgtgcacgaagttcatcggcatttgaagggggagcctccgtggcagcaggaggaggaggcatagcaccaccattgccattgccattggcattggcattggtgccgcagtcacgcgggtgatggggctgatggtggtggtgcgggacatactgctgatgctggtgatgatgcaggaagggggtagcagagagcagatgcttggtgtcacggtcggcgggcaccgacgacatgagctgcaggccgaggttcctcgccggcggctcatagaaggccccccaacccctcaggccccatgctgctcatgctggcgtcgtcgttcatctcgccgccgccgaatcctacaaatcaccagccgaattcgaacaagggccgcaatgcacaagtgcggatctaacgccgaacatccccccaaaacttttttattttttggaacaaagaatcaaacaaacaaaaagatgttattagtatcaagggttgaggaaaattaaggttccagatccggatgatccagatctagaagagaagaagcttacctagggttcattcgagaagggaaaagaaattaagaaaaaaaagagagaaagtgagaatgcgtgctcaccgagttgcggcggggaggagcaaagccgccgcccgccggtgatgtgcgattggcggagggaggaatggatgtagatcgggcggggggcggaggagaagtgggaggaagcctcgcataggggacgatgagacggggaaatatccgcaacgattttttcctccttttatttactttttcttgatatataataaaagctaggagggatgtataggtgggtcgggcccaacccagcttagccaagccaccacatgggcctaagcatgagcacggcctagcttacgcctgtctggcccacttatgtacgcactaccatgttgatgcctaaaacgagaaaaaaaacgataaagtagtattaataaaaaggaaaaattacaaattacccctgaactatcgcggtcaaccgaattaccccctgaacctaaatatcagacattgcttaccctaaacttttaatgtcggacgaattaccctcgtcaacactgttttgagcggttttgatttgaggttgcacacgtggcgccaacgtgtcattccagtcggcaaaaagaaaaacctccctagacccacccgtcatacctctctctcgcacgcgcgcgcagacggcggtggaggcagaggcggagctcgctgagcggccgaggaagagctcgcccgggcggccggtggcggaggcggaggccgaccgagcaccagcatggtcccgttcatgtggctacctcctcgcccgcagcggccaccaacgccacaacagcaagtgtcatccatgcaacaacgacaaagggggggaagggggcatgg

SEQ ID NO: 32038 - DNA, 32825 bp, Oryza sativa
  unsure (1)..(32825): unsure at all n locations
ccccatcccctcctccccacgagccgccgtgcatgtcgaccaccgccatgtgcgccgctgcccatcgcccgtcctcgcgctatgccatgcgtgccgccatgtgcgccgcggcccactgaccgaccaagagagagaaatagaggaagatgggtatgacatgtaggtcccaccattttaaaaaataaaattatgactggattgccacgcgtacgccacgtaggacaaaaccgctctggattagatcgagggggtaattcgtctgggattggaagtttaaagtgagcaatgtctggttttcgggttcaatggagtaattcattcgaccatgatagttcagtgggggtaattcgtactttttccaacgtccagtgaaccccaccctacaatacagtattcgcgtgacaaattcttaagctaaaaatcagtattttagtcttttatagatgaatggagtagctagggtcaatttttcgacatgggtgcgaagtgatagtagctcaattggttaggttctttttggtgaaacttgtccatccgggtttaagttatagacttcaatggtgcttgtatttacagctaggtgacgtacccattgacacttaacagcgagacacttgtgatgacttcgtctattcaaaaaatccagtatttggggtacgctcatagggatacgtgttcattgggttgagtcttgagtgtgagcgcttacgtttgtaaaaggcaaattttgctacaggacactttgacttcgtggttttagccgtgggacaccatccgaactcacttttgttccaatcgggtgggcccctgccgtgtgcgctgcgtccccctcgaggaggggactgacttcgccgccgccgtcgcacgcgagggctccggctgctacgtcctctccgtcctccgccgctcccgcggcggccactcccgcggcggccgctcccgccgtcctcaccatctcctccgccgcgatgagctcgaaccccgtgccgcttcgccaccataaccaccccggcttcgccaccgcttgcccagcgcttcctcgtcgcagcctcctccgtcgacacacctgccaccgccttccacctccctgccccctccactcccgccgagagagggctggacaatgatgaagacgacgggcagcatagcggcgttatggaatgaagatagagagagaagagaagagagataggagagttgacgtgtgggcctaaaggcatttttgacatttcacacgatttttctctcctcttaaaccggaaattatcattctaatcggcgcgatgtccatcggtaaattaccacgtttatggagtgttttcctccaaaattgagttcgggtggtgttgtacagctaaaaccacgaagtcgaagtgttccgtagcaaaatttgccttcgtaaaaatatcaacatgtctggcaatcgttgattttactccagccagatttgtatattaagttacaatcaatgtacaattatgataaaatctcccagataattccgttcacaatctatctaattaatgcgtgggcgtttcgatatgatccaaagatatctcacatctatttcgtctataaatgcaaaattaattgtaatatactatatatattcgtcggccaccaacaaagttatctccaagaataatctgctgttgtgcgagaaggagtaatggatccagcatcacgctccctctccattattttcttcttagtcgcagtgacatttgtggtaatgtatttttttcctttacaaaataatttattttatttgtcttctaacaaccgctgttaccaaaccattaaacttcagacaatattgtttagtttgtttatttggtgttccaaaacaatatggtttctgtttattttcatcacaaaggatgccctcgttttgttcttcaggttgaggtgtctgggcagaagaatgaagcagtataccatttggtaaatttcatatcacactagtattattcttttgttcgaacactaggaaatagcggtacaaacagaatccttcatttgtttgcattcaatttttctcctcctttccacttgattgattatgaactttgtgttgcagtttggtggtgaaggctcgctcaccaaaaatggtaatgattatatccgctaccctccaaactaaatctggtcttttcttattaaaaacacaacaattagttaaaagtaggggcgcacgatgaaacatggtcaaatcacctataatatctatgagtagcatatgtataggctcgaattataaatctaacacgagtcaagtgaatacttcctccttgcatccaaaagtcttatgcgtttcttttgtaaccaagaccaaaaaaaaaaattatctcaaatgtaaaaaaaactaagaaaccaatgtatacatgtagctaatgagtacttatttagatggttgttcgggctccgattaataatttaatctagcacagtaaaacaaaaggacaccatctttcttttggtcttggatgtacaaatattataatctcatttggaaaattagaaaataaaatatgtacaagactttgaaatatgttagctaaaaaatgtttctgtcgttttgaaatgccttaacacgtgtaattttcttgtgtgttcaagaaatctttcttttttaacaaaatgtcaagaagtaactacccctaattagatttacattgtgtttctctttgtgctatgtgtagagtgcccagggaaatgcagctaccgttgctcggccacatctcacacgacggtgtgcatgacatactgcaactactgctgcgagaggtgcctgtgtgttccatccggtacatacgggaacaaggaagaatgcccttgctacaacaacatgaaaacccaggaaggcaaaccaaagtgcccctgaaatcaactatgaacaatcgatccatccatgaaagcttggaatgtaccatctgaaatacaatgcttcctgaagcttagattcatatatactacttgtgttgtcatttgtattgttggagaagagtagttcaacttaataaaagttatccatattttggcattataaggcaatatattggttgacatggattttccatgccattttgaatgtgaagtgtctgtgaactggggatagaagagaaaagaaatgatacaggggaataggggatggcacgttagagcatctccagtgatgaaccgattcatgcagccacattggttgctctaataaaccaaaacaaaagtcaaaattttaaattttaaacttaattttgaagttgatttaaaaatatttttaacgtgttttttttctgcattgacttttaagtcgttaaaacacatatataaaagttttatctataaattaattttttatttcctaataagctattttggcttattagggaatataagcaatcgatgaagacctaagatgacttctaattcctgaaagaacaatagcatgggcccaacttaaaaatagaaaaaatcccacatatctcaccaactcatttaactgtgtgttttaaacttgtatggcccattttgaaataaaaactccatttagagagatgagaacgatggccgactttgtgactcaaaattgagagtcgttgtctctagctcctcgtatgcatcagtacgtcaatccatgtatcgatcactagagatgctcttacatcgatctatctttatttttcctatatctttaaacaatcatttactacagaccgtttattttatcaaatacaaatttatagcccatcctgcagctcatattttgcaacctctgctgcgaagaaaagcttgtgtgttccattccatcagtcaacaaggaggagagcccatgctacaacaacatgaatcatgaagaacaaacaaaggcacatccaagtgcccctgaacccgaagataatgaaacagacaagtagataacgttaattaggagtagatcacgattgctctttagaactctagagtagataaataagttttgatttatctgtcatcatgaattcatgatgtttttttttaataatgaaatagaatcccggcctttgctcaaagagttacaaccaaatgaattcatgatgtatccattttgttgcgttatatctgtactttactttttatatatagttagtacctattattttctaaagctcaacatgtaaaaaatatcacatcgtcacacactaacaattattatctacaatattttaaatcacatataaatatatcacatcatcactcactgacaattattatctaattattttaaatctcatacaaacatgatatatcatttatgattttgttgtatttttagatcttaatatataagcgatgtcaaatcatcatctccacattatttaaacatatacatatatgatttatatgatgtaacatatattcattcacatatcaatatctccacattatttaaatatatacatatatgatttctatgatgcgctccctccgttccaaaatataacaacctacatacatcaacctaggaggggtcacatcttctaggttacccctcctaggttgctatatttagtgaaggagggagtaacatatattcattcacatttcaatttctatgatgtaacatatattcaatcacatatcaactaatattagtacatacctatttttcatgtaccatctagcatcattttgaaaataccacggattcttgaagccacttatctttttctttaaaaaaaaacctcccaaaatgtaacaacttttggcagtgtccagattcatatctaaatatgcttatattttaggatgaagggagtaactatcttaatagcaagtgacgcatttgttttgttccataaatcatgcatcatcatcatctacaggcaacatcagaaggttgaattattttctaaaaccaatatctcaacacgaattgccaaaatgttgatgatccagaaatctctatttcctacggcggatattcttccacattcagccatggtaaagcgggattacattatgttgcatcccaatgcaacagacatgtcaagaggaacctaaaactagttaacaaaagatacttcaatattggaattccatacgaaataactgtagttcatgtgctcgaattacaaaacctttctgaacagagtactgaagcaaaagatgaatccaaaacaagttctagcgtctcatacaatacaaaagcagggaagtgcaaaaacatcttaactcccaaaccacaaaaggaacaacagacagtaacaccggtattacatatccagccttgcaaagcggcagagctcaagcgccaggcaacaagtaaacatgcttctgcctcttttggcaacaatgacgagcacctagaacaaccgttcaagcagctgaaatggtgcaaggatttgacagagatcatcattaacattattaggggaataattacagtactagtaaagaaaactgtgatgccaacaaaaacttactgcagcaatcaaatttcagttattgtgctcatcagcagcttggtgatactggtagtcaccttcatcatatgcctcgccctcttcagggccttcaggttctgtgttgttaggttgcatctgatagtactcatgctcatgtcgctttgagcgctccgtctcataagcatcatggcttttgtgttgctcatagttatagccatattcctgatcatgttttggctcaccgttggcaaattcagcatctctctcatgcatgtgaccacggtcccgttcatgacttgcacgctcgtaatctctctcacggtccctgcctctctcacgatggcgatcatgaccacggtcacggtctctctcataatcccgaccacgatccctgtccctatctctatcacgacgatcacgctcacggtcacggtcacgaccatgatctctctcccggtcccttcctcgttccctgtcccgagtcctgtcccgatccctatggtggtgtctatcttcttttgaatcacgctcgcgagtacggtcatgggatcgttcacgagttctctcatcacgatctctttcccgtggcctttcacgagacttctcgcggtccctgcatcaaatcatgagtaataagcaccacaattagatgttaatgcaggaattccatttatttgataagatatacctatctgcacgacgctcatctctcctaggctcctccgatcttgggcgtccagcgtgctgctgatccctgaacataaaaaaaaacatgcatgtgttcagcatcaattacatggatacttaaatatatgaggaacaatagctatacccaaataagcacccaaaatcttcactgcactaaaaaaatatgcacctattggagtcaatgtccttacataacaatatcaaacttcaatataccgaaaaggtataaaatcacctctgataatattagtaatgaagctcaacatacagtaaggggcaaaaagagaaaaatggtatcaaaggaacatatccaagagcgcataaagcatttatgatcagttaatttttagtgctcacatcacttcttgttgccttagatcatacaaaagtatttgcttccttcatacaataaaatggaaaaataataaatatacctagtggagagcttctgttcagcattttcaccaccaattctgcttgatccaagtccaccacccaatctcctgggacgccaatttggaacagttctaccacgctccacatcaactagcaccctcctattgtccacttttctcccatctgcttgcttgtaagcatctgcgagaacacatattagcagagaaaatgtaagacagcacttcatcagtgatgacgccaaattggactgtatagaggagatatgctaaaccagaagctttacttttcatgtcccgggtgtgcatatactcgatgaatgcatatcctctaggtttatttgtttccttgtcggtcacaagccgtacctgcaaaaagctcaaatgtacccattaaggtctttccaaaaagaaatatgcactgaacttaagaatgttgccggttgtcattacaattgtttgtttgttttagcatatattctatgctgcacgacagacaggcataaagcctaaaacagccgtgctaaccttgcatatgtagatccttcattacgaggagtgaaatccagcacagatcaacacagttggaggcaaaaagcagtctggctgattggcgtttgtgggaaatacagtgatacccccttaccagggaatttactagattaagaaaagaagatggtggtggactaaatacaatacccatttaccctctccattgcatatagttcgttcagccttcgtcggtaagaccatcaaaatagacaacggttacataaatggaggtgacaaatagcaagtcagtgatgtctattccttacgctgttacgcatcagaaaatggagccatcttcaactctaaaagttgagatgtcatttgcattatattttgctgttgtttcctccaagagaagcagcacttgaaagcagaactagctttaacagctcagggaaagtaacataaacactgtactcaccagcaacctaataaatcccagaatgtagaaaccccatgcctgcagataagctgcttttaaaagcataaagtgatctaagcttacttgtgccatcgccaacattcttcaagcttgtttgctccagttaatacacacgagaagcaagttcatagaatgggaaaacaaatgatacattgtgcctactgcagaagcaaatggtttgatcttttccgagagtaaaagggaaaagatgttctaagaaaaaaaaacatcaaggctgcatgcagtaaaaatacctgcttgtgtgtatttgtatttcccaggattttttagtcttctaatggttgtaccaaccattcgcacattaaattgctcaacagtaactcagataatatgtctaacaaaaattaccagaagacataatttctgctggagctctatattacttatccactaagtacatcaacagagcccacatgtttagaaatggataacaaagaaaagactgtccgaaccacccaaaccaatacatgtcaatacaagataaaagtgttatttaaataatttgagaagattatttggttattttctccttggtttagcaaaatgcaaccaacatcattattgagaagcaaacagcaaatgcatgcttacacacaaaacagtgaatgtattgcccaacttgaaaatgagagtgctatgaatactgtttgacaaaaacaagaagttatttttgtttgctgcaaaaaaaaagacttgacagaataacttatttttgttctttacaaaaaagaagacttcacagcattttgtttgatttagaaacaaatactacagacaattctgcccattgaaaatcggagagagatagaagatatccctttcatcctttagcaccttgttgtgaaattccaagtaagcaatatataatggcagtgaaccagctttttcttaaaacatgtttttgtagatgaattagaacaaccaaacaccttaccaaagaggaataagtccacctgcactggaatttaccacatgtacttacccttttaataggcccataagcttcaaactcccgcttgaccctatgctcagacgtctcatagttctgtaaacgtttgctggagtcaataggaagtaacatacaaaaataataccaactatgtagttcaaaataatttgtgaatgatgcaacaaaaaaacttacaagtcttgcaacaaagagtgttttgtatggatctccagtggcattggggtcactctgtgggtcatctacattaagaaaccacaccaatgatgttatcagtatctatcatatgatacaaagggaagagcagctaagaaagaacttacatttctgaagctcttcagccaccttagccgcaccttggtcaagcttacttttgcggatcctatccttcttttcagcctgcgtaaataaaacataatcaccaagtcatgacctggaatgatgaaatgacaataggcacgaataatacagtagatctagaaacaataacagacatggaaaaaaaaagagtaaagccagtagtgccaacaaaaagctgcgtatttgacatagtcacatacaattaccagaagaagaattttggcaaacaaatgtttggacagctacacatgtcttattttgagagagttttcatgtggtgaaagtggaaatattcatctcagaggtgggaacatttgactccaactcttacctcgcaatttcaggtagaacttattggacctaattttcctgtgctgactatagtggaacaatgctcaaacagtcaaattgtgagtgactttccagcaggtgtagtcatagaagctcacatactaatactaacagtcttaagaaatcctgattgttcagagaccagcaagcgttctgacaccattacaaataattgattttgtcgattgaaaaaagcaactatatggttgtggaaactatgcaatatggttatggccacacgaaaagtataccattggcataaatacgacatggtcacgacaacataagaagtaggaacatcttgcactacggagacataaaacaaaatgcaacactaacgattgcgcttcaaacgagttaaaattgatacagaaaacaaatttgcagcagtatcagtataccttggtctcgcatgtggggacgggtggcgcgtactcagggtcaccgggctccgcaaactgcgacacgaactgcgccatccctgcaaccaaccaatcaacaacaagagtgagtccatccatcaggaagcaactcatccacaaaataaatctaacagacaaaattaaaagaaaaaaatatattcataatccccctagaaccgaacagatagaatagaagatgaggcgggtgagggaatataccagtgtaggccggcaacttgcgcttctcgacgggcggcttgaagtcgagcggcgggcggggctcgaagagcttgagcaggttgggggtgaggcccgtcgggtgtccctgccccatctgtggtcgcgagccatggagagagatctcagatcgaggcggatccggagaggagctagggttatagcagctagggtttagggggggggtgggggcttaccagcttgagctgctgcacgttgacgcgctggcccttggtgcgggactgcatcccgccgccgtccgggttcccccgcatcatcccgctgccgtagtcgcccatggccgcggcgccggcggtggcggcggcggcgcgaggagagagagagagagagaagcgagagggatttgcgattcgcgaagcgttgggggatctctctttctctctctcgggatattaggggaggagagagagaagtaaaaagagggggaagccgagacggaagaattttatgtggggcccacacgtcagcgccctctcgcacgggcccatgcgtcggtgacttagtgtatgcttttgctgcctgagcgttgcagggatctttgctgccgctattgaatcacgggggctataatcgtgtgtcacattttttataaatagtaaaatgcccgtgctaacgctacggcgatatttgatgatgcaaatcccttctctactattataaaaattgaagatgttttcgttagaattttggtacatcatctgtattggaataggttttaattttatgtttctattaaatcatacgcgtacgaagtaattaggcatgcacctttttacgtgccccttgccgcttgcagacctgcgcctgagttcattttccacatacgcctctgtgctcctctgcgattgggcccgcaacaccctcacgcgtgatttttcgcatgcctgattgggcccgtgacgtcctcttaaatctaccctattagcatataagcactttaagggaaaaaaaacgagattcccacttgatttaatctttggtaaaaaaaatacaaattcctacttgatttgatcttatcaggcctttatttacctgcatgatatcatcaggcttccatttacctatatcttcttcaagtttattggacaacctgattgcaattaaacggcatatattttagttgtggtaattaagaattaacatttagttaccaaacgtccatcattgatattatttggatgcaaatcgacgcacatacctcatgagcacatgggaatgaggatatgaagaggagcgctgctatagacctagggatgaaatgctccaataacaaatggtataagcacagcagagccataatatatagaactggccatcgttccattttactgcctaacgataggttgaaggctagcaagccaaggaaggctatatacctctcagttctgacaactaccttttcatgaactcgtgggcttttttaagctaaacctcagaagacaatagggaaagcctgtttttcatctaagaataaaagacttggcctattattttagaaaaattggaccaaaaaactcacaaacacttgcccatgaacctgtcggctaaatattgtagtgtaaacttatctgctgcaagcagctttggagtaaatctaccctatcctaaacctttcttacatgcatattgttagtttgtaccaagcacaagaaaataaatcactcactttaaaaccatctcaaaattacatatatgcccactttcatccattaaaggcatagctgcaacttataaatctgaactgtacatatatgtgtcaaccatgagtttacaatcgaaaggggaaagaatggaaaaacagttagaagagattatgccccagccttgcttccattggctctgcactgatcgaataatcgcatcctaccttgccattctgcactgatttctcttgacaactgcacttcatttagcaaaaccatgaaatggagcatgttcctgtcagcctgctaaatagaaacaaccagcttcttttgttaatgagtggcttccaagcttaacttgttttgctaaacttttgaagcaaatcatgctagcttatggtacaccacaaattgatataccagatcagtgatgatcaataatgctatttgctttttaaacagataaatatgaccataagtaacagagaaatgcagttgttttatatttcttttttccccacaaatttgttgcttggtaatcactattaattggaagcaccgtataactcaaaagcagaggtcatctctcttgaagcagctcctcttaatggcgaaaaactatgtcaagagaaatgagtacagatcagtggtgctgcatttgaattcctctgcaatggcaatagtccagaaaaaacatcaatttcaaagatatttaaagaaatcgagggcaacattagtctgcattgggttggtaagatccgtccgctagattggttctggaagcaagcaatgatgctctgttagcaactgtactttggaacgttgggtcatgcatttatggaaaatgggagatagaaaagagggaatgacaagcaaaatgcaaaaataaccatatgtttgaaataccagctattcttgtacaggaataaatttatatgctagtaaggaaacaataatctcagctctcacatcaccaaacaacattgaagcgatgaactctgacagtctgccattcatgtgatcgtgtaaatcagttagcgtaccgcttaaattaattatattaaagatagggtaattcaaaagcacattcctgtaaaatcactggatattttaatcaagtagctaaaatgcataacacaataatatgtacccatcggcaaatgaaaatacatgcctgtttgaatggtcaggagcagtggaggacaattgtcatcatctccaacaatggtgttttcttgagcagaagattagcctgttccaatctattgtgataccatgaaaaacaagggaatacaaatcattcaggattaaacaaagattgctaattacttcagaaataaattcagcaagcagaccatcagtggattaatgctgggttagctgtttatgaacaaccaagtatcacatgtcctattttgacccctaaagctctaataaacttttccttttgtccccagactatcatgaatgcatcgaacaatatgttagcatttcaggcagcaaaccaaaaattagttgtctctaacacattggcgtaatacattccaaccatcgataacaaaattgcttgatgacaaaacttgatttgattagcctggataatgctagcttcctgcaatataacaaaacttgatttgattagcttgcagtatcattttcaagtgacattggaaaccaagtcctgagccatctacttaagaggatagaaattgttctctccatcaataaacaataaacatgaattaaaaccttttagaacttccattaaaaagctttcaaagaatggttttttgttaaaatgcatataatggtatttatatcatcatccattagccacaatgtctgttaaatactatatattatgcacttatgtacattcctgatcaatggaagagcgtgcgggtctgtccagttcatactaagccaagatcaatggtgaaaaaattgacgtgatcctgaaatgatattttgaaagatcaatattacgaagagaagaggtatctgatgacttcataccatgtgactgagcctcatatggctgttggatgcaaagcaccaaacacttctttcccaatagtaaataaccaatccgtatgtgaggacagacatttttatgggataaatcaaatttcacaaaagaacaatatattccatttcataatttagaaagcacaagaatatatatacttaaaaagcacatgtgaatccttcgtcatggctctgcaattgcagtatttagacacgataaaatttcttacagttcaaaaagctcaagtttgccaagttcagctggaactcaaactttgcacaggcacaactcttttcatgattgttacagggaggagggttgtcacttgtcagttgatgacaggaggtcaggattagttggtttggaggtgacaagctaatggtcgcatttgttttagcacatctacatctttgagtttctattgaaaattagatttgtgatggtgatgacaaattcaatttccttttgagattccttcagtgcttccactattcattcataaaaaaacattaaagattggcatgtggtaatccatggcaaatgattacaaagctacagaacacatcaaccatgaaactcaaaagtacctgcagacctagtcaataacctccatgcagacctagtcaataacctccatcaatttcttgttcgaagaaaagtagctgtagagaaatatttagcgaatgagagaattataaataatatcccaaaattcaaaagagatgcagaagataaaagcttcaattccagagcaaccgaaggaagaattaacctcataccttaaatttactttgtgcggctgaggttactctgattacaatgcctgaccgagcttgttcttcgcttatagttacaccataaaaaagagcacattgcttgtcaacctataaatagaaaaatatatgtggtagccatcccattataaacaagataataaaactggtagtggcagaacctttcctcttgctgatgatccaacagggagcggtctcgctgtaactgttccactcatagcttcttcaagaacattcaagacaaaaggagaactggaaggataaaaactgacctttcttgtttaactcgagcgaaatatttttgttaacctgaaccattgctgaaagaatagaacagaaaggagagaactgaatcctttctaattcttcattataccaagctgtcacagaacggctaccggggcgtatcggccaccacggaggtggaccggtcggcagctaccgacggtggccgccgcttcggaggggtgggggtgtcgtcaagcacgatggttgacgccgcgagctgccaccgcttcgggtctggagggggaggcgtgggagggaggtgcggtttccgcgtcctcggtggcggcggggctaggcggtgcggatgcggcggtgcagaccaatgtgatgggaggaggggcggcgaaaggcgaggcggatggccaggagcgatagaaagaggagggagggcgcggtgattttgccggagggaggggaggcgatccgatctggatcggatcgggagggaggtggagagccgttggatcaacgtcgtcagatgatttccgatcattggatatgtcacatgatgaatgagtaaaaactatttgttgaacaatagggtagactagtaaacgtattataatcgtgcattgcacgtctttaactaaaaaaattaaggctaacatactacaagtgcaatcatatactccttttgaaaacctaattcattgcgtaatatcaataaaagctagagcacatttttttgtttaaaaagatcatatttccgagtcacctacataatacgcagcaattaataaaatgctcctttcttttaacatatatgctggaattacatgtaatgacatgttcggaaagtaatttgggagatgtattttggaacaaaacatatgcatattgttttctatttggatgtgtacagaaaactcatcatatagtgcaactgaggtgaattgaatttcagtttggatcatattgttcctaaacttcctaaaatgggattgacatactgtcaaaaaatcgcaataattgattcacgttcagtttcagcaaaacaatacacataaaaaggtaatattcaggtattgctcattcaatttcagcataaggaacaaccaggaaatattcaatctcgaccatgtactggtcaaaggtaatttacccattaccagaagattaatagcagtgtactatactaaactttggaaggcttaccagtatagattaaactaaagaaaaatggtatcttttatcaggaccaacatctacagttcaacacacatcgaatatgatctaaatatggccatttgcacaaataccagaaaatatgatatgcaacatcgatctataaattgtatatttgattcaactgcgcatcttctgtacaatggcaaatagctatatagatgacctaaaattggttaaaagttattttacttgcgtctattcatctattgagatagtgaatgactgagaaacataacatggtcattgatgttagctctgaatctatatgtgtagctaatatttatccttcccaactgatgattaattctgaattaatcagtacgtatttgtcttcctaacaaatgacataccatttattgctgtcacgaaaatagataattgcagtcaccttaggaatgtaaaatataaatgtttctactctgcctagagcagcttatattagcccacaaacatgcttgatgcccatatgactatatatataagtacgtgatgccagctaattaccaaaaaataccagatgcaggcagtagagaaaaaccataaatgtttctactctgactgaaatgctttataaaaaataattattggactacttaactcaatgaagagtctgttaccatgcttacggactgaaagctcagttaaccccaagcacattcagtacaggagacaagctcaactaaccatttcctctaacataaactgaaaaagcatataaacaaatcagtttttcctagagaaaaagatggcaactattgctacttttttttatccaactacaaaatacaaatgtacatgtcgatagattgccgtgagatcggtggagataaaagccacaagaaagcatgattgctgctctgatttgtcacttgaggcctgaaagataagagaaaacaagtcctcgtcatgagggaaataaaaaacctccaagtacctgacatgcacatcaagagcaaccagactgtggcctgaatgcattaagcccgtgctcgcatcgagttcgattaaaagatggaaaataagagttcaaagttgaagcctgagaccaacctcatgtgtagagaccactgtgctggtggagacgaaaactcgacgcggattgaggctgccggcgccagcgatggtgtttggcggtggggatggccaattcggcttggaccactgctgctttggaggagacagcggcagccgcgtcggtcaacatggacacggaggtgattactcaggtgtggagggatgcagattgtagcacacgcagaccattgccgcgagagagactggggcaagccagcagattatattagtatttttatattagtatagataatatatagtaaactgttgaaataaccataactgtctgttaataatattcaaagcttaacagtagttaaatgaaaatgtatacaaagaaatatcatcaaacggctcatattattcacatcatttgctgagatgaaatgcagtaaaaaaatctcacaaaattggaaagaggatacatgactaacacaaaaatctggttacagtttcacgttcgcttaccttatgaactcctccgtaaatgatgaaacaatggaggacttaaccacttacttttgttgttactatcatccatcttgagcatctaattttaatgctatcaataggggagaacatcttctggagcgggccttgtctactccaagtctatttctccgatatgcattccctcttctgtaagtgctagacttgaacgtgttaataaatcactatacctatatgcgtagctcatttgatcatccattgttggcaggatgaattacatggaagccgaagcgatgagaaagcctgtcggctacctaaactcgtgcaggataagtcagccgaaccacacatacacgctagatgagaggaagctaccggaacacatcaaggcgatgactcccgaagagaggacaacttacatagggcaaaggcatcaggaaaaactgctcgatgtcactacttacgtagctatagcgcttcaatctacgcaggacaaggagtgcgtttatgccccatatgcctttgagtaagttttaatatccactaagagtatatgcatataatcacggctcgactaacaattttgtttgcagcgaccattggatactctttcttctctatctaaagtacaatgaagtcatcgtcttggattctttgacgaagacagcaagacatatcaggaatttctaagaactatcgacctgcaagttatatattatcatgacgtgttttaatctttgaggaatgtaaattaattatatctgcaaacagtgcatttaaaaggtattaccagcaaggcggacaacgcaaaaaatcaagagaacgcatattcgtccgcaataagtggccggtaagtacatatgaatgccaaacagtactactaaaatttcataaatgcatgtgtctatccatttaataacctaatataccttacaatcaattgatgttgaaagtgtcacaagcaaccggtgggaaccgtactatgcggatattacaccagcgagttcctaaggggtaatgggaaatattgcgcgaattacaacgaggtaagtaatacacacttgttaaattaatcgctaacttgtattattgcgaataatttccttaatttttcgtgatttgatgcagcttccaaaattccccaagtctgaaagaggtaatcttagagcagtacctatcctaatttttaattcggtttgtctaggttaatctccgatgttaaccaagaaggtatggagcatgcgactaagtctcctgtcttgccgtaattgagaatttagattaaagtcaagaaattttgtctcgacgggtacaccatcgcttcattccataatccttgtctaactccaccaaccgttctcggataatcgataaggtgcaaagtctgcgacaaagccctgaaatctgacttgactgttctgatgtctgactttcctgaaatcagtagtcagaacatttgtcgtactcgcttagtcgttcccggtgtagaatcgtagagacatggagtcctcgataacgctgaatggaactttcctgaaatcaatactcataacagaatattaaatagaaatagcccctgagcaaacgctcaagggtaacatgctataatatgtatggaaaaattaaaaataagttgaatttgcgtgtgacaataaaagagtatactctctagagtcccttagcaaacggagttcggtactcctcctagcccctagctgtttttatggaaaaagccattttccacaaaggcagtttaaatcttataacaaaccagcccccagccgtgaagttgagaaaaccaattcccgattacacggcttagttaatatgcatccagtgagcactctaacatgaccagatctgacatggtcgtttggctttgcagtatctaacaaagccttatcagctctgggcgttcctagccgaaatccccttaggtttttcggaggctttgttagaatagtgtaaagggacgataggacagacttcaagacgaggcaatacaagaaaaggagatcaacggacaaatattgcacatataaacacttacagaaattggcgtagatgatgagatgaccaccacattgggcaaagaccaggtgtatagttgtactcaacaaatcgctgagttagtaggagaatcgctacaccactagtcgaagaccaattatagtcataactcgaccactggagtttaaggtgcgagagatcgctacggcctaatggttgacaaccaggagtaggcgtctctcaaccatttgaagtcgaggtacgagaagatcgctactacctattggttgagaaccaagattaggtatctctcaaccttttgaagtcaaggtacgagagatcgctacgacctactggttgagaactaggagtaggtatctcttgatcgtttgaagtcgaggcacgagagatcgctacgacctattggttgagaaccaggagtaggtatctctcgaccatttgaagtcaaggtacgagagatcgctacgacctactggtttgacaaccaggagtaggcatctcttgatcacctgaaggcaactgataggcggcgagatgtcgctacaactgtctagtcgataaccaggagtaggcatctctcaatcacctatagggatgctagagttggttattacatgtgcatctcatgtggccagcatgactcacatacccaacttatagcatatctgaatgtctgttcgtaatcatgccgggtgatcaagccgacaacatttacgaggaattatccgttaacaacctattcccaaatagtccagccatagccggtgctatatatgagataaatcgtcggtcttcgttggtaggtttggtgcaacaactcagcctttaccgagaacgttctcgataatggggtgtactcaaccacaacctactcgagtgctcaattgttcctgaaaaatattgtctagaaggcaagatatgtagcatagaatattgaatatgtactcaaaaaaaactgcatgaatcttcttgtattatcaggatatgacgagcagattaaatatcaggcattatgtaaaccgtaaacaagcatgatttatataacaggaacagagcgagcccccaatattagaccgtagtcggcctaacatcagaaacactcgtacaatagatattgtataaaaacatgctctaggtaaacataataaatcatggatttgactatattgtattgatctgaagaataggtacaataaatcacatatggaatattgcgtacctttatagatacatatcggatatatctacgaaatgagtagcttaattttaaaaaaccaatctagcaattaccttgttgcgtactcgtttgacatcatataatccgacatctgttggtacaccgcgtatcttgtggcttggatgatctcaatggatcaaaatgttgacgacgatggttccgatcttgtcagggcatgtactctggttgggtcaaatctcccaggtccaaagtagtagaagtatccttcatcgaaaaatccgcagcgacattgcctcgatgaagcttgagatgacgagggtcctgatccgccggaaaacgcacttcgttcgggtctatcaccccacagccgaagtcgtcaagtagtttgttgttggggaatatatctcttgaacccatcccatcgaaaaccttgaagcaccaaaatcccctacctggcacgccactgtcgatgtttgaggtcacgactagattatttgcatggtatggggatcattggtaccagggtatatacgagattgagttaaaagagatggagaaggattttatacaggttcggacccctttttataggtaatagcattacttctgttgggcgaagccggtgttcctctatactcatcaaaatcacacaagtacaatatttgggataacgtatctagtcgtcgttgacttggtggcatagataaccaacacgtagtcgacgacaggatagtctgcctcctcgaatataaactcgtcgacatcaaagatagcgctagatccctcttatcagcctctgcaggcaccatattgggtttgtctaggctaatctctgatatcgatgtctggcggcgtgtgttgatcttggtcttggtttatcttgtatgttgtgtgtcttccctctcctagggggtcttgtatttatacccatagatgtccccttgtccaagtagaactagggagaccaatattgatgcaatccgagtagtccttgtaatttccatatagaactctactcgtccttccttatccggaactccttctatatatgaggtatgattccgtataagacttggtacatggtgggccccaccgagcttagtcgattactattgggtatatggtatccataaccctgacatgcatcaaccaagaaaccatatcagagcacaagttcttaccaacttgactcattgttagcaaaaaacagtattacatacgcatgtcatgtactcatcattgtgaccgccattcaattaagcaaccactttaccactttatagtcctcctgttgattccgtacaagacttggtacattgtgggccccactgagcttagtcgattactattgggtatgtagtatctataaccctgacatgcatcaaccaagaaaccatatccgagcacaagttatcaccaacttgactcattgttagcaaacaacagtattacatactcatgtcatgtactatcactgtgaccgccattcaattaagcaactactttaccacttttacagtcctcctgcccaaaagtttttggcccctggcctgaaacttctggtcatcccctaagaccgattagaggagctctcacggaagttcctagcgaaaatcatgaaacctccgggcccctggtctaacttggacaaaacctcttctttcgcatgtgtagcagtcccttccttgccgaacgtcaagcattgtttgccattcacaacggcacttgcatggtcgactttcatggggacaaaagccaagaccatgtccaaacttcttgttgcgagtggtgatagtcttgtagagtgcctatttggattcataagttttcatgcacccatacttaccaaggttcctaacctttcattctctttcttaaaggtcaccatagcttcaagattagtaccatagaaatccaaatcataattatagcatctagcacaaccattgctaatggaggcattggatgagtaggtttgtttctagagtagttgaacttgggtgagtaggttccaaaatcaggaagctaactagctgatgggatggtgacaatggttccgctgaactccacaagccattttatctcctaaatgcattgagtgatctcctaatgatccctaaggatgtgctgatggaaaccggcactagaagagaggtatgcactctcatcttgttgaaacaaatgcataattatttcaatgcctaaaatatccatatgaaactatgaagttctcttttctgtgaggaacaatctaataatctaaagcggtctcttttgctagctttcgattggtccatgtggcgcctcttactttgaagaaaaattataaatttatactagggaaaaaaatacctaacaatcatttttgaggaaaaatctagagaaaaatatgattccagaggcttccaaaactattttctctttccaatcacacggacttctactcatttgtcttctataaatataccacacctacttggtactactcctgtaactctagaatatatatagtaaacccaaaattattaagcaaaaaataaatctaaaacaacgaatttacactcattttccttctttaaatatactatgcatactcggtactattagctggctcttttgctagctttcgattggttcacgtggcgcctcttacttattataaatttatactagagaaaaaaacacctaacaatcatatgtgaggaaaaatctacagaaaaatatcacacgaacttctactcttttgcctgctataaatataccacgcctactcggtaccactggtgatgggataaatataccacgccaaacatcgttgatatcactagtgatgggataagctaatttttaacagttacatcatttttcttctgaaaacacaatgtagcggtacttttagaaatgaattctagatgttagaaaatggctcaaaatggctcctaggagagggaaaccacatttggttttggcatgatttttggtgtggtacctgcccattgaaaatcactttcttaatagtttttgaaatctgtaattaaagttattttaatttcagaactggtactgggaagaataggctgcctaacttttagaagatcttttggggaagatgaatttgatgaatggaccactttaggagatgtaattgatgacttaatagcaaataacaatcctgatgctctaaagtggtgtctcaaagctagcaaaaattatagtacacaatctgtttatagagctatcttgttttgtttagagggtaaaggatagaaaaattcaggagatctggcactgccctgccatatgaaaataaaacattttgtctggttggctatgagggactgaatccagtccactaagcagttaaagagaaaaggcaaggctgggaagggactgatatttgtcgcttatttggtgtatttgcagggatactttctgctggggcagagtcccaatatagttttgtgatttctttttaattattagtcagtataataatgagaaaagtagagtttttgctgctcctttagctgctatcggttgggtgctgtggattactataaataacacgattgttagatctaaattgatctattcttctctaatccttcccttcaaaatcatttcccatttgcaacgttggaaaatgctaggtgttaaggatgctgatgccattaacaaaatgaccgaggagctcacaaagacaacggcaaccctgggtgctcagagagctagaattgattgaatagtttctatttagccgcggtagtttttagtatgatagagttgtgnnnnnnnnnnnnnnnnnnnnnnnnnnnnttctgaacttcacccattgcaggtaattttgagccagttccttggtgttctacatggaacgagcataaatgttaatattcacgcggctttgtgaatgggccatccgagttgggacatccaaggctgaggttgagggtgttgctgctgctgtgatctgttgggcagtcgtggatcaaggggcgctgggtggcggcgactgaagattgtttttggaggccgccgtattgtcctcactgcgcgccctgctctaggtctggcaagggtcacctcgcgtgccttttgtcacagctgcactgtcagtggtgtcttcggcttctctttcacccaggttcatcttcgccatctcatttgtacctcggtatatcaggcatcgctacaggagatcaattaggttcagaaatcatcctcatcagttcatatgaataatcgatgctttatcaagcatctctgaattgcatctttagataattgaacaggactaggaatatttttgttattctggttagaaatatccattaggttcatagttcttactcctggatttttgttagatagcaatgcaggaggaatgtgtggaaattaggttctaacatgatcaacactgaatattcgttgcacacaagatgttgaaacgatatttcttcacagttttgacacatccatctcctcctcatcagtcaaagtaacacttgcagtgctagctatctcctattgttggtgacagtagaaagatagttagcccccccagcttccccttgacccggagcaaacttttcacttttttagacgtgactcatgcattgctataacacttttggaagccgagctcggccttatctcctgacagtgtaggtgtgggccctaccgggaggaaaaatatctcccctggctggctcggctcgattttttcggtgtccgttttttaaaaacccggcacctacaatatacaatatatggttggtgtcggatttttttatcggttttttaaaaaaaccgacacctataatgtaagtgccgatttttctctaaaaccgacacctatcttcgtttaaaggtgtcggttctaattttttttcatcttatgaaggtgggaaaagcactatatattggtgtccgttttaccactttcggtacctacagtgttgacatctatccgatgttttgtagtagtggtctgggtcattaggatcttagataattacgttgtgtactgcatggatggcctagtcgtgagcgtggcatgcggctgctagtggcgtacgtcttggcctctaatctgtctatttaagcatgtacttagcatctttgttaattgagagtaaaaaagagaaaaacgctgcgtttgtgcagctccaaactccagtgttcttcgccagttcgcctctggtgtgtgtgttcatcaggagtgtgtgcgactagtgtatctagttagggagtgattcccaacattaatcaagtcacaaaccaaaaaaggattttaaccttcaagtaatgccattctatctttctcacagctgcagctttgtagtcatatacaggatagtataagtagagtcaaagttgtagcatatctattgtgccatccctgaataagtaatattattatccttcaagcttaaaatgagaaaagcgcacaagtaacctaataactaataaatttccaaaggctcgtccatcttttactggtaaaaaaaatagtggtggtgatggtagcatattatatgcaatatgatgaatagtattgcagtatctttttggtaaatgagtgaatcattccattatctattatctgtatatgtatgtggccatttcatttaatgtgaattatgccaattttctagatttggggatactattattttctagtttagaacttttggtatatttataatttacatccatacaataaaccggcaccaggttggttccagtataaaaaaatgctagtgactaaaatatatctacctatggtcttacagaactctataattgtagtcatgatacctacagtacacgtatgtagtatttaggatatctcgtgaaatatatatacttatggtcttacatgagattataactaaatataacggctgctgttggacttggagccctagccaagagaagccgctaagccaaccaggcggcataaccagtaggtttgcactgcatccaatggaaagatgatgaggagcagaacaatagcattactattacgcttcacagtgagtggacaaattgtacgacccaaaaaatagatgtagaattacataatgaaaattttctttccaaattgtaaactatgcgcaataagtttttttacgaaacatatggtattatcgatggcaagccaatataaacaacaagagagaattacaaatatgccactgctttcatctcctaatttggaatagccattataaatacacaaattgcatatttgccaccaaagttggtgtgtgtggcttccgtttgccattgcagtctgaactggtataattaaaaggtcaaaagtttttttcacaaaactaatgtagaaaacaaggaacatggtatgaccgttttgctcttggctaaaacagatccctcactggcttctctctccaagagccctaaatcctcaaatccccttatctcttcctccaaatcgagaacaaaactattcaaaattggttccaataggagatcgagggcaagggaggaatggaggaatggtgacttgggcggtaacagcaagcgcagcggcggggagctgcttcggcggcaacagcttgatgtagctgttgctagtgaaccatgtacatgtctctccaaccttaaactagtgaaccatgtacatgtctctcaaaggcaaagtgaattcccttgttatttttatcttttcaggataataaattacaaaatacttcgtaccatagtctagcccatcagaaaaacacaaccatcatcgtctcattgttataatggcttgcactggttttcctctctaaattaaaatacaaaataattgatttataataaatagtctatgcagttgtatagatatgttatatcactgctagagaaagcatttgtagtcccagtttgtaaacccctttagtcccggatagcaaaccagggctacaagaacaggactaaagatcgtcccggttcagatacccgggactaaaagttttttttctacttaaatattgattttaaactgtcctcaaaatcatcctcattcacaaaataatccacaaattcaataacaaaatcatccacattcacaaatgcaacaacaaaatcatccacatttacaaaaacatcagaaaatcttccacaaatttacaccacaaaatcagtcaaaaaaaacatctaaaaataatcccctattcttctattttttttctactccacgacggccgttccgggcgccgcccttcgctccagcgctgggcgccgccgccctccgcaacggccgcgccgccaatgtctttggctgccgcccgctgacgtgagggtaaagggagaagggaagccagcaaggggaggaggggaggaaaagatagaggatgtgagggagagaaagagataaggatgagaggaggagggaatctctgaaatttttctctccctcacatgcgcgcctttttgctttctctatctcacgagcgatttttttagtctaaacaacagggactaaagatattagggggcctaccacgtcctgacaataaatgaaccggtctttagtcctggttgttaacaccaaccgggattaaagatcaagaaaaatacctccgaacttataactcgggattaaaaatagtttttagttctggttttttatcaaccgggactattgtggtttttcccaacccacaaaaaatggtttctccaaaaatgtatgtctatcaggtttatccaggctcacaaaaattcctaggtccgccacagttcgcgtcccgtccgagcgaacattcgcaccaccccgagttcgtacccttgctaagacaaccatatatttttacccattctttttaaacgtgtatgtttatgtaaactagtgagaaaaaaagtatttttttttaaaaaaatgttcattctattattggtagtctgtcggtgcagttggtagaacattcataaaattataaaattatggcgaatgaaaaacgtcacaccattcgtgacgaacgcctcttcccactacgcacttactgcaaccaatgcattttatctcaaggtgctcacagtcatgtttgtgacaattttcacatcctttttacgaaagtagaacgtcacagaaggtaatgtgaaaaaacaactgaacactacataacaagtcatgaagagataggtcttgacatttttttcccctatatggattctccaacttgaacgttcacattttgaggtcgtatgaattagttatgaattttacaagatttaatagggttaaaaacattagaaatgataaatgaaatagtactttataccactatgctcagtttgaaacaaattattgagcggattgttgccatggattatctacttgattatataaggataacatttacatttttcccacattgtatgcgtttttccttgacgggggaccttacgtttttcccacatttataaatgcattgcagaccaatgaattgctgatagctgaggcccatcgaaagtacgatgcagatgatcagcaaaatttggagtgaaacaatcaggcataacaggtggctgcttttcatacttggggaagtgatcaagacatgactgtacaatagcattttgcatctgacggaaagattttcattaaaacaactggaaaagaatatgaaccaagaaatcaaaatatataaaatgaattacctgaacattgcgacagcagaaggcatgcaaggcaacatattccctttgtgttgttgcaagggaaccaacactaatcagactaccaagtaatctgaggatggagtttcttcaaaatattggtccaacagctgcacatacaacacaaacataatttataagacaaatggaagtaaattattaagttagcaaatgttgtatacaatggaaaaggcattgtaatattattcgtatatcaagcaaagttagcaaagatatacaaggaaattatatacaatcatgagtatatgactcataacaggtctttcaagatgagtctgcctgtttttactttggatttagctaaattcacgcaacaggctaattgggtcatgtgaatccgagcatgttttacacgtgtccaactgttcaatgcaactctaagtgtggggctcacaaatgaagagcaaaactcaagttttgcaacttatccttacatttggaatttaggaagaaatgcaaccagagaacatttcaacataaaagtttgtgatgcaagttgtggtaaagggcagggctcatgcttgacactgcagttggtagaaaactgggacaaatgctgctggctgcacaacaaatatctgaacattaactcgtttttttttaattcatattccaactagaagtcttttctgtgctcctaggtttcagtttagtggttgtctataactcagaacatgttgctttaaatcctgttttaagaaaaatagcaatgccatctgctcttcctgaaaaacaaactgtgactgtgcttgctaagactttagccaagcaacgcttattgggtagtgcaagctctaataataccatgcctaccagaattgaacaagcctgtcctaatcagaagacatcagatatatgaacatccaaacaatataattctaaagaataataacaaatgcatttgcaatgaatggaaagattagcaaaaagtgtagtacactgtaccaacaagccatccacaatgactcagcttctttgtttgaaccaacattctgcctattagatatacttgattgagaagttgaaaacaaagaatagataaataagcacagttatcaaaataatttcattttagacaaaaggatcttcaggctttaacaaatgagaagaacccagcatagctacctgaaccaggtcaaggaaatgatattcatgcttcacagtaccacaatgactcaacttcaccttttctgaaagtacatttatattcatgctttagtagaacaacaacatcataacatcctgaaatcattggcaaaatattattaggtgatttcattgcaaagacatgtttgtatagttgctccacagaaaatgccatcaacaaaacaaggtggaaaccataacgtacctatttcatgcatccactgctttcacgatggatatgagaggatgggctctcatattgaaatttattaagaggggtgaggctcgaacccaggtcaactagcccaaaccttgtggtgctagccggaagacccccgggcctttctcatccactgttttcaccgacagcgtgacatgcacatcccttgatacagattcatgactattctcataggaattatataggtgagctcagcattcctcaaaatagcaagggctcaaacgttctaatgtactcaacagattcaaagcttccagaaacaaattgaagttctgcctctgttcaggtaaaaaactgcagagtatgaaatttgcagttaagaatatatacagttgttttggcgcttcagaatgaaaacagaaacaacaaagatttatcaatcatgtataaggcatgcatgagcccaagaaaaaatataagtgaaaattacaattgccacaatatctgacataaaagaagaaacacagagttcgactttgagcaaacttgaacagccttaagaacaaagcacaagtggtgaactatccctaaagtttagaatatttaaaaggtttgtatacagaaatagcattttacatccaacagaaagatttttattcaaacagctggaaaagatatttaccaagaaagaaaaatataaacatgcattacctgaacaatgagatggcagaacgcatgcagtgccacatattccctttgtcctgtagcaagtgaaccaaaagaccagttagataccaagtactgtgaggttggagtttcctaaaaaaaaaacattactcactgctgcatgtacaacttaacagaatgatatgataaatggaagaaaagattcagttaacaaatgtatagacaataaatataaaaggaaattagaatattactcataaatcaaacatcgtaagcaaataatgcaaggaaatcctacactcatgaacgcatgattcacgacacagagtttttggatgagaactctgtcttcacttcagttttaacaagaaactcaagcttgcattgcaatgtgccccaaggtgctggatgtacagaaaacaactatgagaaatacagcatcacacgcatacttaggacatgtcttacagactttttgttttttgcttagtgattaactgctaaatatacagaatgatatagtccataaactaatacttaagtacatagaacagggcaggctggagcagtggagagttaatgctgactctatataatggatcagagcagatgtgctcgaccctaaataaatgttacctgaagcatcctgagttctgtctttgtgatctcccaccaatttataaacatcctgcatggctgcatagtgccattttgttagcatctgctcacagctttcctccaatacctagctcaggcttctcgccttcctgaaaccttgaagaactccaagtagctttggtaatcactttggcatttgatgccttctgtagcatacatccattatcctactgcatatagaggcacgctaccctccatttcaaaagccaaatcaagttccccctgtttatagcatagctcctctaaacatttctttgtttttttatcaagatacttccttttcttcagcatcattgtaaaaatcctgtcagcctcactccatcgtccatcttttgcaagtaccaatagcaaagaagtgtagttggcatatcgtggagtataaccctggaaaagcatatcttcaaataactgtaggacaatatcaattgcattttcagcaagaagaagctccattagtttgtcataggaagccttactaggaacaaagcctcttttgtgcatcatcaataaaaacgaaagtgcttctttcattcgtccagcaagagaaagccccttaataaaagtgttgtatgttatcttatcaaagacacatccgtcactgttcaatgagttaaatagttggatagcatggttgatgtctcctaatcttatttgattattcatgagtatagtatacgtcacatgattgggaagaataccagtttggtccatcacagataagaggctgtaagcatcatccatcttattggctctacaaaggccattaatcatcccattgtaaatatgta

SEQ ID NO: 32039 - DNA, 13110 bp, Oryza sativa
ctcaattgctatgagaagctatacaggaagcctcacgcttcctctctatttataccgtaaaaatcccctactcaaagtaggtgtcaaattaggtgtagagcttctatttccaacaggattcaattcctcaatttccttttctccaaaaccacagccgtaccagccatggaaaatcctgctccggatcggacgcctccgtaccgatccttcgccagctcgcactcggtctcctggccgcctgggccgactcggcctgccatccaaccgagccactgctgctcctcccagtccaagccacggacctgcatacatgcatgctacctgcacacatgtacatcacgttcatgcaaactacacgctacagtacatcgagtactgtagcaaccatgccctccaccgtacatgtacatctccatcttttctcattcctcctcgcgaacaccgacgcttgcacgcacacctcataaaacccgttgcgaagatctctcacacacggtgtccatccaccgtgtgccatcttgtattcaacttcgtcacccggtatccttgaccatttggacctcaacttctccctgagtttagtcccggtccccaccgttgaccgaagttgacctccaagaatcctgactctagtcaccttttcacatggtatcctgaccgcactagacctatgttcctccctgaacatagtcccgatcctcaccattgaccaaggctgacctcaaatcacctgcacacaatcagacatcaccattgaccaaggctgacctcaagtcacctgtacacaatcagacaaaacaactgttcctgggcatagatatcacaacctgacccacattagtcacacgcactcacaccaacatccacacatctttccaaaccaattcactaattaaatcatttgcatagccaattattcatcacaaacattaatcatgacaacgatttcacaaacattactttgtgcaatatttttagtacaacaccatttctcctttatgtttgtcgttcttttagttgagaaaacatttttagaggtgccaattgccagcttcgaagctaatttttgatgcaagctttagctcagatcaatattcatgagggaaaaaaggtttgttcgcattgatttaggcaaatggcattctcatttttaccattctactgcctccagaccccagttgcaagaacaaaattcaaatggtaaaaatgaaatattgagattaagagcactgcaaacaatattctttctaaaaatagatgcaattcttctgagtccatgtgatgcaccttttcgagtgattaggatctgatcatgagaattatcagttatacacctatttaaataatctcttaaaatgtatatgattaatgcaacgatttcaataatttagcatgatgcctaatctaatcctttactcaattatcttgcaggcaatcttgatcaattaattgcttcagtttagagagtttttttcctacaggcaggtgagatgaccaccaggcaccagcacaatagctcattacaagagcacaaaccagactgaagattgtttggcagctgaaactgcactgtgtaggcagtagcccttcttgagaagtgatggccatgacttttgagcctttgatcatctggaacagcaacacttgggacctgtacaaatttgctgatggttccttctacaaaaattgaatgtgcaatatctgaatgttgcctacttctgaattgtcgaaacaagaatttggcaataataacaagaattcggcaataataaaaggggatagcgcacgagacctaaaagtggatggatgcggagacaaaggatttagacaggttcaggtcctctcgatgagaggtaataccctactcctgtttggggatttgaatccaccgggtgtagtatagatctgacgatctagttgtctcatgccccctagagggccttctgcccatcttatataggatggggggcaggattacaagatataaaccttaaccaatacattattggtttcataaatctactttacaatcttatcaaaccaggattttaagccgttccataatatacaaggaaacgtaatacccaagtcatgatccgttacatatttcatagatataagttatcccctgtatcagtcggataaccacgccgtgtgggtatggggtacccataatctccacagtagcccctgagaccttcacagtcgaaaagataatcttctctcgaaccagattactccaaagccgagtgcttcaatcatctttgccatggtctcctaagtacttttaccaaatctgaagactgtggagggctgaaaaataactgaatgtaaacttaggtgcatcgactagatgcacctaataggtgtagctcccgactatggggttaattgaataaactaagcatatagtcagggaataaataatccaaccaactgagtggtttttgataattatagtcaaccaagtgacttgataccaatatatagtatatgcggtgtgaaatcccgaataatatgatccaagtgatataccgactgctttgtagaatatgatgcgtgcaacctaaagttgacaacatctttgaaaattcacatagcaaaacagctataaagaagcttgtatgttgtgaataaagaaatttccaaagtattgggcatacgccatgcgcacattgctttaacagatgtgcttaagtccctaaaagacacatggcttcaccacacccggaaatatacgatatatgtggtgtaaaatccgagtaaataaactcataaaggatttaccaaccgcttgaaaaatgaccaagatatataatcagcctaagccttaatattagtcaataaaaatgcacacttacatggcaaaaagcaatgatattatatccaatcaattgcttaaaaacccaaatagcaccttgacctatataaaaaagtcagcgggtcagctatataaagttttactgtttgacaccttttaagatgcattgtaccaactcctaaaaagttgagtaactgcggtataaaaggattttaaggtattaggcacttgatcacgcgcactttggcctaagcaaaaagtgcctaagtccctaaaagaacgtgaaaatatgggctgcagatatattaggcctaggccaaaaaatatgccttcgacacccttcaaaggatgacgcatgtaacatgctcctgagtaataaatcttccgggtgatatagaccaagtgtagctcatatgaatagcttatgatctgagtgattatcccttataggatactccaaaatatatataataattgaatcccgattggcgcgagtattcggttgatgaaccttacggggaataataaatagtccagtctttgagcatagaaaatagacccatgatcatgaattcatgttgcatgtatccagaacgagttcaaattgaaggtatgatacttgtgtttgagttagtaagcccctgatcatatagcttgtccttctgtcgtagtcagaatggtccattgatggtagccgacgcagttggcatagagacaagacgaccaatatagagataatattgcccacctgaggtggcaaaaatattggtggtagtgaagatagtgataccaatcaaaagtgatgaagtcggtgatagacaaggcagctgatgaagaagatgaagatgcccattagtggtgacataataagccatccgtgaaggcgaggataccggtcggtggtgacgaaagcaagccgacggtgaagatgtagacacgcattaaaggcgatgacgaaatccaccaatcatgaagatgaagaaaatagttggcaacggcaaatgcaaccgacagtaatgatgataagcagcaatcatagatgagcgactatgatgacgaagatgcccatcaaacagcagtagaataggctatgttgaagaggcttgacaggatattgatgaagatgacgatgtcggtgatccagtcaatagcggtgtagcagccgatgataacgatgagatcctctatcggcagttgcgtagtaggccaaccgtgaagacgaaataacaagtcggcgatgaaagtcggtgatgacaaaagcaaccgacggcgaggacgtagtcaccgcttagcaacggcggagacatcagggccgatgaagtagatttgctggtgatgatgtcaataacaacaatccatcaaactgttgagaagatatcaaagctcgagtagtttcattgatgcgagcgtgtgcataaagaagactgatgcaacgcttcttgatctataaagatggcagtagaacttggaattgtagctgttgtagatgcttcacttgaaggaaagtaaatgttgttgtccaactcatcgaaactgagctgattggttgataactctaaactcccgaacatgtagatagaatctcaaacttgatacttgaaaaatttggagtagattatggcagcttccagaaaccaaaattgctggtgaaataattggagttgctgaagtagaatgtctgctccgaagcaaagataaagataatgactcctggagttgactcgttgactgattaattgatttcttcagcttgtcgaattttgagagtcttgtatctgtgtagcccccgactctttggttagttggaaagcaactgaacatagagtcgagaactgtagtttattgtcgtcgagtagccatcacttgagtgaagatatgtattgaggatgtccgggtagaaatctttactagaacaccacttgttataataacatggcatcatatttggcgacgcataccgagatgtcaaagctcttgtagaagtcatggctggtgaagtagcaaaacttgcgaagtagcggcaatagagtttgccggtgctgaagacaatgaagatgaagtagctccaccatggtgacaaagttgcacagccatgatgaagtgaacatgagtcgatgacagaagcaaaccggtagcaaagacgcgcagttgtgaagataataacaagtcggcggcggaagaagtagaataatgatgaaaaggaagacgtccttgagtggcggcaaaataggccagccgtgaaagttaagacaccatgagctgcggcgaaggcaaaccaacgatgacgatgacgccagtcaatgatgacgaacaagccagtcggcgtcagacaaggcggccagcaatgaagatgatgacatccatcagtagtggtagtggtataaactagccgtagaggcgatggctctggtcagcagcagacgagacaaccgacggtgaagatgataaggccaatcaacactggcataatcatgcagccgtggaagtgaagaaaccagtcggcagcagacgtagacagcttgcgttgaagatgatgatgacgcccatcaacggaggcggagtccaccgtccttataggcgagaacaccagtcggcggcggcgaaacgggccaacggtgaagtcatagatgcccaacaacggcggcataataggccagccatgtaggcagagacaccagtcggcggcggcgaaggcgagccgacggtgaagacgtagacgcccaacaacggcggtgtgaccaaccaaccgtataggcgaagacaccagtcggtggcggatgaggcggtcggtcggtgaagacatagacgcccaacaacggcggcataataggccagccgtgcaggcggagacaccagtcagcaacggcgaaggcaagccggtcggtgaagacataggcgcccaacaaacaatggcataataggccagccgtgcaggcggagacaccagtcggctgcggtgaaggcaagtctgtcggtgaagacgtagacgcccaacaaacggcggcataataggccagctgtgcaggcggagacaccagttggcggcggcgaaggcaagccgatcggtgaagacgtagacgcccaacaacggtggtgtgaccaaccaaccgtataggcgaagacaccagttggcggcggacgaggcggccgatcggtgaagacaacaacggcccaacaacggtagtgtgaccacccaaccatataggcgaggacaccagttggcgacgacgacggcaagccggtggtgatgttctgactgatccattcctggagcgtagtagataagcttaaagccatgaatcccttttatgcatatctggatctggatcgtacagaacgaacatatagatgtaaatataatactcgatgaaaattcaagtattttaaaatgtttataaatatgtatttctcctctcgtcaattttgatttccccgagcagatgactcgttacgtttaaacactctgcccgactagtcatagccaccaagcaccgggagtcggcctaggcacttcccaaacatgcatatgagtgacatgagttcgttattaatggaacaaagtttcatggatcagaatttactacttgggtacttttacaattattaagagcagaaaataaatttatctcatctctatgcttatgatttattccgagtaatacttagcaccttgcattactcggtccatccaacgagcccccgggtgctaggaatcggcccaaaggcaactatccatcgacaaaccaaacgaaaagcataggaagatagaactccataactcgatgggaactttattgttactcggattattttgcaagcaatcaagataaatattatgaaaaattgttaaaaaatatgatatagtatctgtagcccctgactcactagtcaacggcgaaccagttgatgtagtgaggcagaggaaaaggaaaatatcatataaagaaaagtaatgatgacttagcttttttgtatctccctcggtgacgatagaggtgaccgatgtggaaacaaagtcatccatcaatagcaatgaagacaccgggcagcagtggcgaaggcaagtcggtgtagatgacgaggcccatcaacggcggcggagtccgccaaccgtataggcgaaaacaccagtcggcggcggaagcaagccggtcggtgaaagcgaagacgcccatcaacgatggtgtgaccaaccaaccgtataggcgaggacaccagtcggcggcggcgaaggcaagctgacggtgaagacgtgtacgcccatgaacggtggtgtgaccaaccaaccgtataggcgaggacaccagtcggcggcgacgaagacaggccggcggtgaagtcgtagacgcccaacaatggcagcataataggccggccgtgttggcagaaacaccagtcggcggcggtgaaggcaagccggtcggtgaagatgtggacgcccatgaacggtggtgtgaccaaccaactgtataggcaaagacaccagtcagcggtggcgaaggcaggccagcggtgaagtcgtagatgcccaacaacagtggcataataggccggccgtattggcggagacactagtcggcggcggcgaaggcaagccggtcggtgaagacgtggacgcccatgaacagtggtgtgaccaaccaactgtataggcgaagacaccagtcggcggcggcaaaggcaagccggtggtgaagacgtagacgcccatcaacggcagcataataggccaaccgtgcagacggagacagcagtcggcggcagatgaggcggccgatcggtaaagatgtagacgcccatcaacggtggtgtgaccaaccaatcatgaaggcgagaacaccggtcgataacgacggaggcgatttgataaacaaccgccattatgtactccagatgcagatccatgtgttcgtatgccagcccaagcatatatatatttgtacatatatacatgtacagcttgtaacgacttgatgacgtggccgttgagcctccatagccgaggtggagtacgcacgagtactgccaaaaaataagctatcgcttggcatcgacggtactgtcaaaaaagtaatgctggaacagatcaatctgcaattagaaatataatatatatggataagaaacgaaaaactcggatcgggcaatgaggctgaatcatgagtgacagccgacgacgcgcgatgcagcgtatataagcccctgtagccgacgacagcttgatgttcagcactgctccgcgtgcagggacggctgttggacaacatgacggtgttcggattggcggcccgacgtgcgaggtcgccgaccgcttcgccttgatctcatagttgcatatatagaaccagaaagtatcaagagatcaaatagagtaatgaaaaattaatctgataaaagtttgatcggaacagcaaacctgagtagaaaattgaaaccgtcgaactcatcgagatcgatctcatcacatctccagaaaaattggttccatcgcacttctcgacggaatactcgacgcaacacgtacctggggcgccaactgtcgaaacaagaattcggcaataataaaagagggtagcgcacgagacctaaaagtggatgaatgcggagacaaaggatttagacagattcaggccctctcgatgagaggtaataccctactcctgtttggggatttgaatccaccgggtgtagtatagatctgacgatctagttgtctcatgccccctagagggccttctacccaccttatataggatggggggcaggattacaagatagaaaccttaaccaatacggtatcggtttcataaatctactttacaatcttatcaaaccaggattttaggccgttccataatatacaaggaaacgtaatacccaagtcatgatccgttacatatttcatagatataagttatcccctatatcagtcggataaccacgccgtgtgggtatggggtacccataatctccacagttttgttgaaactgagtgtgaattgattcttgtgaattttcttacagtatgtcaattccatttcagaaagcttagaaacaatgtgatccaaactgaaattcagttttcctaagttgcactatgtgattagttttatatgtatacatccaaatgaaaaatagtatgcatctaatcttgttgacattgagggatatctctgaggtaattactgccttgctatttcggtatggtatacatatattgatatatactggtccctgcttaatttatattgggctttacatcttcagaatagtctagaatgctttacatttcagcttttatgagctaaattaacatttgttcttaaataagttcactggccttgcaatatacaagcatttgccagaatacattctgaacatctctcttttgtcaaaatgagcgtttttgtgtgtcgaaatgaaccggtaagaaccagtttggtatgctccgatctttttgtttgtttatgtataataacttaaatgatagtattattatttgtagaaactatgatgatgaaatctagaacactttaaaacatgatgaattcagaccacttttatgaaattgataatgatcaattgttggtggaagaggaaaacaaggaagattcttatgcataatgtatgcctggatcttattcaattcttatgtgtccaacaataggtgtgtcagcatggaattgaatttgcattggtatggtgtaaacctttgatcccatatttgtatttttctttggacatttgagctgaatgtcagttgaattagacttattgtaaagcaaactttatatgtaaagatggcatatctgttaaaagatatttggttaattcaattgacatgaaaagttattttttaaaaaggaaaatgtgtgctcctacttctgatgatattctgcaatgagtatattcttgaagttgtagtatattagagttaatttatattgcctaattgtcgacgggggatacccgtaaaccggatatagagggtattagggtacgcttgtacttagatctacgtagtacgacatcaagcaaacagaaaacagggattatactggttcagacccctcgataggtaatagctctaatccagttggtatgggattatatgatgaaaccacagattacaaagggaatagcagaactcgatgataccgacgagaccgtagtcgagttggttcgactagatcacccggcgacttggctgtggtggttgagttggcgacaagattcgatgccttatgtcctcctagggagtcccttttataccgtaggtcagttggtctccaagtagaactcggagacatcggaccctacacgatacagtgacgacccagttctatctgagtaggattccttccatctgtggactccgtgatgaatttccttaacgtgtacaaagaacgtccgtatacgcgcagatataccatatcgatatatgacgtatatccaagggtagagggtataccttatccgtaaccctgacactaatgacgtgcattgcatgtacacgcttactagtgtgtagcagggtttaccaaaccatttgggttaacactacggtttgacggttactacggtaaccgcgaggtatcccgtggtttaaaaactgaaaaggttatcgcatgtgataacctggataaatgcgcgataatcgtacggttcgtacagttttgtaaaccctggtgtgcagtagtatggatagtattatgctgtatattattagaatgtcttgttaacaaacatcaatcttctctcaattttctttccccttcatatcatacaaaatcctaaaaggtcattttccattttctctcagaccattgtactttggactgtttcttttggaactttgaacacggctttggtgtgtttgagtacaaccacctaaccctccagatcaaaaataaggatacatattcatagtattatcttaggatgggggtgtactataatatggactattatatattaagaaggtagtatattaggatggtgaaaaacgacgtaaaccttgaattactgtttttttatttatttactgtattcaatttaatctaaattaatctgtccctaacaaagtgatgctattaggcccatagcccgataccataagccgtcccgtttcccatggttgatatcatacaatgggtgtgtttagttttttttaaagtttttgaagcatacagacatacatttgaagtattaaacgtatactaataacaaaacaaattacagattccgcctgtaaattgcgagacgaatttattaagcctaattaatccgtcattagcaaatgtttactgtagcatcacattatcaaatcatggcgtaattagtctcaagagattcgtctcgcaatttacatgcaaactgtgcaattggtttttttttcattcacatttaatgctctatgtatgtgtccaaacatttgatgtgatgttttttgtcaaaaatttttggaatctaaacaaagccaatgtattttctcaaagggacggatctaacaagttttttcaccctatcacatcgaatgtttggccacatgcatgaattattaaatatagacaaaaaaattgcgtgtaaattgcgagacgaatcttttaagcctaattgctccatgatttgacaatgcggtgctacagtaaacatttgctaaattaggcttaataaattcatctcacagtttacaggtggtaagttgttttgttattagactatatttaatacttcaaatgtgtgtttgtatatctgatgtgacacggtaaaaattttcacccttggatctaaacacagccaaagtcatcatggcacgttttccttacaaacgcctacgtttgaatcgatcaaagaatcgatggattatatgtattatgatgtaattggttattggtttaatttaatacataagtaaaaaaagaaaaagtataagggaaatattagggatagtctatgtgtcaaacaacttaaaaaaataaattttataaaaccctacctattatggtccaagttttgcaaaattgcgtaaagtttggcacgtggcacataattctaggtattaggtattatggttataaagtttcgcaaaaccacattactaatcattttgaatttgatttaccacacttttgagatctacaatcatatctcaaatttatgagtattatctatcatatagatgttacagagaaatttcattatttaccatccaatacgctgacctttaagaatttaccactcaattcgtaagcctttaagattttgccaccggaaccacgaatttcttcatttcataccactcccgtcaaatttacaactcatccgtctccttctgttcacactgacgtagggcgccgccgccaccatcgctgggccctccctcgctgccatggcgcacgtatttcatcttcatttgtcatccccccaatcgacagcggcgtggtcggggatggcttcacgctgcggctgcggctgagaggatggcggcggcaaccatatgcaagctcgggcatggccgcacctcagcagcagacgaggtcgggaacagcgacgatggtggcagcgaagcttggggacggtcaccgatgagctcggaactgcggcagcgaggtgggcatcggagagcggggaggggagcagcgccgtgagtggctatgcctaggtggggttcgtggagcgggtggtgtggacatcggcgagcgaggcggcgatggctgggagaccagaggattcgggctgtggctgcggcggaggcggcagcgtgggagaggggtgatgcagggaaggagcctaaatatgaaacgcagacgacgcgacagcgacggcgacggcggcggtaggagaaggaaaagcggaggcgagcgggaacatcgacgatggtggttgcgaagcttggggaaggtcgccgacgagctcgggtgtggcaacggcggcgacctagttccgagacggcttcgtgtagacggacgatgcgaacgggagggcggagtggtatgaaatgaagaaattcatggttctggtggcaaaatcttaaagacctacgaattgaatggtaaattcttgaaagtcagcatattggatggtaaataatgaaatttctcgatgttacacccacgttttctattttgatacaggagtatgtcaaaatggttaatggtgtagttctgtggaattttcgaaccataatatctatggttctctgatacgcactaaaatatatatggttccgtgtaatttggaccataatacctgtagttttgtacaattgatataatccaattagttaa

SEQ ID NO: 32040 - DNA, 14627 bp, Oryza sativa
ggatgaactgattaaatttagatatcataagaagaaaaagacccatggcaaatagaaattgttgttatatttgtatttgacaaaatgataatgccaatatatctattatagtgaacaccatgcctttttttgtcatgctttttttggctttgtacaaccttggtcgatgtagaggctaggagtttatcacttcctatatgtatgaaaaagtgaaactatgtgtgtgtaggtaattttgaaatgaattctaacatgtatatatatgaaacattttgcaattgtagtgcaggtatgcctaagatgggtgtatgagtgtatgagcaaggtgactgcataatcgtgaagagcttcaatgagaggaggttgcgagagaatctaggtatctttgattgggagctcactgatgttgaccaccacaagataagcaccctcccggagtcaaggggatgccttgattttttcgtccatgaatccggagtcaaggggatggtgagatcactggtgacaactaaaaaccttaattgttcttgatcaatattatgctggtccaaccaattatgtgttgagaagatcacctctggtacatgttaagaacaggcaatggtacatcgttgaaggtttgtaacatgaaccaatattcatacatcactaacagtgatactatgtactccatccgttttatattataagactttctagcattacccatatttatatagatgttagtgaatctataaatatatatctatatgaatgttgtcaatgtttgaaagtcttataatatgaaacggtttaaaagtcttataatatgaaacggaggaagtagatttaattagggtgtatttgatccctgtttgttgtgtatagactggcttgtataaacagcccgacccaaattgatgttggtttggataagcatccttagttgatttgtttggtagatttgtactattcttttttagcttggttatgtcaaatcctcactatgaatttggtttttgggatggaaggtgtagatagtaagtttttattatatgtacctgcatttgaattaaccggacgcccggacatgatagagccaatgggagagagccacgtgctcttttcttgtaaatgatcacacatacacgtatatacatacatgtacatctattagtacacttgcggctgggagatacggctatgtgccctggtggtctatgccctatggagatataaatccaatactatttaaaattagttaacacgatactaatacttttgatcttaattaactaccgttgagaaaaaagaggagggaggatggcgcatgtacgcacgcgccagcggggagaggacggccggtaacgttgtatttcgtgataaatctaacggtgtatagtactggacccatataattaagtgaaaatcagggatggatatttttttcttataattttatgattttctggcgtcacgtggcagcttggaaacgtttttagagtaccatgtgtccgcctgagagcgttttaaggaagtttaatggaattttagcgcctgcggtgcggggagaggacagtaacgtagtattttctgataaatctaacggtgtataatattggacccatatatttaagtgaaaatcagggatggatatttttgtttttttctagaattttaggattttctagcgccacgtggtagcttgagaacatttttagagtgccatgtgtcaacctgagagcgttttaaggaaatttaatggatttttattatataatagaagataaatagattttgattaggggtggaaacgagcctagtcaagcctgactcgtctcagattgtaatggctcacaacaaactaggcttgcttggctcagcttggataaggaaacgagctaaaacatgagctcgactctgctcgtttcctggctcaagccagattgagctagcttgcgagccttcccattgaaacatctctttatatataattagtaatcattaggaaaagcaggggtaaatcattgacatatatcattcccaaacaagcggctcgcgagccaactcgggcttgactcatttcaacaaatagctaaaaaggaggcttgggcttggcttgtttttcattcgagccgagccgagctcgagccaagcccaagctgagctcacgagcccgaggttttttttttccacacctatttctgatgcaaggttaggatgcgttcaggaggaggggttgggaacccttcatccctggcacgcaaaatgaagcatgtattattgcatgtttcattaaggattaatatgattttttaaaacaactttcatatagaatttttttttacaaaaaacacaccgattagcggtttgaaaagcgtgcgccgaaaaaagggagagatgagttggaaaaactagggaataacacagcgtaaattaactctatacctgctagtttcaaataaaatctgtgttgcttgatctcgttggttgcctgctcacagttataaaattgcataatattagaagtagcagcgtgtcatgtcattctaaccggatggagtaactctcacactagctgtacatctgatgtatatatcagcaaatgaaaagtatgtgttgtactataccgccttttaaatgttattagaatatgatgcagttattttttagtacgtttgactattcgtccttgctcgaaagttctgtgcaaatagacaaacctattatgtttgcttcccgtagaacttttgatactcgttttattttaaatgaataaatattacaagtttaaaaataaaactagctgtgttattgcatgattaattaagtatcagctattttttaaaagaaaaaatagattaatatgattttttaaagcaaccttcgtatagaattttttttcaaaaaacacaccgtttaacagtttgaaaagcatgcgcgcggtaaacaagagagatgagttgggaaaattgggggaagaacacagcctaaattaactatatacctattggtttataatataacgaggcggcgacccgcacgagggaggagggtggggcagcacgagcgagaagagaggcgagcgcgaggtggctagggttcttgccaaatctaggccgtccgtttctgatccaacgatctcacgatggtggaagagcagccacgctgggacacgctagtccctcgcgcgtgatcgaacggaccatagcggcaggaaccaacgcacaattaacaggaagtgcaggcgtttttttgcaaaaaaatacaatgacgtggcacacttactttccaaaacgtgattaacccaaaacgtgattaatcagaggtgagtggtgtttttgaaaaaaccgatgacgtggcgtccctaaccttccaaagatcccacgggtttaagtaatctaatatatgcgttgcttgatctgcctgctcacagttataaattgcgtaatattagaagtagcagcgtgtgatgttattctaaccggatggagtactctcacactagcagtacatgtgatgtatatatcagcaaatgaaaaatatgtgttggactatacctccttttaaatgttataaaactagaaaggtagcccgtgcattcgcgcgggcgtacgtcatacgctatgttaactactggagaagtgatctttgctaggtggtgcaaaaaccacattagtcccggtttgaataggaaccgggactaaagataatttttagttctggttattttacccaagactagagatagattcgtggtcctagttgtataatcgggactatatggggttacgaaccgtgagtgaaaaccctttcaccagtagtggtttgacgtatttataaaagcaatatattaaccggagaacatccgccacgatttctccataaattatttttgttagcgttaattaattgtttaataatattttaacctatcagttttatattatatcatatataagtaatatttataagcaattatttataatcttcttaatcatttcaaaagaatgtagatttattttcttagaaaacatgtcaacgaaagtaaagtaagtgtaaaataaaacgtaaggtgtttttctttcttttgatgtataatatattatcataatatgttaaaggatgttgggtgggaaatgaagctccactaaatacatgggttattttaagaagcgatctatctatgaacattttatgtagagtagatgagagactccacgcaacctagaaataacacgataacgacgaagtattatcattgcacagtaatatttttgaaatgtcatgtaccatgaataaacactttttctatataagatagatctaacggttagaaataatgcttctaccggtttaaaaggcataggagtattttaaaaatgtagcttaaaaattatggttgtctttatatccaacattatgaagtgagcgtagttcaactggttagttttcttgcggtcaaacttgcccacccatattattaatcagaacgtttaaaatatattatatttttttaaaaaatgtatggatcaatgaacaatagctataattcgtagaatatatatgactaaaagtattgaatttctttaataattaatatagttaatttggatattcaattttaaattttacagaaaataatctaatagtgagcacaaataaaaattatttatatgatttagataatataattgtttaaaatttgttattataaaatattttttccatgtaactaaaagaaggaaataggagagaagaaatatgtgggggaggtgatatttttttccatataactaaaagaggaaaataggagagaaaagacaagtgcatactggataggcggggaaggtatacgggccccttttttttatcattgtatttggataaatcataaaatgttttttccatctaactaaaagaggaagatagaagagaaataaaatatatgggggaggcacatacgcacgtacacaagcatatgtactggacgggaggggtaggatatgagggccactttttttatccctttctatttagataaataaatctaatggtataaaataatgggcccaccgtatattagtgaaaatcgatggctagatgattaaatgccacgtggcgatgtacgagcgattgtgggagttctatgtggcggcttaatagtgtttataggatgtttaatggacttttagtatataatagatatgatgtagttattttattaatatgtttgactattcatcatttctcaaaagtcctgtgcaaatagaaaaatatattatgtttgcttcgtgtagaacttttgatactcgttttactttaaatgaataaatattagaaatttaaaaataaactaactgtattatctattaaataacggagatagtgttgcaactagcgagtgccgtcgacaaaaagcacccaaatattctcttttccttttcccaaaaaaaaatatgaagaacttgggtcgttcgggctgtagctgtcacacggtgagtcgctgatatgaggcctcgcgtaccaatatatggccagattaattggctgtcgagccttatcttcaatttctctcgatcggttcgatcccatgaccatgtgagggggatgatgccggaggcggctctgagctccggcaagccgatgccgcgggtcggcatgggcacggcttcgttcccgctcggcgcgaccgacccgtcgacggtgaaggatgtcgtcctgcgcgccatcgaggccggctaccggcacttcgacacggcggccgtgtaccagacggaggccatcctcggcgacgccgtggcggaggcggtgcgcgccggcctcgtcgcgtcgcgggacgagctctacatcacgtccaagctatgggttgcccacgcgcaccccggccatgtcctgccatctcttaggcgtgcgctccggtgagtataactgcaacttattttgttggactagctatatatgctcatgcgttgcaccgggatcattaattattcgtgtcattcttcatgtccagctgcgtagctactctaaccagtcgatataaattttctatatacctagctagaatattatatttgatccatgtagtataatctgagacccgtcaagaaattctaatagctagccgcctagaaatacgaaaagacaaatagtaaaaaataaaaatgaaataggctagaaactagcctactagcagcaggttgtgggagggaggcatggaaatgggtgagtggtttcacatgacagcggcggtggtggccaggatgctaactggtgcatgggcactagtatcttttttcgtttttcttttttccatctttttcgtttttctttttttcgcttcctctcccctcacgtgttttccttcttttttttcatgtttttttttcgaatttttaatcggtagcacacgtgttaccaaaaaattttttggtcaaaagttttcaaatcttaacttaaaaatttttcaatataaaaaaatttaaatcttgagttgaaagtttttaaatctgggttgaaagtttcaatttttaagttgaaagttttcaaatctgcgttaaaagtctcaaatttgagttgaaaatttttcaaatttgagactacaagttgaaagtttttaaaatttgacttaaaaaatttaaattagagttgaaagttttaagtttttaaatctggattgaaaaagttttcaaaagttaactttacgtatagttttctttttaatctattagtaaaagaagatcattaaatataaaaaaaattaattatggttattatctacaactaaccaaagtaaacatctccggtaaaaaaggaaagtcccgcaaaaaaggaaaaaggaaatactaaccgttatcattattggaggctggcgctaatcgcaccatcctaattggattaggccaattagctaccgataaatcagcacttgcgtgcatgccccggtgaccatctcggcatctgcgccaattagcaaaaccggcggtggtggtaggatggcggaaccatcaccatcattgttgtctttcttttttaactaaccaacattaaaaaaaatagagggtgcatatatgatcaagcatttggcttgtgtggttgatttgatttgtacgaatattgtaggaagatgcagatggagtatctcgatctgtacctgattcactttccggtgagcatgaggttggctgaagatccggagtcaatgacatattccaaggatgaccttgtgatgatggacatggagggagtgtggaaggagatggaggagtgccaaaggctaggactcaccaaggctattggtgttagcaacttcagttgcaagaagctcgagacattgctctccttcgcaaccatctctcctgcagcaaatcaagtaaaagttccaaacattcctatacattataataatcttgactcttttggaattgcatctatatatataccatcaactagagaaaaacccattagcattatttagtgggataacaatattaaaaaatgaaaaaaaaaagtgtccacatcggcgattccggtcaagcttcacgatcagctagagcccacgtaactgtcaaactcagccataatgtccaatcaagcctcgccctctcacctccgttgcatatatgtctcagtactaagaaacgtttctaggaagatatcattttttttctccggcagccaagaaaaaatacacctgcaaaaataattgacactgtctcaggtcataaatcacctacgaaaacctactttttacagacgggtatctaagaaatccatctagctatgaaggtaagtctatttttacattcagatacctgtgaaatcagtctttaaaaatcgatatttagcggatggttgtaagtaagaaaaccatcataaaatatgggaataccactaaaatatgaaaaaaaaattgcaactacatataaagtcggatgacgacaaacttaatatgaaaattgtatctctcaatgagatgtacaacttttgtgttgatagtctttttatttgagatcatttataatttcaaatatgaaaaaaaagtaactctttcaaatgaagttagatgatggcaaactctatatgagaattgtagaccttgacgaaatcaacaactttgcagttgaaagttcgtttatttcagattgttgaggtgtgttcaaatattcatttttcattctcagatatattttagaaattgtttgttttagttttcaaatgacttcggatggagaaatgttctaccaggaaattgtagatcccaatgagatctacaactttatagttgaaagtttttatatatgagatcgtttaggtgcctaatattcattacaagctttgatatctatttttacaaggaaaaagtccatataccccctaaactttagatgaaattccatctagcaccttgaactttaaaaccggatatccaacccttaaactttacaatactattcatgtaacccatatggtggttttacaaaatgattactacataatttgcatattcgatggatgattttgaatatgtgacatatgccttggacatatatgttaaatctccacttgaataaatgaataccaatataatactaatatgatgttactatatactataatttaagaccgatgattgaggtatgtaagtatgttatacgagtttttttaaatcgctcgtttaaactttaaaatatgcaaaaccactgtctgaaactaatttaggggtaacatgaattgtattgcaaagttcggggtggatgatgtccgactgtaaagtttagggtgttatatggatttttattcaacgtttagggggttatatgaactttttcctttttacgagggttagaaagtccaaacttaaaaacaattctagatatttattttaaacctgattgaggtaaaccaaagttatacgatattctattagtgttttctgtaatatgacaatattaatactttcatggaatactttttcgtgtctgatcattcattaatgtcaagatgcataacatatatatcaactcatataaagaccacggcagtgagcaaccatattaaaataaatattttaagtaaatatggacccaaccatatgaagaaaaatattacaaggatcatggagaaccgtggttcacctcaatcggacataaagtgatttttctataacattttgaagtttagtcatttttgtgggttttttatgtctataaaaattaaactggaattttattttcatgggtgggtccttgagagagccacaccgtgaaaattgatttctgcacgggttggaatttgcctacacaaatccatgatttctataggccctagcttggttgcaggcaagttggaaaaatgcccacgtaaatcacttatggatcatcttaacaaatactccctccatattttaatgtatgacgccgttgactttttgactaacgtttgatcattcgttttattcaaaaattttgtgcaaatatgaaaatatttatgtcatgcttaaagaacatttgatgatgaatcaagtcacaataaaataaataataattacataatttttttaataaaacgaatagttaaacgttggataaaaagtcaacggcttcatacattaaaatatggaggtagtatttttttaagtagttactcgtcatggccatgcacagtatgagagagacaaggacataaaagattaagaggggttgtaagaagaaaaagggaaatggtattttagttttttttttgcgaggaaaaaggaaaaatggtattttagttatgagtatggagacaacattttcttagtactactctggtactgtctatattatagttgtacatatacatttttttctctattctctttgtccaaaacatttcaacatgtacattgattaatttattaatattgttcacgggattacatgaacacttgcaggttgaggtgcacccctactgtcggcaaaataaattgagggagttctgcaaggagaaaggaattcagctctgtgcctactctcctttaggtggaaagggtacaccatggagcaacaatgctgtcatggattgtcctcttctcaaacagattgccatggagaggggtaaaactattgcccaggtaaacagaacactgcaatatatgtcaattttttatatgtgctatgataaattaagcttccagctatgcaattatatttagagaccgtagcaggaaaaacaaaaggcaaaagtggtttgtttaatggccgataagatgatacatgaaacttatggtaataattgttctggtgaatactatatatacctatgttgcattgtttagtgaatcttatcgtgcatatcatgtttattaactagatatgaaactatttagaactgaaagtacaaactggaagtgtaggtatgcttgaggtgggtgtatgagcaaggagattgtgtaatcgtcaagagcttcaacaagagcaggttaagagagaatctaggcatctttgattgggagctcaccaatgatgatcgtcacaagataagcaccctcccagagtggaggggaactcttgacatcttcgtccacaaaaccggtccatataaaacagttgatgagttttgggacggcgagattactggtgacaagactttttctaatggtccctgatcaatgctagcccagccaatgaatggactgctcaagaagaattcaaatttcgtgtaccagagtccaacatacttttcctcatgatgcacacatgttatgtccttttgtgaatgaaagtatactagtcgtcaaaatctccaatcttgtccacatcatagagatcgttttaaatctaggaacgttattttcttattttccatcagataagactaataaccaacgcaagcctgatctgaccacgtgttgtaccactatcaacctttggcactgctcgctctcctcacagtccaagtgcatggtaccattgccaacggccaccgttgctgccaccgccgtgacctgtaagaggttgacctactagttgatggcaacgacactactacacatgtgattttcctagacgcaagcccctttaggttccaggcgggccataagtggctctatctgaaaccaggcaatcccagcgccgggctgtggaccgcacgggataatcgatggcgcaaacatgcaacgagtgaagaagccgatgacgaagcaagaagtggagcaacacctcgttcttccgttgatggctgctttgctgctttggcctctccagagaaacggttaggttagatcaaaatggaacaatagtatcagatgatacttagtagtatcggtaccagttgattactaatatagtgatacttattagtagtattactttactaatatccggtgatacttggtagtatcacttcaccaatctaaagtattgaaagaactaaagtttcttgcaatctgattgggccacatcatcgagaaatcaaggaccgttcgatatatcctccggacattatcatccgtcagatctctctatttgcaaaatctcttctggatccttcgagaaagctctttttcaaatacatccttccacgtccctaggtaaccaaaaaaaaaggagagaatgttcccctccttgtctcttcatcgcacacggccacactgccgccgccagcccgccaacctccccaccgccaccatgaagtggatcaccagtttcgaccgcgtcccagaataggcgcactggatcctgcaccacctcaccagtgagctcgagcgccttagccatgcctcctcccagctattgccgctgcctctaggcgagtttggtgctgtaaaatcagatccacgatggcagatcggagatagccatcgaagtcgacccccacctccaagccaaaggcatcggcttccccctccacatcatgcgttgcccttgctctccttcttggcgacatgcgtgtgacgacgggcttgaggcgtggttggccatcgcccttcaagatgctacatgggcagcattggaggctagaacccagtaaagcttgtgtaccagctggaatagcatgctagaatctgaggtaattcgttgcgagtcagtgttaaagtacggtgtgtgaagatggccaaagccagtatgcaaacatttggttagttgtcccatcttgatatatagtttttgcacgtttcgtgcttgataaattgcttgaacagaaaccagggaaggttaccctttaagccaaataagattaaagccaatggctttcaatttaattagaaatttctgtttgctggatgtaactaatagactttaactagagataaattaaaattgaccaatatatgttgctcaaattaacttctcagctcacaatagatgatgcattgaagtgtatataaaattttcaattaattctgaatatcaatttcataaattacaagcaagcacaccaaaatatcccagcaatatctttggagggattgggtcgctagcatcaattgatgtttgcacaaatgatcctgggtgtatttccctaaccgtaacatgccaccaacagcatgaaaacttaggattacacttctctcggtaaatgctagattttgttgctgtgtcctacatgctatactattttaaggagttgaagctcaactattttctgcaacaattgattgatgttcttccataaaaataagctaagctactatgttcatttatgatcatgctgaatttgtccatggagagtgaattactgtattcatttatgattacagtaaaaatagttttgttcatagacagggtttcagcagtttacatatatgcttttccaagggctaaaatgatatctgaatttatgctgctaaatactaaatattcaagtgcacatcacttgaggctgatcaaatgacgaatgaaaataaggatggttttacttaccactttagatcgctgagaaaatatatgattgcagattattagttaaagttgtaatcaacgttatcctttgactgattcctcatacttaagttgcatcttatattatgaagcgaactaattaatataatactacttcctttatgcttctgttactttcagaatgtgttaccgaagctgtttgtatgttgatttttcaatttacagtgccattggattttagaaaaaactgctgattgatatctgtaaacctaccagctatagtgtcactatttatttgcccatcaacgagatatcaatagtagggcaccgttggcctgagccatatatacacattttcaaacgggtctttaagagccacgcaacgcgtggcttacgtggctagtatcaggtgattactaatgatacttactctctccgtccaaaaaaaaccctgggtttccgtgtccaacgtttgaccgttcgtcttatttaaaaacattatgaaaaaaaattaaaaagacaagtcacgtataaagtattaatcatgtttatcatctaacaacaataaaaatagaaattataaaaaaaattcttataatacggacagtcaaatgttagacacagaaacccagggtttgtgtttttttttaggacggagggagtactagctagtattgttttactagtatcaggtgattactaatgatacttattagtatcactttatcagtatcatgtgatacttagtagtcccatgatacctaatacgtatcacagcattatacttaacagtatcagctgatactcgatagtagcatgataggtatcataagtagcatgacgcgataaccaatgatacttggtagcacgcaagctagatagagctggaagtgttccaaacactgttcctttttcttcttacttacactactacagaaccacagataggtgccagttggaaaaccggcttaggtaccggttttcccaaccagcacaatgaatgcggcactgattactcagctgacaccaatgttaatcttaaaaggaaaaagtacgaattaccctcccccgaactatcgcggtcgaccgaattaccccgttgaaccaaaaatctggacatccttcacccccaactttgcaaaccgaacaaataaccccccccccaagcactattttgagctgttttcgacttgaacttgcacacgtagctccaacgtggcaatcctgtaagcaaataacattaaaaaaacacctagacccacatgtcatccatctcccctccccaatccctctgctttctctcttactcggccgcccgctcttaggcgttgtcgtcgtcgtcttaggcggaggccgctcgctcagatggccgccagcggaggcatagcttgggcggcgggcagcggtggtggaggcgagctcgggtgaccagcggtgtcgcgggaggctgcggcaggaggaaggcggcagccgcaacagcagctggggaggcgagatccgcgccggtggaggaggaggcgacgagaagttgggcggccggcgttggaggcggggctagctccgcgttggaggcgggaggaaggtggccacccgagcacgtgcccgagctggccgtccccgccgcgctcgcctcgcccgtccggttgagatggatgtagaggcagccgaggcactggacgaggcggtcggcgctctggacgaggaggagcacgacgcaggcgtcgacgaggagctggagcagtggggtgatgtaggcgacac

SEQ ID NO: 32041 - DNA, 1765 bp, Oryza sativa
tgggaaagagacacaagacagatagagaacctgataggtggggcccacctatttttttaacaatgaattgttgactggactaccatgtaggatcaaaaccacagcggattgagctgggggggggggttatttgttcgtttgcaaagatggatcgccggccgttgttcgacgccgtcgcacctcctgctggcggccccacctccatgcctgctgtcttcgccgcgccacacctcctgatccggcgcgggccgcctccgtcgcaccacctcccaccaccgcacgctgcctgccgcaactgagggatgcgggctgcctacctcccgtcgtctcctgccgcctacctcccgtcgtctcccgccgccgaggggtgcaggccgcctctgtccaaccgcctcataaagccacatcatcttacttttacatctaaatcattattctacatactatttcaatttaaatctcatcaatttatgaaaacttatgtttatataagcttatgttgtttaagctattttacacgtttttttacttattgttctcatgataaactcccgcagcaacgcgcggggtttcacctagtttaataaaaaaacatccatccaagcgttgtctaatagaaaatcatttgagatgtcaggtgtggttgtgtgacctgttgcatggttcatagggttgtagtaagtatgactagcgctgagttgcatgaggttgcccaacatccaatgcttcactaaaagagcccatagccgatatttgtattttgttgattagagataccatcaatagaaggcaataagggaatcccagcacatataatttttagggaaaatttgaaccatgccacacaaattttgcaaaatttgtgatatgccaccctgacccatatgtcattgactcatgtggttcctacatgtcattgagatacgggtggcatatctcaaatttcgcaaaattagggtggcatggttccaacaaacccttttttttatgactaaaccttctctcaactcaagtacctatctaacattatttaagtcgcgtcgacttgaaacatgtataatttgataatatggtatatctataagggctacatgttagaacactcaattaaaccaccttataagtaatactacctccgtattttaatgtatgacgccgttgactttttgtctaacgtttgaccattcgtcttattcaaaaaattatgtaattatcatttattttattgtgacttgatttgtcatcaaatgttttttaagtatgatataaatatttttatatttgcacaaaaaatttgaataaaacgaatggtcaaacgttgttcgaaaagtcaacggcgtcatacattaaaatatggagggagtaatacttagcaagaactcaagtaggtaacaaatttctaatcgctagaaaggggaagtgttggaggagcgattctccagcagcgaggaagtgcagatctttccttgagtgaaaactcgtccagggggttagttgtgcacgacgtggaaaagatctccaagatagggtccagctccccacaagacaaatgaacacaagcagttatacaggttcaggccacctaaaggtgtaatacccctactcctgttttttttgtcactatctggatctggaaattataaactagacctttttcaaactaaggaacaagcatccctttttatatagcacgtccccgaggggctcacagtgccatttttctgctcttccttcgtgttgtcactcagctgtcttgtcgctgtca

SEQ ID NO: 32042 - DNA, 11656 bp, Oryza sativa
gttggttcccttctaatcttcccgagaaaccaaccaaaagtatatgattaagttgccccgggctccctgggcattgatctggcccaggtgggtttccatcctgcccaccacgcggcatatggtgggcctggcgatcctcaacctatccaagatagtgccacggctatttttcttctcagttggataagtcgggtgtcactgggcaggcgcgacacatatccagacgcctgttgctcctaatgactcagcgttagcgtctttttgacctcaggctggttggggttttcccccataaacatgtttcatttatggtagtgaacgcttgcccacagctggcagtgggacacgttcgccactcaacccagccttctggtcgtgtcccgcgcgcccctgaaacaatagttcagctatcttcgttcaagcttctcgaatatatctttgatgaaaagtagggtttatacttttacatatttaaaaacaaaacttgaataatacaaataatcaaaagtctgcctaaaattccatggcgccaaacattgaaaaccggagagagcgtagtagtgaacaacatatcaatatgcatatgtatatcatgtttaactatagaacattttaccgctgacaagttttgggatggcgatcgagattaccggccggcagcgcgcaacttacaacctaatatttcactgctgaagaaggaaaatttgtccaagatgctataaatttccgtgatgcatacattacgtctgtttctgtgtgtgaaaatacaagtagtgacagttttgtgtcgcagtcgcaaccgcaatcacattgtgttatcttgtctccggccagctcccaatcatatacctgtcgcgatgcatgtatgctactactaaattcgctgaactgacgaagatgaaactgacacatgcaccactccctctctttctctaagatctttttacctcactcgatcaggtacgacagctaagctagccatctatcgttcatggctggtggtggtgtgggagcatcggcggcggcggcggcgacgataccagaggcggcgctgaggtccggcaagccgatgccgctcgtcggcatgggcaccgcgtcgttcccgttggacgcgccccagctgccggccaccgtcagggacgccgtcctgcgagcgatcgacgccggctaccgccacttcgacacggcggcggcgtacggcaccgaggcacccctgggggaggccgtgttggaggccgtgcgcgccggcatggtcgcgtcccgggacgacctctacatcacctctaagctctggatctccgacacccaccccggccgtgtcttgccggcgctcaggaggacgctccggtacgtcagcatcattcacaaaccaacctctaaacaatcacttgtatgtttattaatttagtgagaaattttagctacgttgctccgataatgatagagatcagtcgaccggtggggggagaaaaaaatcaggcgctcccccgccccctgccccgcgcgcatgcatgccacctgggcccccaccacaatccctgcctccacctgcaacaaatcacccacatattttggaaaccctctattaaaagaatttggtttatttttttgttccactaaaaatgtttcactatctatagatttaatattgcagtgaagtgaaatattccattgcaatgaaaaaacccacatattttggaaaccccctattaacgtaattcgttttatttttttgttccaccgaaaaatgtttcacctagtgtacttataatgtttcactatgtatggatcaaatgttgcaccgaactaaaacattctttcgctatttgctgaaacattgtttttatataaggtgaaacaacacccgatttaaatgaatgaaacattttcgatctacttagtgaaacaattccgatatacttgatggaacatcgtgcaacatttaaaaataattcaataataagctaacttttttcatcggaatatatccatgtgtggtcttgttttgaaaatttaattgcaacgaatttaatagtgcaatcggatcataatttggataagtaatttaagagaaaaattagtttaaaatagttttgcacgtaaatcggacgcttcagccccgatttttctccaaaccgatcgggagcccgacccgtagactcgtccaggttcctctcaaaaaattaatcaattttacactaaaatgattgatacatctaaggtaactagtacataattgtgtcatgtttttaaaatagaaaatatagcatttttggtactttcttgaagatgataaaattaccattattttgtttgttttgcgtgagtcttcatgtactactgcaggaacctgcagatggtttacatcgacctatacctgattcactggccaataagactgagagtggaacaagaaacgccttcgccggtgtacgacaatgactttgtgatgatggacatggagggagtttggaaggacatggaggagtgccagaggctaggtctcaccaaagccattggtgtcagcaatttcacctgcaagaagcttaacaccctgctctcatttgcaaccatccctcctgcagcaaatcaggtattactgtacaatacattatcatcctatattttgtcccatcatacatattttggaacatatattgtattattaattgtcgttgggattgcatgcatgactacaatatatatgcaggttgagataaacccctattgccggcagaacaaactaagggagttttgtaaggagaaagaaatccagctctgtgcctactctcctttaggagcaagtggcactatatggggcagcaatgccgtcttggactgccctgttctcaaacatatcgccgtacagaagggcaaaacggttgcccaggtacatatataatgctacaatacgtcttaattttggatcagttatgataaactaaattttcagtgatgtaaagatgatttatagtcgacaaaaaattcatcaatatctgtggtattgaacaccatgctatctatggcaaagtttttaggaataattccaatatgtatataagtttcaccgaaattgcaggtatgcctgaggtggctgcatgagcaaggcgattgcataatcgtcaagagcttcaatgagagaagaatgagagagaacctcgaaatttttgattgggagctcaccgatgctgatcgccaggagataagcgccctcccggaattcaggggaaaccgtgatttctatgtccacgaatctggcccatacaaaaccactgatgagttttgggatggcgagattactgggccacaactaaaaacctgttaatgggctgctcaagagcaatgaattgtgttattggtccaatataccactgagttgtcttgcttatatatattgtgtaacagctgaaagactagaatgtactctcatttttttcaaatgcaaatctaccagttttttgttcctaaacgtattcaaatccagtttgaatttttccagcctaaatttattcaaaatttagtcataacttggaaattctagagctcacaaatgaataaatcgcatcaagattaaacagccaacaacaaggaacatgcatgtctggatgcaacatttgcgtctttttatgtgttcgtttgtgatcatcagagatggtcgattaatcacaagctctctgcagaaatgaatttatatggcagttgccggcggcggcgcgtcgagctccctgagcatggcgaccacctgcagcatgtttgggcgctttgaggggaagtcgtcgacgcactgcagcgccatgtccatgaacctggccatctcgtcggcgtcggcgccctcgacgacgagctccgggtcgagcacctccttcccggcgccgtccccgaccttcatcttgacccagcccacgaggttggtgtccccgaagtcgtccttgtcggtggggcggcggccggtgagcagctcgaggaggacgacgccgaaggagtagacgtcccccttcaccgtgcaccggaagctctggtagtactccggcggcacgtagcccggcgtcccggcgagcgtgctgacgctcaggtgcgtgtccagcgcgctgatgaggcgggccatgccgaagtcggcgacgcgcgcctccatgtcgccgtcgaggagcacgttgctggacttcatgtcgcggtggatgatgtgggggatgcagttgtagtggaggaagcacaggcccctcgccgcgccgcgcgccaccttcttccgctgctcccacgacatcgccggtgatgccgatctgccgccgtcgccgtgcagcgtgtcctccaggctgccgtggctcatgaactcgtacaccagcagccgctcctcgccgatcttgcagtagccgaggagggggacgaggttcttgtgcttgatcttgcccagcgtctccatctccgccatgaactcgcggtcgccctggtagctcaggtggatcagcttcttgatcgccacgcacgacccgtccttgagcgtcgccttgaacacctcgccgaacccgccggagccgatcaggctggcggtggagaagccattggtggcctcgatcagctgcgtgaaggtcagcttccggagctgccgctggaacgtcgccacgttgatgctcagcgcctccttctccgccttcccgagcttccatgtcgtcgccgtccgcgtcccgtcctggaggctgctcagcatcatcgccgagcgcacctcacgccgccgcgcccgcgccgccaccgcccatatcgccgccgcgcacgccagcccggccgacaccagcacggcgaggatcacgccgttggcccacgtcgccacggcgcgccgtgggggcggatccgtcgacgccgcggcggcgagcccggacatggtcgccgtcgggaggcggtcgccgcagggctccagcggcatgccgcacagccccgggttgccggcgtactggctcgccggcagcgtgctgagctggccccgctgcgggatctcgccggagaggttgttgtcggagatgtcgatctggacgaggaaggagaggttggagaaggagtccgggatgccgccctgcagccggttgcgcgacacgtcgaacacgccgaggttgcggaggcggccgagcgacgccgggatctcgccggtgaggttgttccgcgccaggtcgagcacctggagcacgaccatgtcgcccaactcctcggggatctcgccgtcgaggctgttgtacgagaggtcgaggtactccagcgtctggtaccgcgtccacccgctcacggcggcgccggagtagagccgcgtgaagtcgcagctcttgagggtgggcacctgcagcagccgctccggccggattccggcgaactccagcaatcccccaactcccttgcacgagttgccgacgttgcggacgaacgccagcgtgttcccggacaggatgccgctgagcggcgtggagccgagctggcggccgaggcggcgagggatctcgccggtgaggcggttgctgttgaggtccaaccacatgaggctgctgcagttgccgagctccctggggatctcgccggcgaggctgttgttcgccagctgcagcacggcgaggcgggacagccgcccgaactccggccggatggtgccggtgatctggttgctcgtcagcgacacccactcgaggccggtgcagttgaagagctcgacggggatgtcgccgccgatgaagttgttgttcaggatcagcgtccggagattccggcattgcccgagatccgccggaatccggccgtcgaggccattgaaccacatcaccagcttctccagggcgcggagccggccgagctccggcgggatcgggccgcgcaggtagttgatgctgaagtcgatcacccgcagccgcgagcagttggacaagcccggcgggatcgtgccggcgacgaggttgtccggcagccggagctcctccagcgccgcgccgggcgagcagagctcggccgggagcgcgccggagatcttgttgctgctcaggtcggcgacgcggaggttcttgcagtgggcgatggtatccgggagagagccggagatgaagttgttgctgaggaggaggctctcgaccgccgtgaggttgccgagcacggcggcagggatcccgccggagacgttgttgttggcgacgtcgagcagccggagcgcgtggcacgacgacagcgactccgggatggagccggagatgttgttactcgagacgcggaggacacgcagcgacgcgcacgcgttcctcccgaggccgggcgggatggcgccggtgaggtggttccacgacacgtcgagcacttcgagcccggcgatggcgccgattccctccggtatcgcgccggcgaggccgttgtacgacaggttgagcgtcgtgaggcccgcgcagccggacagcgacggcgggatggcgccggtgaagcggttgccggacaggtcgaggacggccagcgtcgcggggagcgacacgccggagatgtcgccggacatgttgttgccggacacgtcgaacgaccggatattgctcgccaggagcatcccgggaagctcgccggtgaggttgttcctcgcgaggctgacatcggtgaggttggggtaacacgccagaaagccgtcgggaagccggccggcgaggccgccatcggagaggtcgagctgcagcagcgcgcgcgggagcttaaccaggtcaccggcatcaacgtgcagctcgccattgccggagaggttcaacctgcacaacgtgtcgagaccagagagggcggcaagctcggcgcgcccggcgaggccgccggcggcgaggtcgagctccgtcaccctgccgtcgccgttgcacgtcacgccacgccagcgacatggaccaggatccacccacgacgagaggactcctctaggatccttgtggacgaacgccttgaagcggaggagcgccgccgcatcggtttccgccgccgccgccgacgacgacacgtagatcgaggagaggagaagtgggatgagaatgtccatttggcatgtggatgcaatgttgggacaatgaggatggatggatggagaagaaaagagtgacagagggtgagtgagagcaagtgttgtgttggtcactcttgatgatgatcagtggtttacaaagaaagattatggcttatggtgtgtaatcctctgcttttgagagataaagatggctttttctcttctttttttttttgaagtggtgtttataaaacatcaccagttaagggtgctttggtacacttttgtgtttgtgagttggattgatactgccttggacaactatcagtgtaggtgggttttataggggattttggtccaggaaacattcctttggattacttttcaaatcaaaggaagaagagctggcccaaatgtagtttgccaaaattttagcctgaagttgcctttttttcttctttactgtatttgctactcctgtacaaaagtttttttttaagtcttttctcctaatatgaaacggcagaactcctgctcgcctcctcgaaaaaaagtttttttattcagtttatgtggaaaatgaattgttttcagtgaaattcctaagcgccaaagtagccatcaggggtttccttgccttcatacaatgatcatataagcaggggaaaagtacgaattaccccctcccccggcccgaactatcgcggtcatccgaattaccccctaaaccataaaaccggacattcttcaccccaactatgcaaaccggacgaattacccccctactcaatccgcggtgattttggtctacgtggcgtacacgtgctagtccagtcaacattctatttattaaaaaaatgtgggacccacgtgtcatactcttccactcttcctctctctcacttttcctctctatctgtgtctcattcttcctctctctctctatcacggggcagcggcggcgggggaggagcatggcggcagagcgaggtgaggcgagcgtggcggcacgctcttcctcccgcccttgggcccggttctctgcgccggcgccggcgcatcgccggcggacgaggagaggcgtgagacggacggggagcgaggcgcggggaggtaggacgagacgcggctcgatggctcgaaagaggagccgcggtggcagtggtgtcccaccgcatgtccacgacgaggaggaggagcccgccgcccaccgcagtccctgcgcgccatcggcaaccacatgcccacgacgaggaggaggagcccgcagtagcggcggtgtcccaccgcgtgtccccgtgcgccacagctgaggaggaggccgccgcccaccgcgcgtccccacgcgcccacgacgaggaggacgagcccatcgcccaccgcgcgtccccgcgtgcccggtcagcctccgcctccgtcgccagccgccatcgtcctcgggccccctccgccacccacaactggctccgccccctactcgccgccgtccttacctcaccaatagcatcaacgagtcactggagtcggagtcctccacctagctagctttgccgccacgctcctccgtcgtctccgcctccacgccgacgtccgcaccgtccgcgctaccgtctacgccatccttgccgaccgcctatccccgtgccatcctcgccaaccgcccactcccaccgcccgtccttgccgtgcgcgctgcgtgagagagaaaagagcgagagagaatagaaagagagaggaagaagagtatgataggtgggccccacatttgttttattaaataaaatgctgactagattaccacgtgtgcgccactggtaacgcgaaaaacacatactagcctaggagatattgtttggttggtagagatcattcattgttttattaaatataattcggacgatcgtgatagttcgggaggggggtaattcgtactttttcctataagcagagacaagtgcacagaggatgcataaaatctgactcggattttctttttctttgagaaacctctggattcatatcatcgagtaaatagctgagaaaatctcatgtacaaaataaaaaaacatgtgtgggacagtaaggaggaacttaatgtcaatttattaaggcattgtttagataaaaaaatttggtcaaaaacgtcacatcaaatgtttggacatatacatgggacattaaatgtgggaaaaaaccaattgcacaatttacatataaattgcgagacgaatcttttgaggctaattacaccataatttgacaatgtgatgcgacattaaatatttgctaatgacggattaattaggcttaataaattcgtctcgcagtttacagacggaatatgtaatttgttttattattagtctacgttcaatacttcaaatatgcgtctgtatacttcgaaaactttatgcccaaacaactaaacacacggccacaccctaaccagggtgaaagcgtccttggagaaccaaaagcagaccgcgagcggtacatcgatcaatgtacagtcccaatttcagagccaaaaattatatttgatttaatatactctaaaaaaaatttaaccgacacataagcatttttatgttgatacgatatggaaaacctttaacagagttcagacacatatctatttgtgcagaataatgtttaacgagtaacatcagtgattgtgtctctggttgagtggggagatctgcattatattacttgtcaccagatgtgatgttagaaaaagggatttttaaagttcctgcaaatatatatttttgtgtgcatatcaaggttgctttgcttagggatcaatgggaaatcatgtgtgtgcatgggaaaggcagaattgtgctgcatgcactcagaaagttaaggggagaaaattcagtggtccatcacagacaggagggctaccaggggagggacatcacatcaacttctttaaaaaaattcctattggcattagagatgataatgctcccctctttactctgcttcctattagggcccttgtgatttaataatttctatcttcattattattgcactttatatgtgataagatcatgtttttttgtctgttatgtttttttagtgatggagaaacaaaattgaatatgataatatttatgcgagtatatattcagtttcatatgtaaagagttatgtaatcctctatgaactaattagcaaactatatataaaggaaatgtatggtaggcaaggccttatatatatattcatctataaatgagtggtattttatcaaattaattcttctttttactctggaaattaacttctctaggagtgtactgatgctgcgcataacagcatatggcaccaatattctacccgcatcaagttggtgttcttgttcttattaattcttaattggtagggtgtagatcaaggttggatgaagtacataattcgcacgttggatatcatgaataatccgtgctaaagatatatccttaagtggttttaattatggagatcatttcacacggcctcatcccaatctcgtttactaatgatgttcttaacttcaatgtgttcccttcttttttttttctttgggtcaattaggttagattcatgtagtccaatggcattccaattaacaaaattctattatttaagattgttaagcataatttatctattaatcttcaataaagtaattatttgatttcatggttgtgaactcaataactagaattctaataattaaggtgctattatttttgtagaaaatgcacgcacaccattacgcgtgcatattaaataaatttccagattccccgtaaaaaaaataaatttccagattatcacacactattcagagaaaaaggtctggcgtcctatatatatcaattttagaattctcagtacagaaatatggaaagcatttaggggaaaaaattgtacaaaaacttggcaggtcaacatcattaaacatctcatggtcctatgtgacatgtatcattgagcacattgggtaccgacgatgcatcaatagatactagacctagacatggtgaatgtgatgtttatgtacatagtatacttaatttgctcaaataattaacattaacttgcatgtgtacgtcatattatgcatgtcatacatcccactaatggtggtaaaatacaagtaaattaacaagggtggtcatgtcccctttgagtgctcaaagtcacttttatgctttggcgccgcacgtgtaatcataattacccccacaagcattagtgttggcaaatccaattaacaaatgcaacattgctaacttctgacgatttggatgtcgggattgatgttgtggaagaaacatatctaatcatcatatcagtatggagcatctaaacagtacactacaaacgtggctatgtttctgatgagatccatgcaggcatgtgtgatattcaattaaaaaactaaaaagaagataggtgttgttcataactgatggcaagtctcaaaaactttaatgagaaataaaaaagagagaaactaactaaaaataatttaggagtgtgcaacaatttcctcttctttttgttgaggcaaaaacaatttcctaactggagtggaattgttatggagatatgtaccaaaatcctagatgtacaacttgtgcgttgctattgaagttgcatatatctcca

SEQ ID NO: 32043 - DNA, 2120 bp, Oryza sativa
cacgcattgccttttactactactcagtctccatgctttctcgatttatagactgataggcgtaggagactacatattcttcatctgctaggaactctggaacattcaagtttggaagagagaaattttacatgaattttaatgaaacttccataattttgtgcatgatttccacatgaatctcattttgaggcatgcctgaaaaaaattaagctgaattgtaaaagatgatcactcaaattacctaggaatatttgagctctgcaggtgaggcaattgacttgtatggatccaagttgttaatccaatcagtttcggtaaaatacataatccaatcagtttcggtaaaatgccatttgtgaggagcacttttgtttaccatttgttaattaattacaatatttggtctcttgattgatcgacatgttactgctattaccgaaagcgaaaaggaagcatttgctttacctttgctagctttggtcaaacaacattatcataatttcctttagaaagtaacctttctcatatagtttgttcctaccagtttgcaatcgcctctttttggctagcttaattggcatctcaaaaggaacaaaattaacctttattacagcacctcgaagcagcattctttgacctaacatatatacttcctccgtcccacagtataagggattttcagtttttgcttgtaacgtttgaccactcgtcttattcaatttttttttgcaaatataaaaaacgaaaagttgtgcttaaagtattgtagataataaagtaagtcacaaataaaataattaataatttcaaaaaattttgaataagacgagtggtcaaacgttataagcaaaaacttaaaatccagtagtaaattgttctcatgagtagcaggctatcagtggatgtcatgatcagtaatcacctgtcaattcgttaaattgatgaaagtaacttgggataattcagttcaattaacaacgaaagagaaagctcatttcactgtcttctgagctctatatcactgtgtatcttactaagagtttaatattattaacttgcaagataatcatatcctacttactattacctctgccaaaaaaaaagtgcctaataaagaaccaacatgctaattagtttggccatctctggaagttgttaccagttccagcttctttttagaagttggagaatggagatccacatgacaccacattattactaataaggttgaatgatgtgatgcatattaaggtaagtatagtcatgatttgagcctaaaaaatcattatatgcgcatgtttttcattccgttttactgaaagtactataatttggatcttgaaaagttacaattgcaactccagatgtgcaactgcataatgctgcctagattctacagtacaccctctgtccaaaagaaaaaaaaaatcaacttcgagggataaattaaatttgacaagtccccagaagtccaaattcgttcaaattcatccctaaaagtaatgttttatcttttttttccttttttttaatggagtagtatggctttagatgtgtaggaccagagcctaacgagttacttcaatgcgatatttgatacgtattaaatacaatccattcttcatcttatgaatttattactgtttatgctctagaaatataagtatagcttaagatgtgagccaacttgaacacaaatgctattagatattatatctctgcatgttaataggctctgatcgatgaaactgttggtcaatgatgagtttcaagttgcaagatagcaatcagtatagtacatggtgggaagggaagacacaaatcagtttggacttctgaagtctgaacctcattgccgtgtgctgaaacatggccaatacagatccctttggtccttggagagttgcacaaacaagattttccataagttaaaatgcaaaaacttgcccagttttagccgcagctatagttcacctgattagagctgcttttgtttatttcttctatacaatactaataaataataatcttttgtacaacaaaacaatacgcattcgatgtaaactgctcagggaggcaggctaactagtgcaaaatgcatcagaatggatgaatga

SEQ ID NO: 32044 - DNA, 33414 bp, Oryza sativa
ttgctgattgtgactgcattgttctattacaatactccagttggactagcatgtgaacccctcatattgtccaactgaccacatgtggatgtcgacctgagttgattttgtccctgttatggcttgttggccgttgcctaagaacttacagtttcagagaatgctagctttgttctgaagaatttgtcagctttctttgtatcctagtggtccatcctttcccctctgttctgagaatatcatacctgtgctggccagattgagcatttttaattgtggagtttagtaatagatattcaatttaatatggtatatgattagttgaagtaggtagccatgttgggccaggaagcttagccattattgagtcatgtaactagcaagagtatataatattatgttattggcactaatgaagttacaactaatcatggaggaacaaatatggacataacaaaactagaggaacattagtgatgttgtaacttataagtaccatgcaagaataacagtggcattattagtggaaccaatgaggtgattaatggggtaataatacatgcatctttcagaaaaaaaatgatatttgaattcagtttgtcatttgataacttaagttactggtagaattggcatgcaattattgttactagatatattttccgtcagctgaaatacatgctctttttgtcttgtgtggtcttgattcttctagtatttatgcatcttcaactgtttctttaggaaagatgatggtgtgaaggtggtctctgtggagaatttgaagaatccttatgaaaaacaagggaacttcaacatgcgattcaagttgactcttaacaagctgtatgcatggagcctagtttcctatgaccgagttgttatgctagactctgacaacattttcctccagaacactgatgaattatttcagtgtggccagttctgtgctgtcttcattaacccttgtatcttccatacagggctctttgtgcttcaggtaggattacttgctatatgggtttctcctttcttctgcaaaatttcttttaactttctccatgtaaggaaagatattagctcttaatctcttcattactaggaatgactatgaatcgacctcctttagtccattgcatctacaaaggcattctgttttgtttagcacttcatattaggggtgatctaactgccatttgataagtaatccttcattattgtttaattaaaagatctatgcagttttgttgccaactggtttactgcaaatcttttacctgaaattaataagcttggttttagaagctgcaagcttatattgaatctgttttcttcctggatattagtctttagctttctgttggcctttctcaaagcacagatgtatttttcaggggcgcgaaacacagaatctacaatacttcttaaatctaaacctatctaatgcacgggccaattgctgttttttttggcacaatattctgcagtaggcaaattcaaaatggttatgacaactcctactttgtgcactcattttttttgtcatactaaccagttgttacttattaatcaacctgattttctctagtccagaaccatctaaagttcatcaaatgaacctgaatattgaaatttatgtcgtcatgaatttttttttctttctattttgttttcagccctcaatggacgtttttaagaacatgctacatgagctagctgttgggcgtgataacccagatggtgcagatcagggcttccttgctagctatttcccagacttgcttgaccgaccaatgttccatccaccagttaatggtaccaaacttgaaggaacatatcgtcttccgttaggctatcaaatggacgcatcttactattgtgagtatcaatagacatatacgaattcgtatgctcatgcattttccccctagactaatgggatatttgttcagatttgaaactccgctggagcattccatgtgggccgaacagcgtgattacatttcctagcgctccatggtttaagccatggtattggtggtcttggccagttttacctctgggactttcttggcatgaacaacgccgtgaaaacttggggtgagtaattttctcagatattttgtcttgcattttatttgcatgattgaattctgatgttaatagaatcttccactaatgcattgcttcatgtacaaaatttgttagcatggatcatggatggtaatatcatccataacagtgtatcatgtgcactcgtgtgattggttaaatgccctttgtgaattgctttctatcttctttagaataaagatgtgtaacaggtcattatcgagccttttacattttagaataaagttgcacaaggcaaggaattattgtgcttctttttttttgtcaggataaagttccataaagtagtggattgcaaagtcttcaaccttctgtcatgttttttaggataatgaagcatataacagtattcattttgttgcatcttaatttctgaagcacagagtgttgcctttcctgactatatgtaaacttgatgcaaagcaggtattcatcggagctaccggttgtattaatccaggccctattttacattggagtcattgcagtcacccgacttgcgcggcctagtttgtcaaagatgtgctacaacagaagaatggagaaaagtactatagttttgctcacaacactcagagtagtggcagcatggtccatacttgcagcttacaccatacccttcttcctgatcccacggacggtgcatccgctactaggttggccactatatttgcttggtgctttctccttttcttcaatcgtgatcaatgtattcctcctccacccccttgcggtcctcacaacatggttggggatcatcggtgctctcttcgtgatggcattcccatggtatttaaacggtgttgtaagggccttggcagtgttcgcctatgcattttgctgcgctcccttgatctggggatctttggttaagacaatgagctccttgcagatcctgattgaaagggatgcattcagacttggtgaacctaaccagacagccgagttcacgaagctttattgaggtgtgtattgcagatacatgtcattgcatttcatcagctaattccgattcgcattggctattctgatggccaattcagttgtacaagtaaaaccgcagatgaaactacagttgcacctttaacaccacctgaaacctttggagcccgtgatattcttcgtaattgcgtaggtgacatacagggcaaagggagagaacatagtttgatgtttgtgtgtggggggtgttggttgtggaagtggaactgcagaggaacattatagagtaatttttttgttacttcatttactgctcctctaaaagagccaacacattcttggctttcttgtaattgatatcatcagttccacacgtccactatcatgagattcaggtgttctttgcaaaatgctgattggaaaaagaaaactatgtactaccactggatatgcatttgcctttccctataggggggtgagtggtgacgttgcaaacaccaaagtaataagctttgcaaatatatggcggcacaaaatccaatcgtccacttcagaatgttgtcttgtctcgtcttgacaacgacgttggatacgacaaaggtgtttctcatgggcacggcccagtgatagaggtaactgaggttataggttcaacccggaagaaaccctcctctcaatgtcgatgtttcagtgtattacaagtgtttttaaatctttcccgctctcttcttttaaaaaaaaacacgtcacaaacgcaaacgctcacaacgtttgtgcactcatctctataaacgcaaacacgcacgccccacttttatgaacacctatgaaaaactaggtcggcatatcttgcgcgtgcacacttatccctatcaacgtacatacactatacccttatgagcacctccagaagattgggccgtatatcttgcgcgcatagattcacccctataaacgcacacaggtacatcctacctccataagcacctttgaaagactaagccgacatatcttgagattaacgaaatcaccacagatgcctcgctgtcaacgggtacatcgcttaccattgaaagaataattagccataaatatgaacatccgagtcagctttaaaacttgaacttaggtggctggctccaccacaagggactaggggtgtcaatttctccatcggggcgaccctaaggggccgggggcaaggtggaattctcacccgtgggtagggggcgcaaacagagttcactccctcgccgtccgccgcctcgttgtgccccctcgttggccacctcgtcgtcgcaccccctcctcgtccacctcatcactgagccccctcgccgttgccacgtcatcgcctgcaacctcgccgtccacctcatcgacgactttcttggttaggttgcggggcctcggggcgggtactgattttcgccctgttcatccctcgggggccggggacagggatacccgcaagagcgaggggacgggagcgttccagcctaacccggccccgtcccggcccattgccagtttgcaacccttacaagtaatctaacaagttgagctacgctctattcttttgctatgggttggttacaagggcaaaaccatcattttgctaagcctagcactcgactaatataattttgtaaaatcttcattttttatattttttcaaatgaattttggcctctttgatttgtagagaaaacaacaaatattggaggattttaatcctaaaaagaaaatactaagaagtcttttgaaacaaatgatttaattatattcttcctctaaaattcttatgtaagggataattctatagagatttcagaggaaaattagcaagagctttaaccccttgaaaatatccttgaagtctctcactctcatttgattcttgtgttggtctaatcaaatgactatttctacattcttttgtgttttacaatttgttttgcacttgtatttcttatatttttgttaactagaaaaatacccgtgtgttgcaagttgcaacagccaacaggtgaaggctattttaatttttattattgttatatggtttagttaaggtgaaattcattgggggagttcgtttggatatatatatatatatatatatatatatatatatatatatagagagagagagagagagagagaaaatcctgtagtaggagtctggtcgtctcaaattagcatgcgagtttttttttagagaaattttttatatgactccttctgtattttcaaaagtgaacgaacttaaaacccgacccatacacggatgacgtaccaaaggaccgtaaaaaatatctttaatttttataatagtagatatatttatatgtttttattcatctttttttttctgtcaaagggacgacggaaacatgcgcagggctccacccctgattagttaggtaatactaacttgctgtattttttcttcttgttatacatgtttggaatttatagtccatcgagtaaaggaatggtactgtcctagtttagaagtggaacggtacatataagattttcttactaaaagttttatgaacaattaaggacatgttcttttctttaactctaaacttcaacttactcatttatgttagcacgattttcaaactattaaataatatttttttgcaaaaaaatatatgtagaagttgtttaaaacaaattaaataaatctattttttcaagtttataataattaatatttaataaatcgtatgctaatgaactttcttgtttcacgtgcgtaaaaattttccctctaatatgagacgagcgcagccttagttctatttaattatctaatataacgtgttctcatccataccttctttcaacaatgggaaccacgtcatccccttttcctaaatcttaagagccattttgaatagtagaaatagaaaaaacattgaattcatatacgattgtaaaatatggagaaaatatagaaataaccgtttgattggaccgtatgaaaaacgtagaaataagatgaagaggtagactcaaagaaaatttttcaagaggttataactcttgctaagttttctctatctctattggatcttcattccatagaaatttcaaatgatacgataagatttaattctttataatctttattataaagatattcatagaaaattattttaataggattgaaatcctccgaactttctattgttttctataaactagttggatggcctgcgcaattgcgcggctagcactcatacaaaatcatttattttctaatatgattttacttaaaatttatcaaatagctatctcgttgtcttaaggctttgaaaagccaaaccttattatccccatgtttctacttttatagtttttaaaagtcacaccagttgctaccccttacttctatcacaccccttcttcatttgcttgcttgatctaccgttgtttcgattcattctccttggacctttaaaaattataccttatagtttttagagattaatctctcgttgggttttgtttttataatttttagaagtcccatcaaacattgtcactatactcatccacaacccgtccattgccttctctctttattgccattgggatttcaaaaattgaatataattatcatttgggttcattttttactttttagaagtcccgccaaaccattaacggcttttcactgtatttctctatggctcacccattgcctcccctgtttattgtcattgagattttaaaatcgagcaagattatcaattttttttttactttttagaagtctcgagcctttaaaaattggaccttgtagtttttatagtttgttgtatcgttgggtttcattagtagaaactttaggagtcccgtcaaacgctgcactatactcctctatgattcatccactctctcctctctttattgttattgggtttattttttactttctagaagtctcgccaaataatcagcggctttatcaccgtactccactatggctcgtccgttgtctcctctctttaatatcattgagattttaaaatcaaatttgattatcattatggtttatttaattaatctcatgttgtaccctatctggactattcttttaatataattcattttttaatcggaattttaattatttataaattctattcctattagaactcttcattattattattaggattttaaaaatcgaacctaatcattctttggttttctatttttatagtatgtagaagtttcgctagtgcccatctcttaataatacaatacaattcattttatcttttattctacttagtagttttctctaaatattttttgtttctgattttagttatttttaacatatgcccaccataaattggtgcatatttttttctttttctttacttattaatttggtaatttctagatctccttgtataatatttggatatattattaattgtatgagccattgctgctgtagcgggcagactaccgagcaagaggatagattttcttttttactgagcttctttgataaaaagaaaggaacgtgcagcattgcccggttggggcttgagagtccgaatataacttggacttttattttttgctgcacggttttcttttttacaaagtttgagtaggactcttatttatatttgtccaatcaatctcaatggttaaattatagatctatcataattcaatggtatagatttttctctttttttttcgattaatgtggtaatatgtagccttcatagcaaatatggtgcctcctttcaaagatgcttcgggttatcattgagattttaaaatcgagcatgattatcattgttttttttactttttagaagttccgaacctttaaaaataagaccttgtagtttatagagtttattgccttgttgggttttattttttataatttttagaagtcccataaaacgatgcctctatcctcctctacggcacatccgccgcctactctttattatcattgtgattctagaaatcgaacataactatcgttagaattttttttttattttctagaagtcccatcaaccgttggcggctctgcaactatactcctatacaccccgctcattgcttctccttagtcattgagattttaaaaatcaaatatgatattcaacgggttttttttactttctagaagtcctggcaaccgccttgctcgtttgcttcacggcccgccgatcgtccctccttttaatcatcattaggatctatttggtgttttattaacagttttttatatgtcgtatcaaccgccaccactctactcctttataggcatgttacttaatttatctcgtcatgtgttttagatggtattttctttcaatagtttttatttttatcacaaattttagttatttataaattatattcctaattgaaatcttatttttctttctctaatttcagaatttatttttttcaaattttaattaatatcgtattgtgttctttttttttcaatttcagttgtttcaaaattgtattcctacttgaactctcttttaatttttctaattttgaatattattttattttttactttgaattttaattaatcttgtattgggttctgttgacagaaaacacgaggcctgggagatctgcttaactccagtgcaggtccaaagctcgccttcggatgtatgagcgtgctagttgatttgatcttgaaatcaacaagaaatagaacaaagaaaccgcaattaatcctataaatgatagccgatcggctaagtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgagatagatcggtcgccttgccgagacagtataaatcacttagatcgaaatatatattaatagtaggattatatacattcatgtaacatcccggtctagggcttaataggattaatagaatactcatatcaacaagttgcaacttcttttccggaagccaatctccaaagaactccagctccagggttaagcgtgcttggcgtggagcaatttgggatgggtgaccgacccggaaattcttcccgggtgcacacgagtgaggacaaagtgtgcagaaaagacatgtgttggtctgtgagggtagtctatgacctatgaaagctatcagacgtaagcgggcttggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactagacacatggacgtggccaagagaggacgttcctggcctagggttgatcgacaggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcatggagcaatttgggatgggtgaccgaccgggaaattcttcccgggtgcacacgagtgaggacaaagtgtgcagaaaagacatgtgttggtctgtgagggtagtctatgacctatgaaagccaattcatagcatagccgatcaggtagatctagcatgtatcggctaatactccgatactactctatactaagattttaaagcaagtaaataaaagtagttaaatcagataagatcggctgaaactccgatactaccctaatcagcaaccagaaagcaggctagagattgcaattctaagcacgactactctatactaagattttaaagcaagtaaaatatactaaacataagcttaatatacttatatgcgacaagatcttaacataaagggcagatttaacatgtcaatcaagcatatagaataaaagtagttaaatcagataagatcggctgaaactccgatactaccctaatcagcaaccagatttaacatgtcaatcaagcatatagaataaaagtagttaaatcagataagatcggctgaaactccgatactaccctaatcagcaaccagaaagcaggctagagattgcaattctaagcacgacttaatatatcaaacttaactgatgcagcattaagtatgaaaagaaaaacaatatctagacaatcaagccgctgaagtttcatagagtggtagatatatcacatagtctaagttaacatcattatctaacctaatcgactaccttccattaacagatgttagccgattataggttagatgaagatattatcaaagattatgtgagatatatgataactcgacgaattatatagacaagattagagtgtcataaagatggaagcactaatcttgagaacataagtcctcatgacaagttttacctcttgttgaagatcgaaaccgatgcagctcaacccgagagcacgaactcatcgaaataaaagtaaagcataaagggtggcgatgcgccgagattgtattggatgtctcctttttacatagggctcgggtctattatacccgagaaaagatacgtccataacagacatgactattatctctaacaaactctaagataccataagtctttacggcagacttttgcccaaacatatctctaaggaaattacatagaatatcctaattaatagatataattgccttcccatgactctatccatgcatggcaatcatcttgaagcacatcaacttgaacccgatgacgtacaccgagtcaaattatcggaatcggctgtatcggctaaccccgtccgactcgaactctgccaacctgaccttagccgatttggactgcagtcgattcttactctgtttccgcaacgatcttcatcttggattccactttgatctgatcttcacctccgatgccaatagtgatagaatttaccaaatttggttgttaacaggttcttgtatggattcttctttcaatattgcttatttttaattccgaatttcagctaattttaaattttattcctacttgaactcttcttttattttcttttgctaatttcgggttttatttttatttttatttttaattttaattaatctcgtattgggtttttatatggactcttcttttaatatttcttatttttaattctgaatttcagctattttaaaattgtattaactatccttttcttttctaattttggattttattttatttttattttgaattttaattaatctcgtattgggttctcatatggaaacttctattgcttggactcttctttttttttctaattttagattttatttattttaattcgaattttgattaatctcgtattgggttcttatatggaaacttctttcaatattgcttgttttaatttcgaattttagctatttttagattgtatttctacttggactcttctattcttttcttttctttttcttctattaatgtgggaatttctagtccccacagcgaatatggtgtctcttttcaaagctgttttaataatataatagatagatagataacctccgggccaattcaagcgagattgatgggggcagccgccgatcctgtgcggtgtgaagagtgaacgagctctaatggccaatggacgagcttagcgcggtggagtgcgaaggcgcgagagctcgtgcggcggccggcgggagggtagtattgctggcaacgcaaactcgagccacgttgggcacttgggcgtttgctagctgctaccgctagtgtagccggcgaccacagagagagcgtgcgaaagataatcgattgcggaagccccaccccctctgttctccttggcctataaacggaatatttctcgtgagtcccacatgtcattgtctggacgagcaccctggtgctctgggccctcaacaccgaggacgaggagatgagatcgatcgcgtgtgggccggcgagccgcacctcctttaggaatttgtttctttctcagagtcctccgtttcttcgacccgtcgttctctcgccgcctgcctcgccgcccgcccgacactttccaacgtttaaaacccgtcttttttctccaggttttcgcaaggggacgacgacgccctgtgccactacggtacaaggccgcgccgagccatcggcccatcgctgcgtaaaggtgacagctagcgccgggcgatgcagccgcccaacctcgcgcgcgtaaagtgaccgttgcgtttacccacccggccgaccgatccgcgaacgccaccgtatgtactggactagctagtctctctgttccgctctactccaagaattcctcggttccatctgcatcgacggttctgtgagtctgacacgaagaacgtaacgttcttctctgtaactaacgcacttgttcggttgttccagaacgaccaggctgcagagctagtgcaactgcagacaacgatgccctgccgccgatgcgtttggcgttcagaaatggacgtagtactagcttggagcgtgaatggcaggatgggtgtacacgatacggatttgtcaaagccgagctgccgatccgatggtgcgtaccttctcgtctctgaatttgcactgcgaaaaaggtataaaggagggatgaatcccaacccaaaagccaaggtttattctcactttctcagagtacatactaccagtacacgctacacctccacctccgctgctttaggccccctttgaattagaggaaaaatggaggaaaaacaaagaaattgaaatcatacactatttatgcctttgattcataggaataaaaaaaggaaaaacgtaggaaactttcctattcctacaattctagagcaaaaacgtaggaaaattaacatccactctaacctcttagaaaactttccttgagtctatctctcttatctgattcctatatttttcctgcggtctaatcaaacagtcatttctatatttttcatgtgtttttgtaatcctctgttttacacttgcattcttaccaaaatcctgtgttttttctgttccttcgttttttctatacgatttaaaggggcccttaatttttagcaacaccatgtggtcctcaaactcatcagcagcagacaacaactaaagagccgtgtaaatatatcagacaatgcaattagtagggagaggcgcccataacacacagaagagaacaaggatcagagacgaaaaggtttagccttttaacgctgtgatctactcgccgctacaaagagaatggacggattgatccaaagtgcctcgactttactacttgcggcggggtacaccgtgccgcccggcgtgccgcgcgcctcccaacgcgagagggggtttcgacctacctgcacggcacgcacgcacatatgctctgcatgtgctgtgcaacgcatgggcgcagccgcgagagcaagcgcggcatgatgcgcctgtacgctaattcttggatcattcctccctgcgttagtttaacttaatcctaccggtacactgcagacacccagctaatcaattaggcttcttgcattagtatatatagtgatatatactatatactccgtaccttgtatatgtcgttggagtatcatgcatgctgtgactgtaaaagcctgcagctaaccgataggaaggtagcagagggatcgtactgttctatctcgtgcgtagtggtggcatctctcggtgtccccagtttgtaatctagccaagtttcacggcatattaatttgcagcgaagggagacttatggttggccatgcatgctctgatcacagttacgctcctatccatgtacacgccgtgtctctatccggtgttggcccacggtatatcaggaccatcgctctctcgcgtctagggattcggaaaagctggtgtatatgtccaacacatattttgatgcaatgttgatacgcgatgtgactcgggttttggtacgcagatatactcagatgctacggactgaaaattgtacttggggtatacacaaaagctagctgggcgacgacattttggagagatcggtaagtctattgtgtgtttagagctccgtcgatgacgttgcaattgttctatgacaagaaaaatgttaaaatatcagctaagtgcaggaactcaacctggtatctcagtgaataaacatatggacgaggtatccgtacattgtatgattttgatatatcagtcatcactcatcagtgtccgtaaatatctctctttttctgaaacattaacgcagaattattatacgttagctacggtagctaaactaccaggtgaaagctagcgatcgaaagcatgctagctagctgcatgcatgaccgttggcgtccgaccaaagcagaaattccaaaccggggccgcagcgccagcagctagcttagctcttggagtgttcccgtcgggcggctatagcttagctctctcctccattatttgcatggccgtttcctcccccctcacagccctataaattccgaacccctgcctcacagtctcggtctctctcaccacatattccgcgtgcatgtgaagagagagatatagagaggagagctagcgaaagtttgagtgacaaagacgcacgtacgcgcgaaaacgttgtcacgcttttgagtgatcgatacacgggggggatacacacgcaaaccgatcgatatggttcgtgagcgggtggtggtggtgatggcgttcgcggtggcgacgctcgcgacgagcctcctgccgccgctggcgtgccaggcggcgccggcgccgtgcgagcgcccgacgcgcgggcaccaccagtacaggcagccggtgggcgtgcggcggatcgtggtggacgcgagcggcggcggcgacttcctctccatccagcaggccgtcaactccgtgccggagaacaacaccgtgcgcgtcatcatgcagatcaacgcagggtcctacatgtaagctatacccagttagctcatgctcatgctcatgcatgcgtgtgcagagtttgcgtttctgacgtgatatatgtgtgcgtgcagagagaaggtggtggtgccggcgacgaagccgtacatcacgttccagggagcagggcgcgacgtgacggtggtggagtggcacgacagggcgagcgaccgcggccccgacgggcagcagctccgaacctacaacaccgcctccgtaaccgttctctctaactatttcactgctaagaacatcagcttcaaggtgagctagcaaacaccgttcgcgcgccatgccatgcattagccagtggtccgtctccatggacccggccgccaacgtacgcgactcacaagacgcacagggagatgcggtgcagtacagtgccgactgccgaggcagagaggcagacaaagtgacaaaacccttcagtgtcacgagccacatcttgcaaatttgcaaatgctgcatgccgggcgtctcttcttctctgtgtatcccttgttcttttgatattttgaatccgtttgtacagggatgtattttcgggttcttggagcagccaaagcagatggcttcttccggctacggcggagagaggctacagcctgatcgacgcggccggccaactttttttttccagtgaattgcatgcatgtaagtagcaaacaacagctgacgctgggttcctgaatcctatggcttggcagaacacggctccggcaccaatgcccggcatgcaagggtggcaggcggtggcgttccgcatctccggcgacaaggccttcttcttcggctgcgggttctacggcgcccaggacacgctctgcgacgacgccggccggcactacttccgcgactgctacatcgagggctccatcgacttcgtcttcggcaacggccgctccctctacaaggactgcgagctgcactcgacggcgcagcggttcggctcggtggcggcgcaggggcggcacgacccgtgcgagcgcaccggcttcgccttcgtcaactgccgggtcaccggcactggccgcctctacgtcggccgtgccatgggccagtactcgcggatcgtctacgcctacacctacttcgacagcgtcatcgcccccggcggctgggacgactgggaccacgccagcaacaagagcatgtacgtactgcttcagctagctagctagcctgatcaacttgataaaaaaatgaaactatattattcaattcccagccagctaacgcctgtgcaaatgttgtcgacggcgtgcatgcgtgcaggacggcgttcttcgggatgtacaggaactgggggcccggcgccgacgcggtgcacggcgtgccgtgggcgcgggagctcgactacttcgccgcgcgccccttcctcggcaagagcttcgtcaacggattccactggcttacacctgacgtctgaaagccgtttttcggcaccacaattaatttactggagacaagaacgtacatttgttagtacagcaaaagcgaagaatagaacattacgataaatataaagtattgaagtgactagtgcagtatatagcggtagattcattcgttcattcgttttgtctgatccggcttataatgatagctgctatagaattcaagcacagctctttacaagatctatagtagctatgtagtactgttttaaaagctttgtcatgtagacatgtacccatgcatgtgaggtgaatagtgaatatataattgattttgttgttactttaaggaaaaatccaaatttgatcccttaactatgaccttagtagattttgatccctcgactataagatcggtctccattatcaacttttgaaattgaccatatttcatctatgggcgccaatcacttctaagagttccgatttggatcagggatgaaatatagacagttataagagttgggggatgaatagtgaacattttaatgttcttctaattgaaggacaaagtcaaaccaaggccagataaaatacagacttttctctcttcataaagataaagattttatcttattttccgttagcacgcttttcaaattacaaaacggcgcgttttgtgcgaaaactttctatataaaagttgttttaaaataacaaatatatctatttttcaagtgttataaaacttgttagattttgtatatctcatatttatttattttttttacatattttccgctatctctctcaatactgttgctataaatcggttgtggagataacggaacgtacgagcctatatgtacaccgctctattggtattacaatcgattgcgctgagtcctatcacactcttatgatatcatattaggtttcttattttcgcatctcaaaccctaacctggcaggccgacatctctcgccgccctggtctcctcctcccaactccctatagactctgtcctcgacgacacaatcaagatcatcgccaacgcagtccgctcctccttatgactatgatataaaacgcattccgctcctccttccagacggccctaggtttgcaggttgatgacaccgtcattgctaccatcatcggcgatactgttgattgtgtcacaacaccggtaccctcttcactactcacagctccaccgacaataccccctctcatattattgttggcagtggctgtcttctccctattacttccgttggacgtgcttacttacactatcctacactactatagatccgggcttcagtgacgggtcatctgtgacgggccaacgcaactcgtcaaagataagtaatctctgacgggccaaaaaaatatcctcttcaatatatggctaccagggaggacccgtcacagatgtgaagtcatctgtgacggcttgcacttgtaacccgtcacagatcgtctgtgacgggtcacaaccatggctcgtcatagatgacatgtcatctgtgacgggtgtagtattatgaaccatcacaaaagagaccactcatctctgacgggtctttaactaacacacgtcacagataatgttatctctgacgggtggtagttatgacccgtcagtgatgagtgaaaattcaaatttttaaattttgcaaaaaacctcgaattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaaccagatctacaacattataattgaaaatattttcatttcacaaaatttacatgttataaagtgagatatattttgaaaaatgaaattttgaattcttcaaacaacatcggatgaagatattttctatgtaaaagttataaaacacgataagatctataactacttagttgataatattttcatttgaagtcatttagggtgttaaatatatgttaaatgattcagacaagcatagacaaaataataacattggatgagtaatcaatatgtgttgagtaggtgagttggtaagggagctctatatggaggttgaggtcttgagttcgaatctcacgtgtagcatacaagttatattgcgtgaaaaattgtgaatttgtaggtagtgatgtgtaaccatgtataggatggctagtaaaattcaaaatattttttttaggttttttgatacgtttaaaattcaaaaattgtatttcttgctttgtcatcagtgacgggtcgtaagttacaacccgtcagagatgagtcatcagtgcgcttaggtagtacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgttagagatgacctggtccggcgtagtgctaattgctgctttgttcttaacaatgttctaatctctcttgacattattaagagctttatttctgcacaccatttttcttatgataattggtgttccattgaacttgacccgtttggcctctttgtgaagttctcaaaattatatatatatatatatatatatatatatatatatatatatatatatatatatatatatatatatatatatataagcaatacacgtcctatggaattaaaacttttctatagaaaataattaaaatgcccttagcttagaagcgagacgtcaagaacaattatagttcaaaaatatctaatcactacagatatcttaatatcaagctaacactacagaaaattctcacccatcatgccatcatgggaaacaccttagttttgaaaaagaaaacaaaaacctatggttggaccttcaagggggtaaaatggaaaaacaatctattattgatagtgtggcgccaatattttctacaaaaaatatattccctattgtcaagtatagaaaattaatcctatcccttatgagattatttttttatcccccttccttatagttatgtctttgagaataagataaaacccatatgaaaagaaaaattgtattcaccctagatgttcaaaatatactattgttatacaatggcttagagaccaatgatgcatagtagcactcagcactatgtacctcagtacatggcaaatactacctctgtccctaaagccctaaattacacacgctgtgttcgttagtgtagtttgaaaactaataggttgtttggtttggtgccacacattaaaatagagtaatggattagcacataagtataaatttattagtttaaaatttttaaaaataaattaatatatttttaaagcaacttttctatagatattttaaaaaatatattatttagcagtttaaaagcatgtgtgaaaaaggagaaaatagttgagaaggagcaaaaaggccacaccagagagtactctcgttatatatttactcccttcgtcccataaaaaccgaatctaaaaccggatatgatatatcttagtagtatgaatctgaatatatatatatattcagatatttagattcatatgtattatattcggttttagattcgttttttataggatggagggagtacactagtactactactacatccacgagttccccaatgccaaaaatactgcagaaattggatttcaccttagtgaattatcaccgtattgattctcctcatctttgctccaaagagaaaccgcggggctgcagaggatgcaacagctaggatcatgcggcgaagcagagcgcagagcggagggtagagtgcgtcattgcgaacctttggggattaacctcgccgacgatgaagccttcgaccgtgctgcccgagaccgagagcatatgccctcacggccgcctgaggtagagacgaggccatggaaggcggccggcggccgctgcgtcggacgcgttgaggggctcggggatttggaaatttgcgtttggttttcgcggcggagagccggagataacacagagaaactaaccaatagtgttgccaaatcggcatcaatgcggatctgagtggtggtggtggtggactggtggttgcccccacccccaaccgcgtagaccacgttggcacgcggccgccgcaccagtccccccctccgccgcagcgcaatgcaccaccagatttggcgcctcctccccagcgccctctcgccgatccacgccggagctccccggccgagccgcccgccggcgcggctaggccgcccttcaccgcaacgacggcgggcgctcgcgctcacgcacctcgccacccggcgcacatgtcgcctcctcgctgtctccgcccagtccgccagcccccacgccggcttgaggtccgcacttactcgtcgaatttccttcatcgctattcatggaatctgaggaagagttggaattgtggtttgtggtggaatgtaatacctggtacccttactggatgggaggaacaatgccgcacagctaaactggtgttaatttgggggaagtgccaattttatgccttctagtgctaaagcttgtgaattcagtttttggattatgtgatgtgcattgtaatgccgaattatgtgttagtctttggctaaaacttttgtctatgatcccctgagtagtccggatatctttagatattggatggtatcatgatcaatatacctcgcttgttcaacttttctatgatcctggatgatgccctggatatgaaattgttgttagtccttgtaattttcaggttggatcagtttttcgaggtggagatgaaggtacgagattatgaactcgaccaatatggggttgtcaacaatgccatctatgctagttactgccaacatggtgagttctgttctaccaatgaaacaaactaaaagaacatctcatgtatattaattaggtcagttaatatgattcctatagcatgtttagaatttaattaaaataatatgattaccatggttggttctgacaaaattaaggattcatttattttttaaaaaaattgagcaggtcgtcatgagctacttgaaagtgtaggcataagtgcagatgcagtagcacgcagcggtgagtcgctggccctctctgaactgcacctcaagtactacgcgcctttgagagtaacatccttgtttcccaagttgtgaaaaaaccagaactgaaaaatgttgatgtgatactatgaaactaataacagatcaaactctaaatattgataataggttcatttgggtctaacttctccctttgtttctttgacttgtcagagtggtgacaagttcgtcgttaaggtcaggcttgcgagcacaaaaggtataaggatgatattcgagcacttcattgaaaagctgcctaatcgtgaggtatgcagcacaaataattgcagattttagaataggaaaaggaattaaaagcacagtacgtttcaaattctcaatcatgttggtaacaaatcttggcagcaatggcacaatgccatcagtagcaacgtactagcatttttcgcaacatagtaccaacttatgaaatctatatgttatttcagtcacaaattggtcgtaggatttcctttgcaactgctctttgcatagatcacacttttccatattcttctcctagcagctcattttggaagcgaaggcaacagcggtttgtttgaacaaagactaccgccccacccgtatatctccagagttcctgtccaagctgcagttcttcacttctgaaggcagtagcagttaagtcactgtactcatcgtcataacctgcgataaatcactgtatcccattttccatcgtattgtctttgttcaaatgaaccaattgattgaagcatttgacttcagtgacatttctaatctgtgataaatctaactgcattctttatttgattttcttggagtgagcacgcgttccaacgtttgaatacatcgtccaaattcagcaaaaactttgaatggctatgttgagctcatggatatgatgtgagaaactttttttttttttttgggggggggggggggtgttgagcactggttctttctgtgctaggttacatatctatgagacccggctttagtcaggcaagggctcaagttctattcataggagatctgaggtttctgaaccctttccacacaatggatgaacctttcagtcccaggcatccaattactagttgtgatagagtgaatgttcaccaattgactagtataagtagtgaacatctcccaatggaaaaaagctatcgaaattttaactttatgcaaaattttcagttttgagttaaaaatttgcacattcttagttcaaaacatctactaacattgaacatagtagttcagatttttttttatttcactggttagctcacaatggctgctgtgtttgacatgcgaggaaaagagaagatcgaggatacgcaaaacaagataagccattagcattagcgtatggttaattaattattaattattttaaatttgaaaatgagttattaatatataatttttaaagtaacttttctatatttttttctaaaagaatactccctccggtttcattttaattgacgctttggacaatgacacgctctacaagatatacatttgaccttatttttttattataatatatacaataaataaatacatgtttatttttattatagtgttttgaaagacaaatctatatatgtttttctagtttctttaaactaaatatctttaaagttattgatggttaaagttataaaaggttaacattaaccttgtccaagaaccagggggagtatatcgtttagtagttcgggcaatcaatcaaaagctaccgaacgcagccgaatacatatggcgatttcggatagcctcgccaatatgctactacgtggcaatatctagaacgaaattacgtggacaaatccactaggtaacctatgcgaaagcactaaatgaacccacataacaggatcagcgagaacgtaccgtgccggggagaaatgtttccaaatggccgcttgaccgcaaaaagcttagtgcctttttatcccttaacaagaattcctaaatatccactccccggaaaagaaattcaaggtctgccgcactcggaaggtcttgtttgtgttaaagtcggatttcgcaatggatgaaactagggtttcccaaaccaccggggccggggttatcgtgccccggcagtaagcacggtaaccgtaaaaaaccgtacgaaaccgtgcaaaatttatcaaaaattcaaattattttttaaatttatttgaatttaaggaggttaccgcggtttttctattaccgtacccccgcggccggtaaccgcggtaaccgcacggttaccgacggtaagttgaaccctggatgaaaccaccataagcttgaaattttggccaattaagattggattaaattccactagccgaaaaaaaaaaccgaatacatcattggtatacctttttagccgtgtaggagtttgatatagactatatttaggggagtttaaaattcgcaaaaaaaagttagttgatagttccgttcctgagaatatgaaaaagctaaaaatcccatcttcaagtttctaatttattttctaaaaattttttagttcttggagaagttgtatatgcaaaagcttccaaatagcgaagtgagcgttggtagaatatgtgtgctagtatttacccgttaacagcaaggtgttcataataatttcatcaatcacaatatacgtcgaccaatattttaaaagtgcccatccgaaatatatccatactaggtcgaacgaaaacaccccggataaaatcgggcagtctcttgatgcgcgcggtgtagctgcagggagctagcaggagaagctggaggcgcaccgcgcacgcccgaccggagccagccatggagcgggcatggcgcgcgctccgcgcatggagcgccgcaatacgctctctctctctctctcgcgcgcgcgcgcggatggcatgtgccttccctgcaggcgaccttgccggcttgccgctcgtctccccttccgcccgccgatggcgaccagtctgtccactcgttcgccttcgtgccgctgctgctcgtgcgtgcggcgccctatgttgaaccggatcggggggacgggacgacgttccaccgttcacggcgcgcggggttgtcgtaaagccatcacattcatcggaatggggaacctgcctagctgctgccctcgtgcgccgtacccccatcgaatcctagccgtcggttcagctccgcctgatggcccagacggtccagatcagccgatctcgccaggagagctggttggtccaacgtgacggcctctgacgcacgcacgcaaggcaggcaggacgacgagaacgcgtccatgtacacgtaggcaacacacagctggagcttttctttgaagagaaaaatagcaaacgaaggaaatgattctgctcgttttagagaaaaacatataggttacgtgcatatatcggcattttcttttgaaatccacattaacatgcataaatatattgcatggaccttgacaactctcgctgtcataatgcatgctcctgtcagaacctagctaccgactaagtactctaacaatgggataattaatgtcagattactgcgtagggtgcgtcaggtgaaagagataactagccaaattaattgtgcgcgcacgaaactttttcctgtgtgcttgatttccacatcatcatatataggtcaacctagaaaatacaccactcttccttgaattttgctcgtggcatagttccccatttaaaaatgttattactaatctggttgtcaaattgcggtaagtggtgctgtgactaagtgtgaattatcagaatatatgtgacgtatgtggcacgtgcaccagtacatggtaaaaacctttactgtttgagcgggaatttgtttgctcgagagtatctagtttttgaaacatctctctggtgcagaggaattgtcgtgtttatgcttattttttcctccttctgatgaaagataggatcactattgtttgcagcatttttcataaaaaataatcatgtcgaataagcgtgtggctagttttcgacgatgaggaccagcacgttttttacagcagaagtcaaaactcgatcataatgtcctcacgcaccggagtggattttaaagtctcgcgttaattatatcacttaaataattacgatttttttaaaaaatatgaagatgtattaatatgtgatatatcactctacaaatatccaatttagaattcaacatgtcacaacggaaaaaataaatttgactcaacttctacattactaaatttgttttgtcttgcgacatgtagaagttgaattgtaaattttatgtttatggagtgatatataatatattaatacacattcttaaattttttttatacctgttcaagaggcatgcaaacaacgaggggatttaaaatagtatttgtcacggtgcaggccttgcctctaacgaggggatttaaaatgatttctgtcatagtttaccctttgcacgtgtatataggcttagatgtcggtgtcccatgcacacatgtgaatttccttctaatatagacgtataatttttttgcgcgatcgtgaaaaatgcacacatttagcatgtagtatatgcctctttgtgtgtgtgaaattttacagagtgcatatgaatttcacacgttgcaaatttgtgtgttcagattatagtaaggcatggcaattgctaagaatctgcgtgtgtgcagactgtttccgaaagatcaaatgacgcaacctagatacgatatctcacagacccactgtacataccccaacctgacaaatcaacactgtcaggatcggagtaacagtattttaatgcttcccaactccatcaccgcaatatcgtatcagccctaacggtcgacgaccggccggccagccggtgacccccatgggccgtcacttagctgggtgcgccaccagcgacggcgccccaatactctggtcaagaaacgtgccactacactgtggtttgtgcatatggaagcccagttcattctctgccgttgtctcatggtgaccggtccgacgaccaggaaaggtaaaatccagcgcgcgtactctgctctatacaaccgaacagtcttcaacgcaaaaaccgcatgcgagcaaactcagacttttgagggtagagagaagaacggtaatcacctagctagcttacacgccggattggactttccgttgcaaaaactacgtgtgcagcgttgaacagctaatcacctgtcctttcctgtcccacggatcatcacctatataagcgccatgcatgcaccgccatgagggaaatatcacagcaatcgcttcatcagctcgccgattgcaacgtgagttctactacacactagcagttgatacacacacacagttcaggcggcgataagctagcctgaggcctgaatatatatagcagctagagatactagtactgaattcacaatgcagcagcagcagctgtgcagcagccactgcctccctgcccgtgccggcagcatcgccagccccggctccggccgccgcgtggtgcccctcggccgccggcgggcgagcctcggaaaggtcacggcgtacgcctacccgacgactcgccgcgtcgtcgatgccgcaaaatccagcctgcttcaggatgtccacgttgctgcctcgaatcccagcctgcagctgctgcaggattatgctcccgccaagaagtcagcaaaacagcagaacggctcaaggtcctccttcgatcgagatcatttcaccaatctactccattaatcattaatttcctcacttcatttttgaatatatgcatgacattgtaaactttcagacattgatatttaccatcttactcaattttttaatataaaaaatactccatccgtttcagggtataagatgttttgacttcagtcaaagtcaaactgctttaaatttaatctagtttatagaaaaaataataataataatttcaactcaaaacaaatttattatgaaaatatatttaattattgatttaataaaactaatttgtaattataaatattagtatatttgtgtataaacttagttaaatttgaagtagtttgacttttactaaaatcaaaacatcttctaacctgaaacgaagggtatatcatacctaaagtacaattaatgttaaaacaagtccccacagaataaataatacttacttacataaaagtccttttaaataaaataaatgatcaaatatcatgtctaaaatcaccatcatcataaattcatttaaaaatggagattgtaatttctattgttgatcttttgatatttcagagaaaaaaaattaactctgatgttttgggtattatgaaatctctcaggacgaaggacgggttttacgaggtcgagatgacggtccaggacgacgagcttgacgagtacggcgtcgtcaacaacgccatctacgccagctacatccacagtggtaagctaatacatctccaaaagtaactgaagcatctgcatgctaaacctgttataaataatctgaaccgtgcgtttcatgtgtatcaggccgtgacgttttccttgaaaatgtcggcgttggcgtggactactggacgtcgacgggcaacgcgctggctctttcagaattgaacctcaagttctacacgcccttacgggtacatcttctttcttgttttacttattactattttggacatctatctcccaatcttgatcaacttcatgtttttatggtcacggcacacacaccgagaaaatctaacaaacatttgccttgcgttatttccagaaggatgatagattcgtcgtcaggatgaaggtcgtgaagatcaaaggtgtgagaataatcgtcgaacatttgatcgagacgctgccagatcgtaaggtaagcatgaatacacagggattctacagctaattcattctctgttaatttagaggtgattttattaagaggtattatactttttagtgtaaagcttgataccttgggataatttagtgtaaattttaattatctttaggtacttttcaagcatagtaaagtttctctaattttagctaatggtgatcgatcgatctcacacaatgattttactgctgcttctcccagctcgtagtggatgccaaagcaaccgccgtttgcctcgacaacaaataccgcccaacccgtgtgttcccggagttgtcgacaaagttacatcagttcttcctgtcataaacggctctttgttgctctcatgacaagaagtggatgaaccttatgtgctctaccggtgtacagagcaaggcacaatttgtttgatctacattttttttaccagaattatgaagcatactgtagtaaataaagagtgaataagttagtgctgaccggcttagccgtgagccgctttatgtgaggatgagatgtagatacgcaatacaaatgtgcacctgttcagcagctttcatttcaatgggcattccattaaaaaaaaattatgatcttccatcgtgccttggatttacagtttgcatgattgtttctcaacaagtgaaaagctgcgtatttttatcacgtataaccgtagactacactcgagtacagaacagataaaactcgatcagatgtataatccacggaacaagtattagcacttcagcaggtgaacccacaaacgcacgtgttgctagatgagaacacaagcaacagcaagagaaacaaatgtacggctgcttgaccgtttctaccacatggcaataccagtcgttttcattcaaaaagatcacatcaatataataccacaacaaacttctgccaggtaatgacaatagctaaaatataaagaaacacagctagtaagtagtaagacagttcctgtgtgcttgaattttggcggcggctgtgcttttctgaaactgaacatggtctacacatgtcataggtgcttcgacccttgccagttcaaataccaaattcagaagtcagactcaattggagaacagaaacagtttttaatgccaaatgattattcaagtcactggttaataaatttgagaagtgcatgttccacaagcattagattgaaaatctacctacacaaacattagattgaaaatctacaaggtatgttgaagaacctggtctttatgatttcaaccagtcacttatatataggtatgtgacgctgagagccagttttgccaccaatgatcaatccaacagcaccaatattcaccatgatgcagataggcaccgtcattcttcgtgtcagtcactgctaccctggcctgggcacacatgatggagatacagtgtataaattcgaaacccaagtgtccatagcttcaaaatttagattctttcgaatttgaaacttaggtgtccattgcatgaggtgtaaagtactttaggtgtatgatataccactagttaggtgaatttgaatttgagactaagtttcaaagtactttaggtgaatttgaaacttagctgtctattctggtatatcatacatttaggtcagactttgaaagagccattgcataagtttcgaatttatacactggtatatcatgaatttaggttatggattatagaattggtgtccataccttcgaaatttaggttctctcatgttgaaaacgaaactatgttcctcaattatttcaatgcataagctaactaggtccagtgtataaattcagagatgtgttggggcatgcaacccacatttcaatcctagttcacataaagttaaggttaactgtcccccaaagcaaacaaaattgatccagtcaaatccatgtcagataacaatatatcagaaaagttcacaaaattgttcctatcaattcatcaagtgaagcctgaaaatcaaaggtgcaagaataaaagcagaccacatgattgaaatacagtcaataaggtatggatttacctcacatgctcagatggcttgccaatcctgcgtgctgacagggtccctgcatatgtcatcatataatagtgaaatatcattatctacggtgcccagattcatggtctatgaacagttaatgatcttgcttaccatcttcatgtatctagcacttttgtttcacttgccagctcatacagaaagtcagaggaaccgctgttcgcctcaacaaacacttttgttttacactcatagatttgttgacaaaaagtactgcagttcttctcatccaagaataactaaaaagctcagatagcaagattgcattcactgcttcgctttcttaataagactgagcttatgaaacttgtgtgctctcctacattcactgcttcgctttcttaataagaccgagcttatgaaacttgtgtgctctcctgattttttttttgggtgatttttctctaaacaccatggcaagcaatatgtatcttacacccgctgcttaagctggtcttaaattggactgatggagtatcagaatttaacaattcattagaaagccaaaatagacatatgtagtgttatttccttttctgaagtaatagtaaagttatacacgaaatagaagcaaaaagttgagcaataatttagcacaacacacaaaaagcatagcatcgacttccaatggatgccacaagaacattgattcatttcacctgagagtggctgatgttgaaacgccgaccacttcgagtccactacaccatacatgtcaatgtacaccactacactatgctgcgatgaagccaaaaggtttctctgctgcgttcctgcttcaacccattgcatatttgagagaatcaccagctccttggaagaacaggcatgatagagcgaaatccgcaacgaaaatcccaactaaagaaacgaccactgcagatgtggtggactctccaacgcccttggctccaccatgggtggtgacaccccaagcacagctcacaacagcaataatggcgccaaacacctgagattttagcaaggaactgatcaagtcccatggccgcagcgcccttcgcgctgactccagaatgatgctggtactgacaccgaagatcgaatcagctaagaatgccgaggacgccagaccgagcgcgaagctcatgagggttagcacgggcagcgcaagcacacaagcgacgacgcgagggaccacgaggtaatcgacgggctgcgcaccaaggacgcggagggtgtcggtctgctccgacacctgcatggtccccagctctgcagcaaacgcggagccgacccggcccgcggcgacgacggcggtgacgaccggggagagctcgcgggagagcgcgagggcgaggacgccgccgacggagcggtggaggccgaggcgagtgaactcgcgcacgaactggatggtgaaggccatgccgacgaatgccgcggtgaggagcgagacccccgcgctcccggggcccacgcggcggagctgcgcgaggaggttgcggcggtggacgcggccggtgaggacgcggtggaagacctgccccgcgagaagcagcgccgagagcccccgccagatcgcgcgcggcggggaccacctggagaagggagggggcgggggctccggggacgccggcggaggcgagggcggagaattattgctgccggtgggggccggggtgagggagaggcggggcacgggcaggcggcggcacgaatggtggaggcggaagaggaggtgagacttgtggttcgcgctgtcgccggcgccggtacaggataagctgatgagagggtgggtggtagcggagattggacggagtaggaaggcggcgccggcaccggcggacggcatgacggtggccggagatcgggacggtggcggtgggtgggtggtgggcgattgggtgggtcggacggacggaggtgatggggatggcttcgtgctgcgggaaggtagtggttgttcttgtgggcttcttgatgttgggctttctgagctctcatgtgatgggatcactgggccaaggcccaagataagtcaactttgacaaaagttaatctatgttttaaaacttaattttagcatgatggttttgattttgtttttcgtagtttattttttattgctgacttttagttgtttagaaaaaatattatttataaattatttttattggaaaaatattatttataaattatttttattggttcgtttaacttttcatgctttgtaccatagcggcgcaacaactaatcacaaacacaatacggaacgggcgcacacgcagccacccgatccggaacagaacaccattaacacacgggtataagcctccattaatccttacttgcatcttcatcctcccatgcaaaattcaacctgagaattaattcacgtacacgaaagattagtggcagtagtgaagctgtggctatctcgctattgacttactatctcaataatggggcttgcatgtcagggcagagtcgcacatgcgttagtttgccgtgttcaactgcttgcaagttgcaacagcgatcgatgccaagctaataggtacagacactgcaaatctgcaatcctttgggcaagtacaggtacgtacatcatgggcatagggatggcaat

SEQ ID NO: 32045 - DNA, 29457 bp, Oryza sativa
  unsure (1)..(29457): unsure at all n locations
taaaattccgtgcccgtacccatgcccagcgggcgcgggtatgtccggcaggtacccaatagatctcacatgaataataacttgaaagatatgtaatttaagaaagagaaataaaatcaataatttaccaaatcaccgtttatcaacaataatttgaattacatcacaacttagtatcagttagcatcacaaatgaaccgagagaaatggtataagaattaagaaatgagtcaaaagtagttaatacatatgtatcgggttgagcatgggttactcacgggtaaaaattgaaacccacctattgcccataacatcttcggatcttggacggacgtgcctatgggtaaaaagtcacacacacgcccatgcccgtcaggtcgggtatccatggatacccagactcatggtaaaattgccatccctacatgggcagctcagttgatcgtcgatcacctagtcaattcgtgggtgctggctgctgaaaaggacgatcctctcttctgttgttagtggctggaagtagggactgatggctaccggacaagcaaaaacaaactgattctctgtcttttcttctcccttttttttttttttgaactcttctcattgatgcttcgtgcctctgctgtgctttcctgttctgtgacattgtggcaatgatgtagaacaagctatctcctttcggcatggcatcagttgagcttttatgggcaaagtgagcaaaatatgcttgatatattcccaaatgttggtaatatcctcgtaaacaacaagcagcacacagaacaccgacattggctaacttatagtttcgctctgctggaatataaccagtgtttaattttgacttgcaggttgttgataaaactgtaagatagcaactagttcaacatttcctacaagtgtaaaaccaacggtacagttacaggagctttaccatatgcttaaaagcctgagatgtcacattaattaactgtaagttttaaatttggccgtccatgcttgaagaaaggctagccttcttggctacccatcaaaagagaaacccttaattggttttcagaaaacatgctgtctacttatttattctttctccaactagctccatgacatccaaatatcccctccatgacttcatctgtaatggctgcatctatgtactaggtcgaggctaagtccttggttactagcttaacctttaccagttaccaacttgaaggaagataagaaacatttatgccgtctacttttcttctgtcttttaccaacctgattcgttggatgcctacttgtctagtcacactatcgatgttatttccctgagtgcaataatatgttatcagctccggccactaaaaatctccataaagcatgctcgatggagtagagctacaagcagcttgctcttgctgttgagatttggcttcagagagcatctttcccatccttaagaaggtaccatgaggtaccaatgtaatctgaccgttgatttaggaagggtatgatggggctaaacaaattagggtagcgttaatcaccgcccatcccagccaatagtctgcggcggccgccaagcgccaatatctgttgccggcgtctcatcttgtccgccgcagccgccgtctcatcgcaggtattcccccgcggccgacgtaccctcgacgccaccgcggccgcgcgtcgaacacgcgtctgccgccgtcgaggacgccgcggcagacgtccaacccgcatcccgtcgtcaatagcggcgcatcccgtcgtcgcatacagcggcagcctccaccccggcgcatccatcccgccgtcgcaagaactcgttgtctcatccagccatccgcaggcgcatcgactcatccacgacgacgccaggcgcatcaaaatcgccgcctccaccctgccgcatccaccgtcgcatccagccggaatactcgggcgtcgcttcctgctgttgtggtctctgttgttcctgcatcgtccgacgctcttgtgtgtgcaccttacatttgtattccagccaactaaagtttcttaaactcatttgtattcatgccagctgcttctgttctgtgtgttttcagcccaattaagtatagtattccagcaacaatcaagatgaagcttccgtagcatgtttttagttttcagaacagaacgggcagccattttaattttgtagcagtgattccaacaacaatcaacaactccagtagcataaaaactgtacacttgccatatcagatttgaagtgatgcaaacaactaggtaattttagggaaatagatgataaatatattacatcagaataacattgtcttaacttagaacataagctgctgcatggcctccattaaagttgaacaaaagctgctgcatagtatccattacataaggtgcagatactacactaggagggggcatactactacattatgagggggcacatcaaagttcttcatccattacactagttgagaacctcaagagtaatacataggtcatcatcaacttcagtgaacagaaacacacaaacatcaccaagctcgaataaattggcttgaaccaacttgttccatctagttgtaaaggtagcccgcttatctttggatttcttcagtctcatctcaaaggattcagctgatccaaccagagtcacaagtaaatcatcaattggtgttgaaaggtggttgtttatgtactgcttgctaaatggcaaactgaaggcctaaaaaatataaacaagacatttagactcaggacatttatgtataaacaaatgcaaatacagggcagtcagatttgtgaaccataccattttcccttttgtcaaattagtcatctggatctcatacacatagagtggaatggtaggcaaattgcttacagcaatgtgagcaattttgtactgcatgttcagtcccataccagtactacctatcaaatccagggaaggtgcgaggtccatattgacctgaaattggaagtttgacaagcacatcatctgactagcagtacctaacattctgtacatttggacttattaattatttatatgaaaataatcacctctttcaatggagcacttgcgcacgctttgatatatcttagcaacttcatcatcatctacaataatatttcccgtgtttttggtttgtaagcaccattttagttcgaaacaaagaagaaaggacatgaataagtaggaaaaagaatttggtttaccatcttcactgtcagaaatcaaaatgactggttttcccctcggaacgttgtccatgctggtattgtcatgaataaatcataaaactcgaaaagcactgattgaataaaaggacctcgaagcagtacacttggaccttgaagaaggacgggagcaggcacacataccttgaagatccacggcggcgacccggattgccgtgcccccgctcgccaccgttcgggggctgcatggtcaacggcgagctagaccctgagacgccgcgcacggacgcgcgcagccgcagcactggacggcgacgcctgggctggagggaacgagtgaagactgaagactgcctatctccctcccgcttttggtcaccgagatcccgacgaaacgccgccacaaccatcgccgagctcccgacgaacggccaatgcaaccatcttcgagctcgccgatgtagcatagaaacctccgagctcaccgtcgctagggctgtcaacgagccgagctcgagcgagcttacctacctaagctcaagctcggtacaggctcgagctcgggcccagcattaccttcgagcttgaaggtaggctcggttcgagctcgatcaaggctcggctcgactcgagctcgattcgtagaagctcgttaagactgtttccttcagcaatctgaacttatctcccaataaaagcttcttaacaagccaaagtaggattacaaattcataatagaatataatagcttctcgacaggtatatactagaaagattacaaattcatagtagtgcataagtcataatagaattactactttataatagaccggtgtgtataacaccataagaaacattacaatatcatgtgtcaatgacttgacagaacatagagcatcaattaacatcaaaagtagcccaccggaagttcccaacatatgttccatctaaaagctctaatatctaaatattacttatactactaacacagcgtacttcaaatttcaactgtcacaaaatatttactccactattggcaatggcagtacgccaatgtgaaacctccaagcactttcttcaaactaattgttgatgctatactatatgcctgcattaatgtttcgtaaagttaaatctgaaaccatgtgcaaagattataggtaatgtttcatcagtgatgaggaattgatatggtagcaatagataatttatataacctcaaacatatacctgacaaacgagtctaattgctgcccacaaccgaatttgcagttgaagcttgagttgggacaaggataatagaattagtatcatcctcctagtatgcaacaaacaagtaaacacagattattagattgtgtatctctattaattggttagaaacatgaaaatataagaacttactaaatatgtgcttttgtggtggcctcctctaatccaactagatgtacacaccaaagcttgtgctgttgatgggagtaaagagctgtgataatcactaatcacttgaccccctgtgctgaaagctgattcagatgagactgaggtgatgggaatagtaagaatatccttggccaactttgccacaattggatactttaattcattcatcctccaccactgaagtagattgaaactttttgcaggaatatcctcaacaggatcatctaagtacctctttaaatctgacttaggaagactagcagcattctttgatttcatatactcatgaaattggctagcagcaaagaaatgactactagtagtgcccagagatgtactagtagattgagtggtggcatcattttcctttgatgtgctctggagttcactttcatatgatgcatgcaaagatttcaatgtggattccacatttgcaagtttcttaggaagtacagtttcttcatacaaagcagggaatgtgtagttaatcatacccatcttaaaccttgggtctagaaccaaagcaactgcaaacaaagtattgcattctgggccccagtacttctcaaatttttcaagcattgcatttgccatttctttaagaattgggtctttggacttcatgtcacgccccgagctagtcccgactggaattagcccgtgacgctccaaattaacctgttaatcgataccagtcccaggaaaacagtgctggtatcacagggagacagaatatcacagcaacagaggtctctttattatagagtagaggtacagtcatgttgggctgcggacagatcccgagctcacaactgcattacaaaagggaaacggaagccagggcttggaccaaacatcacaggcgcgacttgggaattaggccgaaaccctaaaactcatcgaagccggcttactcctggaagaactcttcatcagcaggatccgcttcatcttcttcagcaactggggggttatttatatagagcaagggtgagtacaggagtactcagcaagccaggggaaataagtgtttaatgcaggcttcaaggaaaggctgttgttttcgtaattgattttatttgaactcttttctgaaacaactaagtgagtgcttctcaaacgacacggatgagacagtgcgtcttgtccgaacggagtatgtgcaatgtatcagtctttagattttgaaacaaggttggcacccggccaacagcttttcaacagccacccgggccaacaacttttcaaacggccacccgggcctaaatcctttttccttcagaccaaaaatccaataatcttagaaattcaatatcttcccaaccgtaaatccgattgactccgttcaacttccaaaattccccaaatctcgagatctacctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcaaaatattatgcattgataggatcgcacttaatcggttgtcccgtctgcaaggcagattggcggacctgcctaatttgttgcatttgatccttcctttgttaattgttataccatgtccccttgtaaccacccagttgcgcctcgatattcgtgcactctgtgcgagtatcgacggtcgccttcaaacttaaaatctgaaaaacaacttgggtaaaacttgggttttacaaaagacttggaaaacccgacacctgggtcggtgcttgcgaactaaatgaatttctaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaggggagccatgatgccgagagacatgtggattcgccggggtggtgtcggagaggacccccctgggcttcctggcacagtatggtctgggacctagcctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgtagaggttaactaactgttcgaacagccgtgcccacggtcatgggcggatgtgaggtgattcttagcgtagttttgtttgactactgcttgtgaaattgctgttgtgaaaaggggtttgatgtttgaaaaatctgtagctgacgggatcagctaggcccgggtggccgtttgaaagtggttggcccgggtggccgtttgaaaagttgttggcccgggtggccgttgaaaagctgttggccgggtgccaaccttgtttcaaaatctaaagactgatacattgcacatactccgttcggacaagacgcactgtctcatccgtgtcgtttgagaagcactcacttagttgtttcagaaaagagttcaaataaaatcaattacgaaaacaacagcctttccttgaagcctgcattaaacacttatttcccctggcttgctgagtactcctgtactcacctttgctctatataaataacccccccagttgctgaagaagatgaagcggatcctgctgatgaagagttcttccaggagcaagccggcttcgatgagttttagggtttcgacctagttcccaagtcgcgcctatgatgtttggtccaagccctggcttccgtttcccttttgtaatgcagttgtgagctcgggatctgtccgcagcccaacatgactgtacttctactctataataaagagacctctgttgctgtgatattctgtctctctatgataccagcactgttttcctgggactggtatcgattaacaggttaatttggagcgtcacgggctaattccagtcaggactagctcggggcgtgacacttcaacaactgacctagtactctcttaatatcgacaatgtgagaataaaaaaggttagatgttgggtaggttgaacctgagaactcctcagtggctgcatgaatgacagaaagggcatcattgacttcacaatatagattccattcctctggtgttggcagccacctatagtttgcatctcctgcagcatatacatccaaggcagacctataaaaaaatgcagattgcagcattttgaaggttgagccccaccttgtgcaggaatcaatagccaaacccatgtcacttttaaggttgagagaatcaatatcagcactgaacttgtatgctcgattgtttgatttcttgatgtacttgatagtgtccctaactttgtcaattatatgcttaatcacagccagaccatcttggacaattaagttcagaatgtgagcacaacatcggatatgaaggaattttccataaaaccaaagtgaaccacgttttgtaaacttggcaagcaacaggttagcagcactatcattacttgaggcattgtcaaatgtgatgctagctatcttgtcctcaattctccatgaagcaagacaatcagaaatggcattagcaataactacaccagtatgtggaggctccaactcaagaaagttaataacacgacaatgcattgaccaatcagcatctatgtagtgggcaacaaggctcatgtagcaaattgtttggttagaggtccaaagatcacatgtgaggcttatctttctaacatctttgaaagtcctcttcagtttttctttttcagattcataaagcctcatacaatcacttctaatggtatttctagagacctttttgtaagaagggtttagcctctttagcaaaacattaaaccatgtatactccacaaggtaaaatggcaactcatggacaatgatcattttgcaaataagctcacgtatctttgtaggatcataataaccagggacagaaacacaaggagcatcaagatcaacatcaccttcatcaaggctagggaaattgatattctgttgttttatggatttttgttgaagcttgtgataatcacactgctctaaatgcctccgccaatgtgttgtagtgccactactattcttggtgagcagagtttcacatgccttacatttgaccttattttccatttctcctttcttcttctttgatggcacagtgcattcttcaaagaaatcccacaatggagatttctttttcctggtggctttagttgggtttccctcttggccctcttctccccttacttcacctggtactagctgctgattcggttgtgcttctgttgctgctatgccatccctattgctcggtgactcgatctctatagatagctgtctttgcaggtttacagacatctacaaaaaataaaaataccaactgctatcaatatatattctgcacaaggtaaggaatcaaacaagtacaacaagaaaagcattgccatcaatttaccttggcaaatggcaaacacacggtgttctgcaaccttcagtctttcttcagaagaggaggacagcaagataagtactactctatgtctccacctagtccataaaattcaatgtaaatcaataacatccatcaagcaactaaacactacacaattaatacatgtagggccctagatacatgtgggtgcaaaagaaataaaaatgtaaaacaaagaaagaagaggaaacttactcagatccgagtcgtcggttcgtcactcacggcggaggcggtgggctgctgctgtcctccatggggttcttcctggacaggagaggcgaaggatggacggtgcttggctagatccacagcagtggtcagtggagcactagagcagcctaggattgtagatctagaagagaaatgtttcgaggaagagagcaaatgagctagggtttggatacgggatggggatataagggaaataaatggttaggtgatggactgctgttggtggtaggattttggaattggagtgcgggagaaattgggataggtagcgggagtgaaaatttcaagcttctgccgaatagctcgagctcggctcggtagagctcgcgagcttcgagacaagctcgagctcggctcgaatccttgccgagtcgaactcgagctgagcttgcgacgagccgagctcgagctgctcgcgagctccgagcttttttgacagccctaaccgtcgtcgatgaatcgccgccacaaccatcttcgagctcccgacggttggccgatttgggcctgccgctgatgacctccacccatccctgatctagccgccatcgagtcgctgatccaggattcgctacatgcccctcctcccgccgccatctagggttctttctctcgcttcagcccagcgcttcctcctctctcgcgaaacagcgaagaaacagatgccgcgtgcgtgaagccgtgaatcggtatacaacgcgaaagtacaaaactaccctccataccacggtaccgcgtcaatgggaggtgcggtaccatgaggtaccgacgccttttggaccgttggatgatctcgaatcaacagtcacgatttggtactgcagttgctcaaggacagtaaaaactcggcttcagatgttcatttccagacttccagtgaactatccttactgcttacagttaaaacgcagttaaagcatatgtatctgactaaaaaatgataacgggcaagaacaagcattcattgtagcagatttgatagcacaaaaatagggcatacacataatgtcttacaagccaagtttcagaattagcccccacaaaggtgccttttactcctttcgtgcatccttgacagtatgttttcttttccacgtagcagagacagcactaggctattcttttccctctaggatttttatgatattgaatgtgagggaatccaagttcgctctagttgatcacttgctcgtgagatactgagatctagagacgaagattggagagagggccggcttggctgcagaagcaagcaagaatcctacgtgccacttggagtacgctagatcttccagtcctactaacagtagctcctcaacagtctgcaggccctagctgcaccaaccaaaaacttcaagaattcaggatgcatatatccatccatccatctgtgcgttcgtgtgtatgacggttagcagcgaccactctgtgctagctagctccatggaggagagggacttagctctcattgatgcgcacacacctccgtgcgcatggagtagtatagtagtaccacactgctccataatacacatgcccgatcgatcgtcggcagcggcagcagggcctcgatcgcgagctagctgttggtatttattacacacctcggcctttttgggacagggatactggagaaagtaaacgattacattcaactcacggggatgtgtacaacccgatctattgatctagatattatgttcgatcttgtacgttctagcttgccgaaaaaccaaaccaaaacttgcatcaggtctctctctaccgggtataagcgtgtggtaaaggtaaaaagaacattgtcttcttccacgcctcagttgcaccatgcatgcattatgcgtaaatccagcctctaattaagccattggtgaacccatggagccatcgagcccgtacgactagcgttattctgagcctcttcttacggaaaacctcctcctccagagcgcacacgaacgacgccgcgcactgtgcacgcaagtgcgaaacggatggtcgttaaactgcccgcggcgcgcgctctgttcaggggcgtgggattcaccagacagccaccagtggcgccggtgcgtaagctagaccacccaatcaacagcgactccgtagtcaatcgtacaggctacttgcccccttcgcgcgcgcggtgcgcggaacagtcatagccacagcggttaccatcgcccgaatttaccgtcgagtcgctttgacccgtgcaacttaaccggtttaccattggtgagaacaactgagagaaggataagatcgtagagcaaaggttgctattgctactacaccattcagtagtgccgcgagttttgggtggattagccggtcgccttttgagtgccagtgggagaccggtccaaactccaaaggcgaggaaattctagccggggatgggacggctatggcgtgaaccatggtgcagaaggactgcatgccgtggcttagcttacctggaagggttctcttcgactcacgaaagtcttgcgtgctagtgaccccatcgcgcagcaaaagtgaaggggaaaaaaagaaaagagagcgctaaaaacacttgtggtacttttcagcgattctttcctgagctgccactctccccgtaaaaagaaaagaggtgaacgaatgcttcttgtacgaattccacttttttgctaagataatttaggtgcggcttaacagcggcaagaaaagtacaagcagagagcgcgagaaggagggagggagatcacctgcctcgtctaaaaaaagcgcaagggtaagcgccacctgatcgcagccgtccaaccatgatccatcacgtgtcgccacgtgagacagcaaatgagcaaaccccactgccttcgtccaggcgcgccccgcgctacggccacacggacacggggggacagcacaaggtcgggccaacgtatcaataccttgtcccgtcctgctgctcggtgtggaccaaccgattacgccgggagatccgcctcgggatgcgtgcccacacagcttccacaggggagagaagtacgatggccagactcattaaccgagaattaacccctgattaactgcgttaattgtcgtgctaatcccaccctgggtcagtaacgcccacaccgcgcaaagtcagtggccactgacacgccgatgcaatccaggtgggcccagcgaggagaaaagaacggtgccacgtggacgcgagacgtgggccatgcttataactacctgcccaccaaacgaggagagcagctcctgcaaaatcgagctccagttttgctgccgaaaccacacaaactgtccatcgagatccaactaattctcccaagcatttttaaacaactaaaagttctacatttttttttctcagtgctgcatgcttagtttaggaacagcaattctgttgcattagacagacgatttgttaggatccagcgcatatgtttgcgccggacaagtggggcccatcgcacagtgagaggaatgaacggagcagcagccaagcaagagacggacaaaatggactaggcaaagtacgaggctttcttttctgctttgctcctagcgtgagaagggaaggggggacgccgtcacggcggcatatgcagcagccaaaccgggcaggcaggtggtcgtggtggtgggcagtggaagcagggaggagagaaagcaggagcagaatgccgctgttgctgcaccctgcatgtggatgcaaccatgaacacactagggactactaggctgatcctgcattggtactgccattttgttgcttttcttttctactacactgcttactatctcgcctattgtttggccaaatcccgtaccatggacaattggaacaagaacagctggagactgcaacagaaagcaacagttcagctataatttttctcctgtggctctctctgtttttcggtggaatattttcatgctagattatgatcaagaagtaagcaagatgctaagctctgctagttgccccaatgtacactgttcgggtagcttgaaacaaacaaaaagacagaacagaatggaggacagcatcaagcaatttttgtagctgaatgaacaaaacaactgagaaaaaaaaaactaccaaagcaaagatgtctcctttttatgatattttctttaccttttcggctgcctggttaagcagctctttctctcgaatccatagctctaaccatcttctttggaatcaaccgaaaggagagagagcactgaacagccagtatgctcgctctctcatgctctgcttgctttcaagaacctggcttcgaggagaggaaaggatctgaaacggcggagagctccacgtcgtcgaacggcgccgggaggttcagatcaatgaagccgttgcttttaatcatggctggaatatcgtcgcccgatgcggccgccgccgcggctgagcacagctgggaccgcttgtggccgcccagagcttggccggacgcgaacacgcggaagcagtaggggcactcgtgcggatgcggcttcgcgccctcctcctcgccgccgtcgcactccggcaatggctggagaggcgtagcgggagaaggaggagggttaggcggaggcgcgcagcagccgcccctgccgccgcgcatgtggctagcgcgatggccgccgagggcctggtacgatcggaacaccttcttgcatgcggggcactggaaccgcgtccgcttctgcgcggccgctgcggccggagccggaggtgcgtcgccaccgtcgctcccgtcgtcgtagcctgcgccgcggagacggtagggcggcggcggcggcggcgtggctggccaggtgtcgcgggagagcatcatgagggacagcgctacgtcctcctccgacgtggcgtcggacaccgagctcacctgctcgacatcgcccgatccggtgttcgcgcgcttgccgtgaggcggcgaggagtagtactccgtctcgctctcgcgatccgagaagtcggactcggcgaggcggaccctccgcttgggcttctcccgcagcacgtatccctggatgggcctcttggcatcaccgccgccgtcgtcgtcgccgaccgcgacggatgtggacgcggaggacgtcgaggagatctgcgacctcgaggcggcgactgagtgggagcgcatgtggccggcgagggcgcgggggttgccgaagcggcggtagcagagcttgcatgtgttcttggccatggcgagagcttggatagagcttgatgaggcacagagcttaggagagctaaaaatacgagctttcagaggaaacggagagagatgaaagcgctgcttccgtggggagttagaatagagcggaactgccagcttcctctcgtttattgttttccttttatttcccccctttttttctgggtgactcattgtattcttgactggttgtatttgcagcatttcttttactgctcgtgtagaaccaagcccaaccgtatggaagatttcggactgatgcttgtagttaattgttagtacggatgaaaggaatgagcctattgttcttttcgatgaaatgagtctaatgttttgccatgtaccatcatgtggtccagtgcgtagtttttagcagtagcggttgtattgctgagatggtggctattttggtgatcagattagtcctaattaaaaatctttatttgctaccatacagaaatggcttttgcatacgtgccatatggctttctatgcgagggaatgtactgtgggatgctgctgtactcaatgcaatagctctgaaaattacccgccttggaagatgccactacacttcatggctgtcaaattgcccttttgatggatctccttaatatagctttgccttgttaaaccaccatttttatatcctgatcatccaaaggccacaccttggtgcagctcaggcgttcagtaagttgggtgagatatgtctgaatagagggctcagaatgagatgggaacaaagagtaggtgacaagaaggttgggaagatgggtagaccagtgagaacaaagcgaacacagggtggagtgtggcttggggaatcagtgatagtaataagtggcagattaatcagccggggtctaaatcacaagagtcacttacaatgcaccactgtttttatacctttctcattaaattaagatctgggtatggtgggaacaaaagatctcgatacggtttaggcaacgattaatcccttattagcagcacgttagttgcttacccacaaagcctgaccgagtgcccggccagcatgcatgcatctcatcagcggatctctcagaattatgcccatccaaatccagcctcatcttgttcttaatctccctggaattactcctggcctccccttcacattatcttcctgccaattttaaccaccaggcatgcatatgcaccagctgctgcatgctcgttgagagcttagcacttagcaggcaagcaagcaaagcatctgcgagagctagcctttccaactaaccgctttagggatctctctggttatgatgggtacgcattaggtgcgcccccgatttatgtacatgatggccattcaccccgaataaacacctaccagctagcgagctagccactcaggatcatatttagtactaccatcaagtagcgaccaagtatccagcatcattgttgatcaagcatttgttatgcttgctacggctgtcatgttagtagcatgctactgtgctgccgatgcatggtgttcattgtgtttgtgtgtttctgtgtgtttctgtgtgtgtgcgtgtttggacttcggtaggtaatttccaaatttccatttcactttgtagctggtactgtcagtactgtactagtacagcgtacagatacggtacaagtcaagggggatcggctggctggcttcaattccgttctgaacactaggcagcgtggcaggcgatgagatcataggcgtgtgttggtttcttgcttcgctcctcctctcgtatactctactggagtgtgaagtttttccccctatctgtcaccttcttttttcttttctgtcatcttggtgctgtccttgttctgctcttgatccctatctccaacctttgggagtattcattggaatcatcatcccgaattcatgatatgatatcgaagtgattagctctgaatacttacaaaacatgcagtgttctccttttcctttccttgggcctgcaggtgaagcagatttgtattctcctgtaaaatgcagtggcttggcaatcagtggaagcaaagggttagtgtcttcctatgttactattccacaatggtgtgtgccacgatgtctttttttctttcatggagaaaacgaaaatcgaaggaacgagtacaaatccgcgattcggtccagtactccggtcattgtcctaccctgtgaacttcacttgcagtcgcgtcgaggatccagaggaccaaagctttccgtgcaacggaactgtttagatggtactccagtccaggaacaagacgcgcgatgcgatggcgatgaaaaccacacgttgctctccggcgcgcatggccgtcttgtcctctcgcgctttcaaaacgagcgtgcgttcgtgcgtgcagcggagcggagcggggtaaagaacggaagccgcgagggctacgagagggctagcgtgcagtaatgtccactcgcacaactccttggattcagcaaggctggatggacgggagcgcgtcaggcgaggacgaacgggattgggtcagaaaggattacggaagaagtcagcgtcgcgtcccggtggctgcctgcctcgcgctcgaattggagtggagcgatccgagtcaagcgccgaacgaagcgaagcccccgtcgtttccgccgtcgtcgtctcgctcggcagcctcgcatcgcatgcgccggcgctcgccagctgacgagagccgcgtgcgccatcaagcttaattgtgagcagctagctggctgttcgacacgtaaaccgatgaacgaagcgaagaagaagctaccgaatgctgatgcatttgctgtagacctgtagtgcatcgtgtagaaaacgaaaaaggatcaaacatataggccgtgtttagttgtaatttttttttcaaaattccaactttttcatcacatcaaaactttcctacacacacaaaattccaatttttccgtcacatcattccaatttcaaccaaacttttagttttggtgtgaaaacacagccatagctttgttgtcccctttaatgccgggttggttcggaaagtttcgttaaagagggtttatgatattcctacatgtttacttggtctttttgagacggatttgctacatttatgtcgccataaattttcgttgattacagtcggtatacatgcctattggtcacacagccgcacaggcttcccactgcatgtgcttccatgagagagaagattattttcacacatatatcgcgtgatgatagacgattacatactaattacactataattacatactattttatgacttacatatacaattttgaaacttacattgtaaatacactaaaattacatatgtaattttgggacttacatatgtaattttgagacttacattataaatacactaaaattacatatgtaatttaagaacttacgatgtaaatacatatcgactattttttggtgaaaaatatggcgtcataaatatagctactgatataagaacggtaaatatattcggtagtttgacgtgagggaaagtaaaactaggtgatgtgaaagacctttttacacatcgacggataaattcgttgtagtctagctggttaggatactcggctctcacccgagagacccgggttcgagtcccggcaacggaaatttttgattttctattttctggtcatgcaggcatacagcttcaaaaattcatatcttaaataacgatttcagggtgcagcatccaggctgccattggcccacgtggcactctacaaaattttccagggctactctgaaattatgccacgtgtcctcccgtatacataattaaactgcattcttctgtccacttaactctcaggaaaagtcaggagtcaataaatcaccttgcctaacccttgtgaagaagttggatatgtaacccttccgaagtctctagaaaaattaagatagaagttggatatgtaacccttccgaagtctctagaaaaattaaaatataacatggttcttcacgtgtatttatacgcacaaactatgtcagtactcacatagtcacatattgatttccaagacctttgatgctttaactttttaagactggttttaacttttaatacaaagagtaatcttttaatacaaagactggctttggatattaagctgacaattagagtcattagcctaaaaaattatgccttacataaatttcgtaattttcctataggttaacaaattctgtaaattatactaattcaaaagacacatcttccaaagtatttgtccaaaggtacttatagacgcttaaacaagttaatctttcattagcaaaacttttttcaagttgaattataatatacagcagagaagtacggctatctaaatgtggtagagaagaattaattagccatgcatacactaattaaccatattactctatttgttgataatattgctctaactatgttcgattgtacctatgattagcttgtattatttttaagatggagggagtatcgtatatgagactacagagaggagtaggtgacactggtatgttagcagaagaaatttctcttagagagacttgtcaaaaaatatatcctttagttttcggtccactaatgatctaatcttaccaattaataataggtgttaattactctgtctaatggaagagaaaaacaaaggtttgaaagcaaataggcaagtactatacataatttttatacataattttgctttatgtattaattcttttacaacgcttaaatctttacataaatatggttattactataagttaatcgttcctcagtcttttcaaaattcattaaataggttcttgtaaatctactgcatttgaaactctagacaacaacaacaataatttttctaaatgagtaaatatatccagctataagttggtgtgccgatggtgcgccaattttctaggatatggaagcagggaattgggaaaggatagggaggtgagatttgtatatttgtttctaatttttagggtatttagtgtaatgttggactattctataaatttgaaaaacataagaactaaagtaagaaatatgagggcccggcatgaaaaatcaagaatatctctagagttactttgcattataggataaacaaatttgagatatgctaactcatcctacgtgatactttgaggagggtcttgcactacgaacgccctaagagaggtggtatagctatagttttccgaattatacatatgaggctacgaattgtgacatctaaatggtgtactactcgcaatagaagatatggaggcgtgtccctctccattcacatgtggctcttcaaatagtgtgtgaactatgtggtcctctcgtagtcatgagtcatgactattttcgactactgagaagataagcaaatatttggaaaaaacagagagcgcggtagagatacaaatgataagatttttaaccatcgaggatttaataatgtaaaagtaaaataaataaagagaatttagaatgttatacttaggctgaaagaaaataaaaatatgggaagaagaaaaagaaaaaatcatttcccttttttttcataaccagttaaaaaaacaattccaactgttagtgctattataagaaacctctagttattatgagtaaattccctgtgtacccctgaaaactcactcaatccctttcatacccctgaaatttacccaatcccttctatacccctgaaaattcaatttgatcccttccatgcccctaccgttacattttccatcatttcactgttacgtttggttgcaaatatcctttttgccctagatgctttaggtttaaatataagcttaaaaaacaattgaaaaaattttgtttgggtgcacagtatgtgcattttataagactaatgaaactaaataattagtgcagaaaattttgacataaattttgaaaataaaataaatgtaataaattaaaatttttatttcaaattttaataggacaatggatttttttatcgggagcattcataaaaaaaatgttgtgaacattggtagtcctatctttatatgaatgctcctcatttttatgactttttttaaaaaaataaatacgtgttttttatttcatgatctaaaaatatttttgggataaataatgcatcgcacaacaaactcataactataatagtctcatgcgagaagcttttatatttttaataatgtaattcatgaatttctttgttcatccaagggtaaaatggtcatttttatggaaaatagacggtcaactaacggtcaactgatgggaggggtatgcaagggatcaaaatcaaattttgggggtatacaaggaagtaagcaaaattcaggggtatagaagagattaggtaaaatttcaggggtatataagggattttctcaattagtatagtcccaaacaattttcatataaggcttcaccttttagccttatcttattaataataattaaatcgaccatcaaccaacatatatttgacatcattttttcctctgtaatttaaatatttacaaatataatgtttactcagacttgtaggcataaaattaaaaactgctaaaatatctctttaaaattttacgcttttacaaataacaataaacagtatatgtagtattaatatggtttgctatatggatggtgtgctaacggcgcaccaattttctagtatttacctcttttgtgaaaaaaatactcaatacttgcttctcttgagaagaaacaagagaagcacctatttctttaaaattttctggtcatacaacttaacagattaaattcatatattacctcttttgtgaaaaatactcaatacttgcttctctcgagaagaaacaagagaaacaactataactttaaaattttctggtcatacaacttaacagattaatacattatcttgtgtgaaaaaacaagagaagcaactatttctttaaaaattttctggtcatacaacttaacagattaatacattacctaaattttctggtcatacaacttaacagattaatgcattacctcttgtgaaaaaacaagagaagcaactattttttaaaaaaatttctggtcacgcagcttgacagattaatacattacctcttgtgaaaaaatactcactacttgcttctcttcagaagaaaaaaaaatcctacaagtctactgcctcttcccaaattcatatgttacctctttgtaaaacatactcactatcttgagaagaaaaaaaaacctacaagtctaaaagaaaagaaaaagtcacaaaaaagaaggcaaatacttatatgctcatgcgaacaacatatatgcaattgcaaacgcatggaaataatgtaacagtatatatgtatgtactgatcaattcgcagatcaatcactccttgtcgttatcatcagcacccccgcgagacgaggagccaatgccgacttgcagccacggtgtcgtctcccctgccatgctcacgtccttgagatcgctaagcctcgctctcttgacggtggtgctgtccgcctcgtcctctgctgcggcggtgcttaacccgaccgcgtcgttggcgttctggctgccggttgtcgcggtagccttgttccgttggctgggtatcgccggcgacgatgggatgtataccggtggtggcgcgtcgagatgaaacgagctgccgccgaccttcggacggactgttgcggccgaggccagcagtggcgggttcgccgcgatgctgaggtcgagagcgggctccggtgcgtccaacattggccggaacgagagcgggacaaggtcgtcggctaggggtgggactgaggcggtgtgatccgccgaacttgacgtcagccagtggcaccgtttgtggcctccaagcgcctgcccggaggtgaacagtcgatggcagaccgagcattcgtgcatcttgcccttcttcttcaacggtgcagcggcgagcgcggcgaccggcggttctatgggcacgatggccatcgacagttctgccgcggcatcgctcgtgccggcgtttccatcaccgtcgatgcttgcgtgcacgttcctcctggcatcagaagtggccttggcgggattgtcctcgctccgatcagcgacctctgcatggtgtgatggctcagccacctctgcggcgttgctctccagcttggcagcgaagcagcccttcaccttcttgtggctggcacggtgcccgccgagagcttggtgagaagagaaaaccttcttgcacgccttgcactcgaacatgcctcgaggcacggtcgagacatactgtggcgccggcgccggcgggggaagcgccatcactgtatccagtacatacgtcgtcggctccatgaacgtgatcagtctcttatgttccttactcgcggaagaagatgaccgttgttctgcttcagtgacgcctgcctgatctaccttggacgacgagagcatgaccaggcaattggccaggtcctcctcctcgccggcagcgcacgctgagggtgtcggtgacaaatcgactcctgtgcccttgcagcgacgcgagcgcttccctttcaaccaaccggcggccggtgcagaatcctcttcgccgtcggcctcgggcgaaggcgaccacggttgcagcgagtgatccacgtcgtcctcgtcgtcgtcgtcctcgccggagctgcacttgccgtgctcgaggaaatgctcccacgacgtgaactccttcccgcagttcttgcacacctggcggctcctcgtgacccggttaggattggtgcggagctcgtagacgtgtgtcgctgcccctgacgacgacgggccgcccgcgttccaaggatcatctgccccgccgcgcgcacgccgcacggcctcatcgccgagcgaatcgtcgtcgtcgtcgtcgtcatcatcggcacccaacccatcgccgtcgccgacgccgtgggccctcatgtgcccgcctagggcgcttccgcacgtgaaccccttgttgcagactctgcagaagtgcttgtaccccgacgcctgcgccgccgtcggcggcggtgcccgaggtgatgacggcgacggctgcatctggccatgatgctcaagaagatgcaatcgttgtatggaaaatcacaatgtcaacatgtctcgacgaaaaatcaaatcaactttcggtgcgagacatatatatatgtgataatcgactaagtaccaaagacggtgaagattcacacatgcatgcgcttggttcgccgcggcggaatcgaattcgacctggagatgggagcgccgatcaagtgcgcgcctccgtccggtgtcacgaactcacgatcgcagcaatgccgcgagttctcctgaacctgaaggtccaaaacagccatccaaatttaaaaacttcgtcactactgcacgtccatagacatatatagttctcataggcgtgtttcgcggtgcatcggccgctttagctagtgacgtttgacaacgcctaggagtgacacgtgccggtgataataagctacatatctctgaatctgaaagtcaagggaccagcccacgaatcatgttcgtccaacggatgccatttgacatatatgtaggattggagttgttagttttttaacaacagcgcacgtgcactagtgtaccttggggctccttcggattgcagaatctaaaattaattttgttaaatttaacattgaatgtattttgataatattaatcaaatgacttataatatggaaaggagggagtagcaaattttggtcgtaattttaaaaatgataatcatgtaagtatcattcgcgtatgcacatctgaatagcaaatccgtctgaatatgcgacggctgctatactctagatcgcacatttttttagatgagattgtacactcttgtttcggaagtttccagagagcgccgtatgttggattgcaataagtggcagcgatccaaattcttacgattaccaccctccccttgtttggcgattctaaaataaggccttcccggggaattttcggctcctttcgccatcctgcgtcaacctgctgatcaatcgaccgggcaagtaacgcaccgccaggtccgtcaacacgagttgggctgtaactggatccccacacacgtgcccaactacatgggccggaacgggattcccatctgccgcaattagttgggccgggactgtattcacacgaacgcgcaacatgaattacagaggaataagttcactttgagtccctcagtcgccgagtccaaaattagtcccttgagcgcaaaactgagtagaacgcatccccaacatataaaaccaatacaaacgagatccctcggtggtattgtcctcagttttaactgacgtgacacatacgtggctcctttgacaaggtctttatcccacgtaacattgacgtggcgcttatgtggcaatttgattctgtaaaaattaaaagacgtgggacccacatgtcagctacacacaagataataaaaaaaaagttgaggcccatgtgaccccacgtgttatcgtcactcctccctcttctccctatcccctctctccttcccctacactgcaaggagaagggcatagcggtagtgggtggcgcagaggagctgaagatgaccaccgttggcaacgcccacaaagcctcatccatatttccgcggcgtgcactgtgctcgggaacagctctgactagtacacatgcgccaacttcatttccaccaactccgactcctcctgtggctcctaggccagccgcgtgagccgccacacctccttccctccaaaaccgcgtcgcacctcaacttccaccatgccatgagcacatgccccaccaccgccacaattaccacgatcaccaccacggagtccgcggacaacgacaactcaaccgcctcccctctcctctcacccttctcccctcctcctcctctcgtctcctccctgccacatagatctcaccgccccacccaacctcttgcacccaccagatccgcgcgccaatacatccactccccctcactatagccaacctgtcgaaatctagggctcccaaattttcccctctctcctcttctctttcctacccatgttttgtttggtctttggaagtaacagagagacaacaaatgaagaagaaaaccggcggaatccacttctagtctacgcacttgggggtcataatgcggaagagcaccacgagcaccaggagcgtggtggccttggaggcacggtcgaagagggaaggcaccggtgaggtcgccgcccaccatcggttagctccgtccgccacctgcctcgcttgcctgctccgccattctcctcgctgcccacccccacccccacccccgtccgccaccttggaagagatgatgaagagaggggagatggaagaagggaggagtgaggatgagtaagaatagagagaggagagagaggggagagggcaaaagggtggaccggaggagcgcggatgacatttggggcccacatgggccccatcatttttaattgttttgtggtgtaactaacatgtgggctcatgcttttttttattacccatattaaattgtcacgtaagcatcatgccaacgtcacgtgagacgtagtagtcaaatgaaccatgtaggcgtcacgtcagtcgaagccggggatagtatcactgagggatctcgtttgtactggttttgtaagttggatgatgcattgtacctgattttatggtcaagggacgaattttgaaaattaagggaccaacttattccaatcacagattcacagccgacgtgcctccgaatgtgggccgagacagcgcagctgatcggccattccattcgtcccgctgcctcgattctattctttgccgtcgccgtcgcacgctcatcctattcccccacaccgactccccgtcagctgcccagagctactcgcctgaaatgttcctcatgtactccacgtagtttcctgcatctgggcaatttcatctcgtcagatatagtgtctggtcactggtgccctccaagaacgggcaaagctttgtcatcgctctagtctgtgggtaaattatttccgtcacaagatgctgccatggaatgctgacaaggacctcagtcctctcctcactcagccatggtccatggaccaggggcatccgcgttgccagaaatcagatcctgcacctgcacagaaccctttcccgtaccgtatgggccgccgcgtacgtacgctgccgtgggggcggccgagttgctgcagcttgcaagctgtgctgcgtcgagtaattcattaaaaataactcttattatccgaaaagtttttaatgtgcaccgacaacgcattcgcatatcgcaacagagaaaattttgcgtgctatgttcgcccattggcatggaccatgagttaaggtaaagtgttaattggtagtcatatttggtccctactggagttgatttgatgtaatctcgctaccttgtcgctatcgattccgttagcgttttaaagacttgatttgccggaaagcaaagttgatcggtcgtgacaacatgaaagaaaatcaattttacttgtccccgcatcagttcttttaccaatcgaggtagagaggaacaattgcattgcacaattcttactcctatcctaagtacacgagcaaaccataactatttacatccttgatctttctgggcactcgagtggcagctgccggcgatcaaatcgtgcggctgctgtgccggccgcctgtggcgggcaactggcagatcacgcgcgaatggcggctccggagctgacgtctactgggctgccgccgacgccgcttgcctctgctgcgcctgcgcctcgccggagcagacgagggccttcttgaggcacctctccacctggtacccgccgccgtagctcacctccctctccaggtgccggcagtagctctggaacacgctgacgctcacgttgagcctgaactgcatcaggaagaggaagtccagctccagcgagctcagttccgcggcggtcagcccgcccaccgcggcgaagtacgagttcttgtagttccggtcctcgacgaacttggaggcgacgaggatggctgtggtgagcagccgctgggcgttggccgacacgacgcgcacgccgtcgccgcggcgaagccggtccaggtacgcgtacgccacgacgtacacctgcggcgagacgttcgcgtaccgggagaaccgctccaggaacgcgtgaaggctcatgtccagcaccgtgccgctgtcgaaggcgcgcgccctcctcgcggcctcgccgtccgccgccgccgcctggtccctctcgttccgggcgatgtgccgctccagcagcgacgcgaggaccgacacgaccaccggcgtcgacagcgccgtcgtgccgtcgtcgccgcacgggagcgcgtacacatccgacgctaactcagtggacgccatctcctgaagaattcaatggcaaaagcttggttcttcacaaaacctatgctacacaagtacacagagaactcttgcaaatgcagacactttatacaccagagggaggcaagcgtgggggcaaaaagaagctattaacaatggcggaactgaacagctgaaggcgacacgaggaaggagcaaagaaacaaaagatatcggcataaaaaaactcagcacgtacacgcaaactggagctaaaacaaatcgagacacggagatgaagccttcaggcaccttccattgaggcccctgacccgatcacccgagcttatttatgatcaagcggacgacaaatgcatccaggggcagatctgattgatggctggtactgcactactgcggttgggggcggcatccgtgatcgacgaggctggatttatgagggaaaaacaagcgcgagtggcgaattatcgcgtcggtgcccggcgaacccgtacacatttaactatgcgagacttttcccgcgtacgtgctacctgctgttcaggtacggcgtcttgtgtcacggcgagacgcgtggcttgtgggcaagtgaagaacagatgcctctgatctttttagtcttgccttgccggttgataagctagtttatgatggtaatgggaacttctgttaagacgtcgaagcgaccgatggatgcaggagacgacaatggccgcggcgttgtaacaaccggttcttggagttgctggagaggagtggccctttctgccgacagatttgcactattttagtaggttggatgatcagtgggaatactgttcttgggtactcataggacagcggcatcgaggtgttgacatgaagatccagagaggatataaaaatggatctgctgatagtttttcttcatcatcagtactacttgcagaatgatgaggttaggttgcaataagctgcttcatcgaaaataattaaagttgccaaaggttaatttatttcatttgtgaggatcattttttggaaagagatgtctggttggtatatgcacgcacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 32046 - DNA, 1362 bp, Oryza sativa
atagatactttataaacctatcactaagaagcgggctcactgaaaaccaaactgttcgtatttctttaaaacgctgctgccctagccgggggtctgtctatagaagaagggaatccagaggaagaagcagctccccgaaggaatccttctaactaccacctatctacctcccgcttttgttcggacaaggcgagtttcctaagattcacccaccgcggatacactaagcgttcttcccgttggtaaatctgattcttgcaaatcaacatcagacttagaagcttcatggggtctggtctcgccatttggcaatttaagccaaacaaaatacagtacagaggttataaccaatacacaagcaggcgtgaaccagtcagaaattagaatggagaagtagacacagaagaggaggttgttgggacagtatcgatagccgccttttcacttattgctaggagtgattgtgagagaatacataacataggtgaaagccaaaaggcatatatgaccccccaatggaagtgatttgaaactgacgtttctttagaattcgattaagaataagaacatagaccggcttctagaaaaagagacgtgccctcttctctatctgtagattcaggagcaacatgctggttccttttgtcataatacctaacggctgtgggcagaatgaatgaaaaagcagatgaaagacactatacataccgatagaatgataaatttagaataaagctaggtgacatcacggcatttgagaaccaattgcttcttttgcttttcaccaaccttcatgtacaatcttatttcgtattggagtacagcctatcgtaggcccagcaaaggcaagacggaaagcaagcattaagtgaagaagcaaggtccaaacaaagtagtgaaagattgacattgaaaagcttctccatgtctatatctgtccgatggaccaagttcaaaggaaacggcttctctactgcatcaaaaaaccaatccaagcctgaaaaggagagttgcggttaacgattcctataaattgagaaagaagcatgttcttcatgcccaaaagcggataaagtagatggaacctgttctctaaccttctttttgtagcagatactgcataaagtttacctgccttgtaaggcttttgtaggattaatcaaatttgctttttctcgttctatctcagagtatccattcattcgatcttgctatccgctctcaattgaatcccttctctgttgtcgacaggtgtgtccgcatcaggaccagaatcacggtctagtacctccgtactcgaatacctcctactttattaattaggaagtgaagtagggaacggtttcctattcaaagtacagt

SEQ ID NO: 32047 - DNA, 732 bp, Oryza sativa
taataaagggattaagtttcccagtaacccgcatttaaaatcactaagttgcccaaagccattttgtaaagacgatcctagagctacacagtattattaaccaaggccgtgaacccctcacgaacctgccttaacccaaggcctacgatgattcggaccgaactggcaacccgacctgggttccagctcgtccctagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttattccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagagcgccgagcttaataaatatagtggccggg

SEQ ID NO: 32048 - DNA, 2039 bp, Oryza sativa
tatttacgataatttgattgctgacaacatcacgcttctctttcttattcttatttatataactgtcactttaccgggccggaaaagtgacaccgtcacgtctcagagtcgtatgcctggaacaagaagggtcgtcgtacaatttcggcgattcaaaaaaagaaggaggcgagctccctatccctctttgtctttccacttccctcgttcaggaacaaacacttcgccaaattcttttgagtcccggcccggtttttccccactaaccaattacgttacgaccactgaacaaacttggttgacgaacatggtttatgcgctgctaatctagcggcttgtcgagcatttgacaaactcacaccatccatttcaaatgggatttgtcccgtggacacacgagcaatccaacccgtaggatttccttttcctcttcccattcgaacttctgcgggtttccccgtaataggaagatctgcgagaactcttacccatatcttacaatttcttcggaattgtccgctcatagcacgatggaattgcccgattgtagcccgacgcgctgcttcaatggctcgatatgaaagacgaccagctctacaacttttggtgccatatcttccaaaaccaagttgtgtaccatccggttcgcaacccctactacatctgcatttactatatttactatatttcgtacgtttcggatatagcacgtcccttcttattttgactatatgagatccgcactttgacacctgaaattccgttacgagtggatacttccgcaagagcataatcgattttctggttaaatacattacaagatgtttttccatactttccgcattcagttctagctatttccgcaccccctaatcgaccagaacaacaaatacgtatcccctccaccccttttggcattattaatggaatatccttcactatttgactaaaaatggaacgaaatgagattggattgttccccagttgaaaagagatgtcttgagcaatcagagaagcactttgataaacagatttgatctttaccgactcaattaaggtattagtgtttgttctattagacaaaaaagatcgcattttttgcacttcgttcaaataagagttgtacccgtacggaattatcctctttctcagtatgatctctatcatcatctctattccctttatcaatttgcctatcctacctaggtagatgaatttctctatcaattccattaccttatccttacccatgaggttcctacatttgatccttaattgacctaggagttgttcccgggcatactcaaaaaatgggttattatacaccccaaccccatcccttggaaaaaaaaaggtagcaccgaagaaaggaaagagcgagatggtggtttttgttgttcccgcgaagcgaagatcattcgcttggtgaatgaagtggatcaacctctttttggctcgggccaaacactttttctcgctggtcgagctttctacaaaaaaagcgatgcgagagcgtattctcttatctaagcttcctcccttcgctccccccatcgtagatggttcagccacacccggtgccacgaaatgattgagaactacgacggggtcgaaatgcattttgttctttgtattaaaaaagtattgcatgaccgaataattcaaggaggggcgcacagcggggagggtcctttttagtagatgactcgtcgggccgtcattttctatcaggaaggctatgtcatttacaaccccggcgtatttcggatgcttgaaggccccgctcacccgaagtgatttagaaaaattcttctttctcgatggtgatcggtcatggtatccataacgttgcatctttttcggccaaatcctgatttcgttttgcttctcccggtcgatcgactcgactcttttccctgccccccggcctctcacttcgtttcgttcttcctctgtaccctcgcttgaatgaagacacccgatcggcccgactttcccaaatgcccaccaccggcccttatcctttccgggtcttgatt

SEQ ID NO: 32049 - DNA, 1915 bp, Oryza sativa
tagtatggcgcatgtgtatattctattgatcctgtttaggctgcttaggaaagcagtcaagcaggaatggaaaaaatgtcttctgctgctatcttatctgctaaaatggacaaaatcttctctttttctctatgtcactaatcacagtcggagagacccatgagactttcttttctcccggcaggctctagcgctacggcaatgcttatggctgcaatccaaacagcaatggtcctcgcggatttagtgcacccaatccattaggggttcctgatagtgagattcctctagtcaagtctaaggattgagtatgagggatttcatccagtccattgcggaatgtatggtcacagaatagactcatcccccggcttatagtatgcagcttggaaggccttggattcacacgtctggtgctgccccgtcttctccgcatcaaagagtaaagtatgctgttgaggtggtaaaaaatcgactttgtttgtcactaaacctgcagcattcccgtatattgaagccgctgaagaagctattgagacttccttccagtcactcgaaatttggaatgctaattctgtttctgagggcggagctatgcccaaagatgtctgaagcttcgaagatggtagcaagatttatgctgaacagcccatatcagaaaggcaagggattgggcaagaactagcaaggaatattcgccccagtggaactcccttctgctgatgagagattttggataagagttcataaaaggcgctagccagtttcaaggtcaggaagggaaaggaaagagctgggtttctaacaaacacagaaacgtttcctttttcgtttttcgctttgatttcgatagtaaattgtttgtattcatcgcattgatttgaaaagtttgaactttgatttcaggatggttacgggaaatttcactctcttggctaattgtaccgtcctttcctctaggtattgagatccttcgacaagttgttcttcccccgaagaatcgtcaccaaagacattcttccatggtttttttacatgggggggggctcggttttgtaaaagattatgggtttgtgtcgaattattttattcttcttacccagtccttcggtggaatgatgaacatacaaagctcatgaataggattgacttccctagggcaaattgctttttaatgtttttcgggaattctttcaatcattaggttttatacctgtcggtatcggattcataatcttcgcgtggttcaaactgctcttcttcaaagggatagttcaagggcttgttcattatttcgtcgtctgatgaagaaccttcagtgcttgaagtctcctcatccgtttataatccaaagactggaatgggtttaatcatagccacctgtttttggggtgtgttagcagctaggttttttcggaggaggaaccctggtataatcaggagtattgggtttcttggcgttggatgaagtttcagccacctgtgaggaagagggttcagcttttccactccaaccatttttcaaggttgtcatttcttcctttgaaaagaagtattgggcgtctttatggcttatctcgtgtattccaaagggtctcagacccctagctattcttctttgtttaccattctttacatatttgaagcacgggagaaggaaaaagactttccactgtcctaaactaaggacgggaaggaagaaggcgagcatatcctctaaattgattatcctcaaatcagctcttcctggggtggggtattgtctgtcccgataaatagataattccaggagtaataaataggagtaaagtattgatataattggaattgcagaagcaaataccaatttactaaaaaaagaaaaaaagtatctaatctaaaggggctcattttcttttttaggattaacaaaagg

SEQ ID NO: 32050 - DNA, 1102 bp, Oryza sativa
atagaattcctcccgagaacacacgaaacaaaaatatgaactaggtaaatagaaatggaaaagagatgtttccaattcatcacaaaatctaaagctttttctacatccatatgatctactttagtagattggtattgcccatataatgaaagcagatcttggtccatggagtcccaagaaggttggaactccaacctgtccgatgctttttcggccaaataaatagaaaagtgggaccagcacaatgagcaagctgcgcgaaaaaccgcttctttttccggttccgcaacaacttgggcgaaatggggttctaccgggaaaccatggtcgagttttcgaccttggttactggtcgagccactggataagaatctctggagatctttcctctccacttactcgtaacaggctttccctctgtataagacttcttccgaatggcataattgtcctgtcctattgacacctcgatctttaaagaaaactgactcctccttctcttttaggatttgattgtcgttggtccttttttcactaatgatctcaccatagtagttcgcgcgagggactatcttttctatcgcttgcttttcactctcaagacaacggtcggtctctctatgctataaagcggagcaaagcgcatggcgctgaaagttaagaaagctcaaaaacacacacgaacacgatgcagggcatagcataaatgagaccgctgatcattttgcttgacctttttctatgctttttttgggtgactcaccaactgacccagcagtgatcgatgacagaatggtacgaacaaatcaaagtcgttgaccattataccgtgctatggcacactactagatagattgtatggctccgttggtgactttctgatcacgggtttcatttgaaaaaccccaacgccattcatcttgcgtccgggtctttcatgcaagagtttcatttttggccgctactacgttcgtcggaaaacttcttgatggcaccatcatctcattaccttatttttgcccttcgacttcggctatgaccaatgccccacctagctgaataggcgtaacaaagctacctgaaaaaggcaaggtgcacctta

SEQ ID NO: 32051 - DNA, 978 bp, Oryza sativa
aattccgtttaagaacgaaaaagataaattttgggttgaaccaacaacccgattgtgcggttattctgaatgcagatagaaagtcttcggtcatactggaagctgctcgatcacaaatacctattgcattcttagttgattccacgatcccaggggaatcccataaaagaatcacttatcccatcccagcgaatgatcctatacagttcgtatatctatttcgtcattcggtcacgaaaacagggattctggaacgtaaatctgtgcacaaacccatgcaaacaggcttaaaagcagtggatagcctggttcctataggccgtggtcgacgagaacttataatcgggggcagaaaaacttcaatctgtagcgctacttccagagttaccaaaactcgaagtatctatactgcggctgacagcgaattatttttagctgtcctgcctttcctttcggaaatgccagaacaggtagtttcaactgtggagcccttcctttctacaatcccggaacaggtagttccaacctacattccacaaatgccaaattttataggtgaaactactacagtctacccagctacaaggggaggctggcccgagtaactctacagggggtggggctgccccttcttcttcaatttatctggcttatgcggccgaacacgcatctttcctaaagcaatttctgaggagctttaccggagagtaggggaacaaatcaacttaaagagtcccctggacgaggagaatataaggaatatagtctacaagatcatgaatgatgattttgaactcttcttcgatcccatagaagatttgaaggactggctacaattcattaaggcgaatccccttagttttcaggatcttatacaattttggatggcattagccaaatagtcgatggggatgggggatccaccagtaaaggatttcaaagaaagaatggttgggatgggggtatcatagatagggt

SEQ ID NO: 32052 - DNA, 4643 bp, Oryza sativa
tagcagcggtggttcatgctctaaagatctgggggcactatctcattgggaaccgctgtgaaatatatactgatcataagagtttgaaatacatcttcacccagtcggatctgaatcttcggcaaaggagatggttagaactcatcaaggactatgatgtgggaatacactatcatcctggtaaggccaacgtggttgccgacgctctaagtcgaaagagccattgcaacactctcaacgtccgaggcattccacccgagcttaatcaacagatggaagccctgaacctaagcatagttggtcgcggattcttggctgcgttggaagccaagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccggatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcaggacaccagcgaccggccggacttctccaacctctccaagtgccggagtggaaatgggatgaaattgggatggatttcatcaccggacttccaaaaacccaaggtgggtatgattctatatgggtaatagtggatcgattaaccaaggtagctcgattcattcctgtgaagaccacctatggagggaataaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatgacagaccgagcgtctaaatcagatcctagaagatatgctccgcgcatgtgtcctagatttcgggaagacctgggataagagtctcccctatgccgagttctcctacaataacagctaccaggccagcatacaaatggcaccctatgaagcgttgtatgggcgcaaatgccgaacaccactactgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggtgtgcacaggtttcaaacgaaagggaagcttgcacctcggtatgtgggtccctttcgtatcactgctcgacgcggagaagttgcttaccagctggagttgcccgcctccttgggtaacgtgcatgatgtgttccatgtgtcgcaactcaagaaatgtctccgagtgccatccgagcaggccgactcagagcaaattgaagttcgcgaagatttgacctatgtggagaggccagtgaaaatcctggacaccatggagcgcaggaccaggaaccgagtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaatctatcctcaaaattgtgcaaaagaataagttaaattcattgggaaagccttccacacatttaaaatgtgcaaagataaaagtcaaatgaggcttggaggatttttgtatatttcctaaaagcctaaaatacttaaataaattttagtggaattttcagagcacaaataataattgaaaagaaataaacaaagttaaaaaggttttataaaaagaaaaccctaaaagaagtcttttcccctcctcctcccttcttgggccggctcggcccattccctccctctctctctctctccccccggcccatcggctccccgcgcgcgcgcgcgccgctgacaggcgggcccgcccgccactctcgccgacgggtggggcccacctgtcatctccctcctcccgccgcgccgccgcccgcccgtgccctagcgccgccgccgccgcggattccgccgcatcccgtcgtctccgcgcgcattaaagagaggggaatcattccccgcaatcccctctcccgattccccctctttcccctctctctctccctcggattcgctcggaatcaaccccgcaaaccttgccggcgtattcaatggagccgagatctccgcgcccgtttcctctctctccggccgcactctctccctcccgttgctatataattgctccccgagctccgctcttccgtttccgccgctcgccgctcgctctcgccgtcggatccatgctcgcgccgtgctcctctctctccgccgtcgccgccgacctccgtttcgccgccgtcgtcgctccggtcctcctcccgactcggcgccacctccatcggcttcgccgagtggttgccgaccccgtccgccgctccgcttcgcccgccgaccgccggagcaccgtggtcatcgtcatcccgagcgcgccgccgtcttcctccgctccggccgccattctcgtcgtcgtcgttgtcccggggtgagccgaagaccgccgttcgtttcccccttccctcctctctctcgggagccactccgccgcgccgttggttgccggcggcgaccatcggggcgcgggtgcgcgccgctcccgtcggccgcgccggcgagccgccctcgggcgcgccctcgcggctgccaagtgggcccggccgtcagccgcccgcgcccgtgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaataggatttttaattgaaaaataaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattattattaccttgttcaccctagattaaacaaaacctcaactagtgggtactctattcatggttccactagtatgaatttaggtagaagcttcgctgattaattaggcaacattaggtggttttataactttagactttgggtattctcttatcatttggacactttggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggactctatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgatttttaaatgcggtttactgcaaaacttaatccctatattattattcccttgtacttcccttgcattaatcatgcacct

SEQ ID NO: 32053 - DNA, 147 bp, Oryza sativa
acttttcacattatttattatagggaggccttgggggatctttcaattgggggactgctactaccttaattcaacaaagaagcccattgcaacccaaaataccttgggggcccaaccttttttcatttcgaatagagcttcgtgaga

SEQ ID NO: 32054 - DNA, 1098 bp, Oryza sativa
cctacgaatgtggtttcgatccctccggtgatgccagaagtcgtttcgatatacgattttatccggttcctattttatttattatccctgatctggaagtcacctttttttttccttgggcagtacctcctaacaagattgatctgtttggatcttggtccatgatggcctttttattgattttgacgattggatttctctatgaatggaaaaggggtgcttcggatcgggagtaaccactagtgaaagggcaaaggggggaaggacataggaaagagggatgcctacaaaaaatcaattgattcgtcatggtagagaagaaaaacagcgcacggaccgtactcgagcttcggatcaatgtccccaaaagcaaggagtatgcctgcgtgtttcgacgagaacaccgaaaaaacctaattcagctctacgtaagatagcaaaagtacggttgagcaatcgacatgatatatttgctcacattccaggcgaaggtcataattcgcaggaacattctatagtcttagtcagaggaggtagagtgaaagattcgccaggtgtgaaatcccatcgtattcgaggagtcaaggatttactgggaattccggatcgtagaaagggaagatctaaatatggtgcagaaagaccaaaatcgaaatgaatggaagatgcctctggaactttttggttattttgggtccagatgaacgcaagtcgacatcgggatacgcattttggcttggtagcggtgttatctcttggagtagcaagaagcagtcctgtatagctctgtcccaagctcctctttctagtagccctactaaacctatgagttgactcgtacatactcacttattcttgacttatctgtgactgcatattcctagcattgtaccagggaatgttgcagaccgacgggcacttcgttgctgggctggaatagaaactgacgtatggaggacttgtgagatctttcactcttcgacaacgaaagccttgaggacgtcagcgatgtgttatagggacgtcccgcgatcttgcttctaaagtacgtacgggaacatccaatcgagtgcctaaccttgggtgctccgatcttgt

SEQ ID NO: 32055 - DNA, 476 bp, Oryza sativa
tttgattctcgtctcgtttcacttgcatttgctttcgttctaaagtggaatcgaaccactcactccgtttggatttagagtccaaagggcccaggcccagcgaacgaaaaaggagttacagtcccacgcccactgccctgccttcaccttttgattgctttatttttatacgattttttgagcaactagcgcgaaagccgttgcgcgttagcgcattcggaaccacacatttttatacgattttcggatcatttgattttcgttttgaaaactttaaaaccttatcagagaggggccactaaggctggatgttggcttcaagaaatctcctttagccttaccccgggctttgaccatgtctcccgaacaatttcagtacatatggcgcaagacgattccacatatatatcgaggtcggaatgggatcgggtgttttcacgtctcaccgtagtgcccggtttgtcttgattggtgat

SEQ ID NO: 32056 - DNA, 593 bp, Oryza sativa
aacattccatctcttcttgtccactggtatagaaagaatatgcattttcttgacccaccgaatcctaatcctcatcttcaagggtccaccagggcttccaaagcgaaactatcctcggcaaagaacctaaggaattcctcgaatcgatagactttcgtacaacggcaaacagagagagggttttacgctacttcacagtcagaagcaagggtggaaggtataactctagccggcaggcaggagggaacgaagctctttcctgatcttgggctagaatccccgacgttggtagatttcgcagtggtgtagcttaggatcttaaaggtaagcagcagggttaatccctatcgaaggaatggggcttttcttcacttcagcacttcccctcgcagtggattccactaggttcttaacctcttcccaattcttaaactaaaacctgcgatgtctaatccaactcggcacctaaccagcttgtcagcatcgtaagtttgcctcaacattccccctagaaatagaataagaatgtaaatctactttcatttatttattagggatgagactttcttatatatttttataataagtatgct

SEQ ID NO: 32057 - DNA, 635 bp, Oryza sativa
agggaggctttttcctttactttaattggatccttctttggttggtttccgtttttttttggggaaggcccagaggtgcttccgctatggaaaacccaccaggcctgggcctagtgaagcgggtccttccggatccgctgcgggcaagtcagctgaagcctctactccgtcgtcctcttttttcaatgggctttcgggccagatacccgcaccggattcccccggggaagaggtgccgcaaggggaacagccccgttttgacccttattcaattccggaagttcccctggaacacgtattcggggctgttccagatcggggagagccatccacaagccacaccccgccgaaccctgaacctcaacttggagaagaaaatgccgggccatcaaaccaccaaattcaacatgatgttataagaagcagacttgaaacttgaactccccaaagggaagtaagcgacgatgagatagactcatcatttttattaagaaagatattatcgatcgcatggcccaattagacccggaccgggatggattctggaatgagcaaaaggaccacttagtcgctcatggaatcctcaataagggtaaagagtataccttacagggactgataaacctttctaaaaa

SEQ ID NO: 32058 - DNA, 331 bp, Oryza sativa
tgggggagttcgtttggatatatatatatatatatatatatatatatatatatatatatatatatatatatatatatatatatatatatatatatatatatatatatatatatatatatagagagagagagagagagagagaaaatcctgtagtaggagtctggtcgtctcaaattagcatgcgagtttttttttagagaaattttttatatgactccttctgtattttcaaaagtgaacgaacttaaaacccgacccatacacggatgacgtaccaaaggaccgtaaaaaatatctttaatttttataatagaagatatatttatatgtt

SEQ ID NO: 32059 - DNA, 673 bp, Oryza sativa
attatgcccatctattgcattggctgcaggcatgtgtccattccacattccattgagagcagtagaatctatactaatgtatggcctacagccctctaagaatccatctatgcaagctttgaaagcacaaagaatctgttaaagtgaaccttatctccaactctaactatgtcaatctcaactacactaccaggggatctcatttctatctcagccttgaacctatacaaccaatcaaatgaatcatcaaactttccaaataacttatctttagccctctgcaaaccataccacgttgtctgatagcctatggtggtcttgtatgtctcctgtagcttaccttgaagttcctttgcacccatgtctttcttcttcttcaaaaatggaatagccctttcagccacccaagcttgagatgccatcttcccaagaactctgcttcttgaagcacaatgatgatcctcctcatttatttggatctgcacaagtaaaccatattagcaacttattaggtaaacaaaatcaatgcatacagcataatgtacaatttaacaacaattaaatagttagtataataccctgacacttttatcagcctgtgtctttgctctgattttccatgggcaaccatttgcagaacactttcctcgaaatctatctggatcagattttt

SEQ ID NO: 32060 - DNA, 3971 bp, Oryza sativa
cacacctcacacaaagtcaagagaaggggaatacagagaaggggaatgaatttaccaaggaggacactccgagggcttcatcacgatcagatccacttcacctccgccagctatacgtcccggatgaccggccgatgcgttggcgtcgcgtgcaggcgcggtggaggggaggagctagcggggggactcgccctgccgctgccggctgggtcgtgagagccggccgcgacgcagtggcgtcagggccggcagcggggcggccgcgtgaggctcccgccggccgcgacgggactcgctctgcgtcacgcagtagcggcctcgccggccggccggcgcgtgtgggttccaggcggcggcggcagtagggttcaagcggcggcgccaatagggatccaggcggcggcggaggcggcgggggtttcaggcgcagcggcggcggcggtagagtttcagggcggcgacggtagggtttgagcagctgtggtcgagagaaagagatggatgccgatgcgtttctgtttccccctgttttctcgtttctgcacaagggcacaaaggtaatttcgccaggccagtccacattggcatgatgatgtggcgctccaactcagcgaaagtggcaaaaaattaggatgtaatctctctctagtggcaaatatgttaggccaaatctaatagtggcatatggagagttggcactcataagagtggcaaatagttaaatttcccggtgtggaccgtgtggtgtggatactctcgtcagtcatggcaagttttcccttcggatgcgactggtcaattggtcatgccacgcatgaaattcgcgcaccagtgtcaatcctgttcctgaggtcagcaatcaaaaattattgaccaaagaagatcctacttcctagggtagtttattttcggattggttattcaagtttatctttaacagcatatacaatagcagagtataaaccagctgcaaacatattttaagaagataaatgtggagagagaagtgaatcgggctacagatttgtagccagctgtagcacggactccaaaacgtagtgtgtgtataacaggtaggatcagatattaataagctattagattagctatatatgaattggagctagtacttggctataatattaaacttgctctaagggtcactttcaaaccgcaaatgaaaatggctacaccgtagcttcctataataacgtttcccaaactgtaggtccgtttgatataactctaacatttaaaactaactccaaaagtcaaatcgtacatgaagcagcctaaacttagcttcactcctagttaattttacgaaagcgcttcagtcaactctattcccattttagttggagctgaaatgttttaccgggcttcatctccagaaaagatggagctctagctggaaccgtgcccaacagatcatacttaacagcatattccgtaaaattttttatataatattttttaaaacaaataaataagttagtttttaaatttataatagctaatacttaattaataatcactccgtttctaaatatttgacgttatcgacttttttaaatatgtttaccgttcgtcttattaaaaaattaagtaattattagttttttcctatcatttgatttattgttaaatatacttttatatatacatatagttgtatatatttcacaaaagttttagttattataaaattaaacaatatatttatttgatattttaaaccacgtagaaaattttcacatgaaacataagtttaaaaacgtgctaatcaaaatcgtgatgaaatcggtatgataacaagaaaagaacaatattactactccttccatccctaagggcgttcacagtgtgtcgtcgtggcttctgcctcgactcactacatcggagattccatgccacgcatgcatttggcgtagccaagtgaagaccgcggagccaactttgggcacgcgttctgtaacggcccgcctctctcaggccggacccacttacatctagctgctcttatatgttcaccacatcggagattccatgccacgcatgcatttggcgtagccaagtgaagaccgcggagccaactttgggcacgcgttctgtaacagcccgcctctctcaggccggacccacttacatctagctgctcttatatgtgtcgtcgtggcttctgcctcaactcaccacatcggagattccatgccacgcatgcatttggcgtagccaagtgaagaccgcggagccaactttgggcacgcgttctgtaacggcccgcctctcccaggccggacccacttacatctagctgctcttatatgtcatagactattgaagaccacggagctaactttgggcacgcgttctgtaacggcccgcctctcccaggccggacccacttacatctaactgctcttatatgtcatagaccgcctctcccaggccggacccacttacatctagctgctcttatatgtcatagactgccctcacagatcaacacaagtcttttctgcacactttgtcctcactcgtgtgcactcaggaagaatttcctgattggttacccatcccgaaattgctccaggccaagtatgcttaacctcagagttctttcgagatcggcttctggaaaataagttgcaacttgttgatatgagtattctattaatcctattaagccctggctcgggatatcatacgttcttcctaggcttggcaggcatgcgtcagagcgagaggtgaggaaagacgaggaacgggatgcacgacgtgttgggagagggcatggccccgtgcttcatcgcccccaaagattgcgctagacagatcaagcgaggtcgacggtgcagcgtcgacgtcctggagagaagagaaggcagcggcggtggaagaggaggcggcgaaggaaaaggcggcagtgaatttggcgcctaacctcgtcgtcgtcctcgttccgcgccgtcggtggggtgggtggaggtcgacggccgcagtgggaggagaggagggggcaggcccgcggggaatcgtcgtgcgccgccatccctctccccgtggcggtcctcggctccgcgacgccgccaccagatcgggcgagctcggcaacgacatcgatggcggcttccggccccggagacggtggcttcctgcccgccaccgtcgccgcttggcctcctcgacccttccgccgttcgtcgcccgccttgttgagtagaggggagaaagagaggggggaaaggcacgtctcttgaggagagaggaaggaaaagcttggggagagagaggaaaagttgtttcacatcgaccctactcaaggctacttacactggagtatgaggtttgtaaggttctttgtctatgtggcatacgaggaacattaaaaatcgatgacatacagtaaacgtcctagatgatactagtaatctgcccgtgctaacgctacggaaatatttaataatacaaatcaaacaaccaaaataagatatatgttttgccaagcatataatgagatagaatttatagtaacgtgcatgcgtacaacacattatttacaatatgtataagaaaaataattacattcaagatgtaaaaataagatataggacaaagcgaattcatactttaattacatttctgagttcaattgtaaacaacatacatcaaattttgaaaatgtttcctacttaaggaaaacaaacttcacaaaaagatttaccatgatacatcttgatttgtcatgtaaatcatcactttttgccatatccatgcacatgggccaaattaattaaactaaggttttccttgccatggagcttgtgaagcgcataagcacaattagatcacaaggaactacttcacaatgcgggtcaatagacaataacatactccctccgtttccccaaggtagtcattttagccttttccaccatcataatgaaggttaatgatttaaaataaat

SEQ ID NO: 32061 - DNA, 15040 bp, Oryza sativa
catatcaaaggcagctttgccggtgcttcatcgctatgctctcccatcaactccattcatcgcagacataacttcgttatccatgagctttacagtatacaataaataggatatagattccaaaatactaagcatgagaaccccatcatataaatgacaccaaaatcttagtatatcaaataagtgtcaactgtgccaattcgaacagcttctccatggtctcaccagtcgcacactgcattgagtaatccagagatatgccttaatactttctgtcaaccaacaagtacgttagcaatgaaagtagaaactcacacaagcaacagcaggaatttaaacccttacattgtcatttcctagcagcgctcgacatcatccatcagatcatgcatgttttttttttctctaaatcggaccaatgtaagcctgctcctcccatgtgttgcaaaatgccaaaccatagtgagcctgaagtccatattatccatttactttgatatctgaaatcaccatgccagggttttgaatcaaattaacatattagaatcatgtgaattaagccagggactccatgcaagaggtaatggttaaaccggcaagagttaaaatattttgattaacagatgactttagctaattgtgacaaagaatgacataaaacaaatatcaatttttgatttctttcatgatattgaagtatattaattgaagggatgatatatatttacaggacacttagggcttgatcggcaagcatagatttctcaggggagattccctcccaccacccaattgccctccactgtgggattgtgattgtttggataacagggagaggcggggatattgtctcacatcaaattcagaatttacataggactcatgcattatagaagtctggccaaagtttcattatcctcaaattacagaaataatttgcaacggaaaataaaatgcatggtattaagtaatcatggtggctagacccttccaataatcgttgactgttgttggtcacaattgagctgccgctagccccaagcattatgcccattcgaaccattttcatgttattatggttagactaatgtatatgctgccatagatgccattgcgtgcagctatgaaaaagctctgtaaccaaatatcaactaaataatcaatgcagcaaattaaactgtggaagagattaatcatcacctagaaccaaacctgttagagattaattgatcgggagggaggcgaggagccgttggattgtcgtcatcagaaactctatactctatagaagcactccaaaaatattcaaatcttatcggaaagcactccaaaacttccgtgttcatatccctatgtaaggaccacagaaaagtgcagttgttgactctgctctcctaaaaatcccactttacttcaacttcctttttcaaagtggctagaaggttaaatccaggcacctcaaaagaaattaaccaatacatgagttctaataaaaggattaggttgtggtcacagtagtaatctgactgtgagaaatgagtcatgcaaaaaaggatgaaggattagtgctaaaacatggcaataataaggcagcactaacctgagaaatatcaagagcctttcttccacttcatcagaaaaaggattggtgtaacaattttatggggaatattgtcgataggaaacaacttactaaaattctgcatgaaaaaaatttagttcctttccatcaatttgtttagaagaagcatatatatattagtcaaagtagggcaatacctttcagaaaatacgaaaagttcaaaccttttttttttcgccaatgccaaaaggttcaaacctgtaggaaaggcaaaaacatgagaaggattcacatagtattgtggtaaaaattgtgctcatcctgcatcagggcgtccaccatcgtatagagagtatagtagctggaacaactattaccttaaatacatatgcagcaagccaccacgaacaagtttgattattttgtttgaagtcattccacaaacacttccgaagcacttcttggtactgttgcagatgcagtgatgcaaacaatcatctcggacttatttgggctagggaaagagtccaagctgtgcactgatttttatctcgtgttctaatcaaaacaaatgaaaaactgagccatgctcgggccaagacaatgaagatataccaatcaatcagggagcagcaaatcgaaatgctcacatgtgttacttgcctccatgtgttttggccgccgtaggtggacacctcccattcttggatggctgcaagctcgtccgttccggttgtcacgtcggcgctgggagtcttgccggcgaccgtggtggcaggagactgagcgagtgggcggccatctggctgcgtacaaccaaagggttcagggacagccgtcggtcgaggtgaatctgggatggccgccggtgaaggcgatccgatctggagggaggcgcgatagaaagaggagggagggcgcggtgattttactgggggaggggaggggaggcgaggtcggatcgggagggaggtggggagccgttggatcgacgtcatcagatgattttcgatcgttggatgtgtcacacgattaataagtaaaaccatttatttaattatagggtagattttggttggagtaaaacatagccatccatatcctcccaccgtcgactccgcgagtgctcacagtccaccaaacagcaacccaccgaaaataaatcgcgaatatccgcagctgctttgcatctgtggcgcgccgcgctgcgtcagatttctcctcttcggttcccctcgccaacgtgtcccaccacccaccgtctattttgtcccctctaaaaccctccctttcccccgcatccacggccctccctctcgccgccgccacttccccctccctgacgcttcgccgcagcgaaaggcggagagagcggcgcgcgcgcgggagagagagagagagagagagagagagagagagccgagaggagcaagcgagaatgtcgccgatgctggcgacgctgccggacgtcacggccgtcctccactccccgtcggcctcgccgccgtccggcctccgcgcgccggcggctgtggggatggggatggcgaggacgcgctttctcgctccgcgggcggcggcttcggcggcctccgccgtctccgcgaagccggcggcggtggcgccgctgtacgcggaccgcacggtcgtccgtatcgggctccccagcaagggccgcatgtccgagcaaaccctaagcctccttaaggtctcgcacatcgtctccgttcctgcttccatctatcgaattctgtatttacgtggtgattttgttgactttgtgttgttattatgctgttcatgcctcgtggtgcagagttgccaattgtcagtcaggcacctcaacccgcggcagtacaccgcagatatcccgcaggtgaggtttccatctccattcattgtcttctatcagttcgtcatttctgtactggaaattggcctactatcgaattagtaggccacttaggctctctgattcattgataagtatacgtatgggctagtccattttcaaagcattgcagtttaccatttcctgtatatgcactattgttagtatgaatgcccttttgatggttgaataaatacgcaatagcaattccaaactaaggcccggtttagttccaaagtttgaaccccaaaaacgtcacattgaacttttctacacacacaaatttccaacttttccgtcacatcgttccaatttcaatcaaacctccaattttagcgtggaactatacacaccctaaagttactttatcccttcgacagtatgagtgaaatactgccatcttatacaatattatatttttagtttatttcttcccttcaacaattcgaattttgtctgaacttctggtgcactgatggatgaagcaacagaaaatttgtcccttaaaatgattcaagcatccttgtcaatttaataccccatcgatcacattgtgtgttcacaatacaaggagatgtccttttagaaacagtagtcatttttaatgaaacctagcatagttattgtaccttttccacacttgcatatggttttaaagtttggagagattttagttaatttatttcatttaatatgggtagcattagcagctttaccttcctatgactttgtccctgcatgatctgcagctatttgtggaaatgtggctgcctgtttagaaaattagtattggaatataacggtgtaggagatagctaaggtaaaaagtcgcagtgctatttaaatcacatgttttgatttttttctttcctttatgcaggtcccaaacttggaggtttggtttcagaggcccaaagatattgtccgcaaactacaatctggggatcttgaccttggcattgttggttttgacatagtcagtgaatatgggcaggtatattttgggaattaatgctcaatgttttagctcgggttgtgcatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacattctccccctaagtcttgtgcgctgtcttgtgggagagttgagccatcccgatccgggagcaaagctcaaggaacttgatcctcctaaggggtttggtgagcaaatccgcaagctggtccttggtgttgatgtagctcgccttgatgctcccttcctccaagtagcttcggatgaaatgatacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctgctgcttgattgactgccagctaacgaggcactcgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcactgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcaaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacgacggcgatcccaaatcctcatgagtccgtcctcgaccaacacgcgtgagccgttctcatccagctgtcccacactgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccttcgctgctgctgcagcggtctgagccgttgctcgcctgcgctcttctgctgcggcgagcttggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacagtgcataccgcatacctctagtttcatactaagtttcttctatacttatttatagcatacataatgttcttaatttaatatttatttgactttcttagcaaggctttaatagatttatacttgtacttatctgagatttcctgtggcagggtagtgatgatttagtagttgttcatgatgctctcgagtttggacattgtcgtttgtcccttgcggtatggtgttctagaattgcatccatgcgtactagttgttacttggttgaagtttgtatctgtctgaaactgtcaaattgcatgatcaggttcctaaggaaggcattttcgagaatataaatactctggaggatttggcaaatatgcctgaatggacacaagagagaccattgcgtgttgttacaggatttggatatgtatggtcgtgaataaactcaaagttgttcaagtgctccccccctcttggacattaatttgctgttcatttacctagttattttattgtattgcagctaggagaaaagtttatgagagaaaatggtttcaatcatgtttcgtttttagctggagatggagctcttgaatcatatcccgctgtgagattgcacttctctaataacttacttaggtttctttgtaacttaaacttcctttcttttttgtacttctttgtttatctagttgatatattgatggcacaattctgttcctccataatagttatatttagatcctagtaaaaccaaatttgcatatttctgtcccaatatttcagcttacaagattggtatttgcatggtattgtctgtaccgctgtagtattgtttgttatttctattttattatgatgttagtatgttacaaagctgcatggaatttaagtataccaataccatactttactgtaatttgaatttgaattgtaatagatctgaactgaaatttgtctttacttctttattctatattggcatgtttgtcttgattcttgatatgtgaacttgtgtgttcttacataatacacaattagcctatcaaggttaacaaatgctaagaattcttttttcctcctgtgaagatgggtatggctgatgttatcgtggatcttgtgagtagtggaacaaccttacgtgagaataatttgaaggaaattgatggtggagtagttttggaaagccaggtaagcctaacctctccctcccttcctctcacgcgtgcacacatgcatgtgggagagcagatgcctggtattttaattgacatttgcttcatcaaaagataaattgtgctcatttacaagatatgtaatatcacgcaggccacgcttgtcgcatgtaggagatcgctacacaaacgtaatggtgtcttggagattacgcatgagatgcttgaaagattagaggctcacctcacagcaactggggagataatggtaaaccaattttgtagcttaaattgggtgattactcaattaattgcttacttattatactttacattgccatataaggtcacagcaaacatgagggggaacagtgcggaagaagtggcggaaagagttctcagccaaacatcgttatgtggattacaggtatcactaaaagtatccaaagtagtattttacctttttatatactgaccatgaatatgtgcacttatgtggcagatgctaaaatatctctttaaaaataatattattttccacattcataaattagcactctataatcttgaactggaaatataattgtattgtagctgctctaatatctagacctgattaatcttcatcataatctgggcaatttaaagcttttaggtcctttgaaataaaactagttttgcatttcaaacttatagcaaaagctttgctcatgattatctgactggaaccactgtagtttgaaatactgatgtggaaaatcactaaagcttatgagttgattcactcattttgatttaaacagggcccaaccataagtccagtctaccgctcacgtgatgggaaggttgctgtggaatattatgcgattaatgtagtagttccacagaagtctctttacaagtccattcaacagctgagatctgtaagatattttacctcaatacttttaaacggaaatgtgtgcctatctccccttattctcccttttccttttctgtttcatgtgggcaattgtctcttatctttagaaattttctaatgttgtagtaaaaggtatatttatgtgcttatatgagtaattatcaaaagatgtttctgtgctattctcactgctgtcagcgcaaaagataaatctgatatgggagctcataatagaacttattgtcagaacatatatggcccttgctatatattttttgaacgtgtatggcttagttccattgataaatccaattgttttaatgtgtactcattaacttgtaactgcagattggtggcagtggagtcttggtgacaaagctgacctacatatttgatgaggaaactcctagatggcgcaaactactttcggagctggggttgtgacttggtgtgaagtctgccatacttctctgtcaatgacccttttagcatcggtttacttatgctcgctgaagtatactacaaccataatcagaaatgagctctcgtttgaagtgtctgcggtgcttatttgagaggaaattttggtctgtgccatcgtacattgtgctcgtctagttatacctttgacaagcatatgggttgaaataccctttatgtacctgttgatataattgtgagaccttattgccttgttggataggtgtgcgtatgaattgtaccttttcttgcgtgacgctgaataaattgggctttctgcaataaagatggatggtgtaattccaccccgtagcaaatctgtccgcctcctatgatgcaaggctcctgctatctttatccttttggggttgacccggggttactatggaagagtttgacaccaaatttgctcttggtgctggatctgggatgataagggaattccaaattaccaattctaatttttcttgtcaagttcctttcctcctttctttttacttgtcttgaatattgccagtatttacagacacatctgtacatttgctttgcacggcaattttcatggtcaaattgatagagcagagacagaacacctaccatatacatgatgatattgctttcagaatttaagttccatgaaaaagtaatccaatatgagatggcgaccctttgcacgtgcaggtatagtgtagacatgacaaacagtttacataatactgcacacatattatctttgatagatttttgcatatttttacacaattggaagccttatactcactcagtcactgatggcgcacacacaataaaaactgtttaaaaactgaaccaaattcagagcagagctggtgcacattttctcccagctgcttatttactatcggcaagcacgagggtcacggctacaaactacacgatcaagtcatggtgcatcacgcctttagctgcagacgtgcagagcctcacacatttcgccgtgcgcttacccggacctcgagcggcactgccatctcgcacgacaggcggagcacctccgacaagtcgacggcgccggacgccggcgtccactcgaactcgtgcagcagcgttgccatccaggcggtcacggtcgtcatggccagtgacttgccggggcagctcctcctgccggacccgaacggcacgaggcggccgtcggcgccgagcacggacacgccgtgcgccttgccgccggggaggaaccgctccggctggaactcgagcggcgcgtcccacacgtcggcgtcgcggctcatcgcccactggttcaccatggcggtggtgccggccgggacgaggtggccgtcgacgtaggtgtcggatatggccctgtggcgccacgagaggagcgggcccggcgggtgcatccggagagcctccttgagcagcgcctgcaggtaaggcagcgacggcacggcggactcggcgaccgtgttgctccgcccgaccaccgcgtcgagctcacggtgcacgttggcttggacgtcggggtggaggacgacgcgagctagtgtccactccatcagcacggccatggcgtcagttcctcgaaagatcatctcctgataatttaatgtaaccacggttttattatttactcatttggttatgtaatacgtacgtcagggagtaactgctaccatccgtttgtatgattctttctacatataaaatctgaaagaaatagggaaaaagttggtggaattttgcatgggggtagctttttctaaaaaaaggttttattttgtttttcagatttgatcacaacaaaagttagttttgcatgatgtgtttacacctcttttatagaactgtttgatgccatattaatccaagcacgccaaaatatcaaagcacacggatcgtacccaaagcacggcggcgatgtcggcgtcggcgagcccctcgctctcctgcagcgagagcaatatgtcgacgaagtcacgtgcctctcctccggcgatcgccttgccacggtgctcctggatgatgcctcgcacgaagcggttcacccgtggcatgagctcggcgcaccgtgctccgacgccctgcgggtcaacggcggcgagccccgggaagtagtcgcaccagttctccttcccgaggaggtcgtacccttcgtgcaccatctcgagcagctcctccacctcctccccggactccggcgcgccgcgcgacacgtcgtactccttgccgaacacgaaccgcatgatgtagtagagcgacgcgcgccggaggacgccgcgcacctg

SEQ ID NO: 32062 - DNA, 19637 bp, Oryza sativa
  unsure (1)..(19637): unsure at all n locations
cgccgggttgtcgaggatctccttggccacgtccgggtgcgacgtgacgaccgcgcgtaccgggccgagcgacagcgccatgagcctcttggcacccggccggcgcgccgcctcggcggccagcgagcagtgcgccagcccggacatgaggccgaggcttccgacgaccgggagccctttcggccctgggatcgaacacctcgggctctgccccctcgccctccggtacttgccccatgcagggccacccgggtgagcccagtagagcagagcagtgcctgcccatgcaaggcatgcaaagatcgcgaggtagacgaagctcgtggccatggctgacagtgtggcagcgctctcattttgccctgagatgggcgggaggaaggtcagtggcagcacccaccagttctcagctgctgagctctccatttgcaatattgcactgtgctgctgctgtgaagttctgtgtgctctgagctgcagctcggggagctgtatttataggagttttggagcgaacattccgtcattcctcctccggtgtctcctggcaaagatgattcagttacaatcattggcaataaagaagactttgcagtgcaccgttgagtatagtccagtacagtggtcctggttcctctgtttttccattcaggtgatcactgaccaggtagttcagtttagagaaaataatcaaaccagcctagctagtgtatgtaaactgcatggaaatcgaggagaaattggtctcagtatctgctaagtgaaaggttcaacgagcggtatacggtacaactcctgtgttgtactactacttggtctccaacttttattctgtcgcaatcctaactggccacacgtacgttcttcagattagtctagcttcaattcgcgacacctgtactcctgctaaccatacatttttggcaagtcctaaattatgagaagcctggggtaccaacaaaccatagcccaataagtctgcaattgcagcttacgtgttgctgatatatagatctcactatattgtgggtgtagagtcgttgagagagcgttgcggctgcttgttttctcgacagagtttgttttcacatgctttgtttagggcgtcatgaggacattcacgcaagacgcaacgactgcgcatgcaggtgctaactaaaattttatattgtgcatcagttggtgtggaacacaataggagttagttaggcccctttcatgttacacatgcatgcttgcttggtttttatgctttatgcatgaactgtcctacactaggatcagtcagcggtagcgcatgtacctgtcagagtagttaattatacactaactatagtaccattattggatggaccaaaagattaattacactgacttgcttagcctcgtcattagcagtacgtatgtgggagtaatttcgtcaccccgcaaaatcttctatgataatgtccccatccctgcaggcagggatatgtacaagtacaactggccaaactttatgtatgcacatgtacgtatagtatcacctgtgcaatgtgtgagcagttgcgcaggaacttatcaggaacacgagagcaaaaacaaatgaaattaatgcattctctccttatgaaaatataacaacttctcgcttttaaaatttgtcctaaaatataacaatttcttcaccaacattctctttttaatcaatcacaattccccaccattcaattttcccacctaacttcacttctcctccaaccgcaacactcgatctcctatttaatcctaccaactttcttaatatctgtatctaactctaaaagtacttatattctaagacggatggagttcaaattaagactgttttaaatcattcaacacaatcggaaggtaattcagctataagtttaccaaaacacaattgggcgggcggaatctaaagtggattgagtacgtggttagttccgcaaatcgtctgcgcccattgtttcatcgaaccaaataacttcgtttcgtgccgtttaggtgtttagctgctgcagttctacatgcataaacagcggatccacttaaaaaaaaaaatccaaaacaccgaactgaacctagtacaattaggattgaaatactctgactaaaatgtgaaccctctaccgagcagaaccacatatcaatgactttgtcttaaggaagtactcccttcatttttttaataaataaagccgctgacttttaaacatatctttaactattcgtcttatttaaaaatttatattagatataaatcaataaaagtgataaaacaatttacaacaaaaataacttataattacgtaaaatttttaaataagatgaatgattaaatgtgtgatatatataaaaaatcaacacgtcatctattaaaaacatgtagtaagtcagtacaccacatgtcctactgtcttgcattggatccgccactatatactggaacgcacgcgcacggcgcacaaccacctgagagcaaggatactagtatagctcacttactatctataggctctctccaagagatctatgtcaacatattttcctacttggaagagattaaatgaagagagagataaaagctatctattaacctggagatagtttatagagaaaaacgaggcaatggattagagagctatagatacccatgtatatataccatttaagtggtttcctattaatctagtctattgctgagatgtacatgttttatagatagcaccttattttactattgtgggtgctcttagcttatcttaaagctaacatatatataatagattagatataagtttggctataattttcttctcctctctctatctctcatacatttaatgcatttgtcttgagttttcatacatttaatgcatttgtcttgagattgtgttaagttagtctttgcatgagtgtcaatccccttgatttttttttgttacctctcttctccacataagtttaagtttataggtttatagtagatttatatctcactattatacttctctggaagctgaaagagctgacccgcgaggccgcgactgttgcctaactccttgggaagtacgcggggacaaccgcgcgcctaacataacgcccctggtgccaacaccatcgcgcgcatggacagcgctcccgccgccacaaacacatctatcgggcggcttccgcgcgtgatccgccaccgaaatgcacccgccgcgacgctctcattctgccggagcgccggtaccacgcgcccggcggaatgaaaatgcggccgctactacgtgacaggacgccactttccagcgaactcctcgtcaacatccgcgcgcatccccatttttttatctgagcaaaacaagaaataattttttttatctaagcagggcggtgtgaatttttatttataaacaggacggcgtgatttggtagcgtcccgttagcctaattagagcaagtttaatagtataactcactactagctctaatttatatatagcaaatctaatagtcaatttatataatagttacttcctatactattaatatatggtcccttgtcatatatgcattgtatcttacagtctgtgttgcagctggctatagatctgtagcccgctgtttttctctctcatcttttatctcactaaaatatatttatagctggctaatagtctgctattgtacctgctcttagacggagtcttttacccctatgccattaagaaagttggaggttacgcgtgtgccaaaaaaagttttgagttacatgtattaccatgacacaaactttcgtttacccgtgtgccattccatccaccatctgttagagaatgagctctgacatgtgggacccacgtatgaaaatgactaaattgcccttgaagcattttcatctctactactcctctcctccagtgcgcctcgaaccctagccgctgctgccgttcgtcgccgtcgccggcacggtgccgccgcctcgcctcgtttatccgccgccggttgtcgccggcacgccgccgtcaccacctcgtctatccgctgccgcctctctagcagccgccgccgacggtcgttgccgtcgccagcacgccgcctcgcctcgtctatccggcagcgcgcctcgtctatccaccgccgcctctctagctgccgccgccgccagtcgtcgcagtcgcccgcacgctgctgccggtcgtcgccgtcgcccgcacgctgctgccggtcgtcgccgttgccgccgccttgcctcgccggcacgccgccgccaccgccgcaaaagtggctgaaatagaacaatggcaaaatagatctttcaaacctccgttagtctccattagtgctgattccatccaaagtggcgcacagttaaacgaaagtttgtgtcatggcatacaggtgactcaaattttttttatggcacacacgtaacctccaacttttttaatgacataggggtaaaagattctcttagacgcggtttatctggagcgtccagtcttccagcggacgcgacgttgttatagcgtccaaggtttctaaaaacacattcatctgctcacagtaccccaaatcagaaagggaaaattgaaaccatgccattataattttgcaaaatttaagatatgccatcctgacccacatgtcattgactcatgtgggtcctatatgtcattgagatatcgatggcatatctcaaactttgtaaaattataatggcatggttctaaattacccaattagaaacccaccattgaagcaccgatcatgagcctcggcggccgcggcggtggcggctaccagtggcgctagttcatcacgatcgagccttggagtgtgtgcccgtggccgttctgggtgcgcatccacgagactgagtctctcggcctcacgcgcggcgtccggccatctggttaattagtcatcctcttacacggccatgtactggttgtatgattacctcttttcgatttttgcattcaagagtaaatgagtaaatcccgtgtggtattcttttctttattcatacattgcactgatactgcctcaggcgatagctgtttcgtgcttatgttttagaggacaatgaccgaaatatgagcaacagccatcgtagcaagtgcttgtaagctaatttgtctgtccattctggcctgttttctcaacatagcaagatgattaaggagacaatagacaatagtgtgcacataatctggaaaaatgatttagttttactgtaggaccaatcaccatacaatcctaatttttgagttgcagaaaaaaatataccaattgtaaattgtttgacacgctctattaatttttttaaggtaactagtaagatgagggctactcaagatgggctaagtcggtcagctgcaagaagtgatggagtgcaagaagtgatggagagctaggcttattagatggagatcaaactttagttcagcaaactgaacaaagtgtttcagaacgtttcagtagcactgctgtggatgccccattgccagctcaaaatctcaaaagtttagaaaaatgtaagttatagcttgtttcgtatacttgtttccaaaaaataaaataaaatgattgactaatttttaccctatgtatgcaggctaatgatggtgtgtaagagtgtcaggtttcaccgtacgtgttggtagcattctataccatttatttatgtgagccgctattgaagaggcttggattttatcaagttgcttagatgggtggaatgggtatatatgtgcagtctataagtataagcgatgtatactcaatgcaaaggactactgtgcatattacaaaggagtacatctgcatctagcagcatcggtgatgatgatagttatttgatcgatgcactaaagtttttaatcataatctccatctagcgctgcaaccattgcaggatataaatagaataaatctaaaaatccgctacttgattagtactgatgtctaatcaattcgaaacaaccaaaagaaataccttagagcaaataatctgcgatccccacttgaattctgatcatctaatgtaagatttgggcattattagttctccagtaagagaaaattaggagagaagattagggatatgaactgtaggataatgaagaaagacagcaataggccaggtaccagaactcagcagcgtgcaattccgatccgtttcgttatctttgttgcgtgtgtgcagttgctcgggcaaggccgctattatgtttccgcgtccaggttcccgttcaaggacacggtaaacaccaggcgtccaagttaggcgctggcaaagggtagcatccccatgaaaacaacaggacgctacatgaccacaacgtcctgcttattaatctaatttaatttctatgatgctaaaacaaaaaaaatatatttctcatcctgctcagagtaaaaaaaatcgggcgcgcatccgtgtgtgcgggaaacgcgcgcacacgtaggttacgcagccaagcggcccgaatcgatcgcaggttgggtgagggggccgtgatggtacgtactacgtactaccgcaactccattacgatacgaaagtgggatcgtccaagagcatctctaccagcctctccaaatcaaactctccaaacactcatatagccaactctccatctgatttagagcatctccaacagtctccttattcaactctttaagttaaattttagcaattttaaagcaaaatcgtgctccaacagactagctaactggatggccaagccatccggctagccaaactactcctcccgccggccaaatttggccagccaaaatagcctagccaaatcgtgggtcccaccgctttcccccctctctctctcgtcagatgaacgccggcgccgcatcttcgccgcttcgcgccaccgcccatccacgctggcgccgcccgtccgccagctccgcccctccgcgccgtcgcctctcctcgccgcccctacgccgccgccgcccctccgcgccgctgcccctccgcgccgcccctccacaacgccgcccctccacggcgctgccctctgctttgccgacgccgccggggccgcccctcctccattgtcatcctttgccggcgccgcgccctccgtgcgacgatgagaaggaaggaaagagaaaaagaaaacgaaggaaggagaagagagagagatgggaagaagaggagtggagactgaataacgggccttgtagtttggaagagtattaatagaaagttcggttggctaagccaaataaataaaagattggttaataggagggttggaagaggctgtagaagatcttttcagttagtcgacttccaggctaactcccccaaactctctattaatactctccaaaataaaatcggacccacatgtcagcctctctcccccctcttgtttctttttccttcttttcccctttccttccttcctatcgaggtgtcgaccacgctgttgccgacggcggccgacgcatggcgtgcggtggtgcgatgacgcgaggaggcgggaggcggtgcggggaggctgccggatctagaggccgccgctggctttgcggtgacgaggcgacggcggcagacgaggtgggaggcggtaagcgatggcgcccgacgacctcgacgacgacctcaacgatgacgacggcgcccccaacgacctcgacgacgaccccgacgacgacgacgacgccgcccctgacgacctcgacgacgccctcggttgtagatgacggtggcttcggcagtggggcggaggggcagtgccggcagagggagggcgccggcgcggcggaggctagaggggcgccgaatctaggggatgggtagagaagttgcgtgatgaggaggaagtcgtgatctggggagggggagagtgtacgggatggggggggtggggaaaacgcgtggggcctacaattggagaggcgattttggctggccaaagttggccagcgcgagaagaagtttggccagtcggatggcttggctagccagttagctaggctattggagtgtgtttttatccaaaattaccaaaatttaacttgaagagtgggataagaagtctgttggagatgctcttacgccagatttggctttacagcgaccccaattctctgcaagcggacttccgtttgtctgaatccttcttatggttttgtacttcagttcagtgcactgagcctagctaccacggatccttaataagatgggtagtttggcctctgaatacagatcgtacgcttgcaatttgtgagcgtgatacacatggttcggcacatcgcaatgattcaatggatcatcatcattgcacgcatgcaatcagaaaaaaagatcaagtacgatatattactcctagttgttatcagtagttgttgcagggtatattgactggctatacatagtgctgcacgcagggaaataggggcatcttccctgcagatggtgagacactgtgcctaacctaatttgctgagctaagctccagtgcagactagctcccctgattctagctacttcagaatacatataaacaattctccgctctatacgttttaggggtcaaaattcggatagaattggattcgatcaaagatttaagcgagcaaagtaaatctgatcgaggcaagccagtgcacgcacgggcttcgcaaaagcgacatttatggttaaatttgattcctgctccttggccaatgcgatgatccattgctttgacttgtcaatatcaggaccagatgcgcaactaactgatgattttgtcctcagcaatgcaaggagatatccatttgtcagtggagaaccctaactgccaaaaagtcgaaagtgaaaagacgggcatgcgattctgatatacgcagctttttcgatgataaatcgaaagcaaatcctttcttagggccaatttgtctgtataaatatttttgaattgaatagaattgattcgatctggcactcattttatatttggcagaatcgaactttcctgtttctgcacacttgcggagcaattttctgttgctgctgcatgtatagcccacttcctctctcctgttacgtttgatctactctatgatccatacaataagttaatgaaccactttgtatacaatacaaatggaataatcttcctgaacttttttcacagttattatagctcaacgacccaatccaaattatccatcaatcaggccatgtattcttaggtcttcgtgttgttgcctacaaatccactctagtgaaaacaaaggacgccgacgttttataaaaacaaagaggtgctcttacacatagcaccacttactaatctttagctgttctcctcaaaagttgccttgctacaataatctttcaagctagttaatgatcacacagaatgtggcttttgattgatccaaatacaactagtaccaaagccttataatcagttatatgtgctcaataagatatagcaatgccaacactacacctacttgaaaagtgtttatttcactatgctcctgtcactggcccataggctcttagcatatattatacatagaagcatatgcaagatcagtagatcacactaaagtttgcatggttcagattgagcctcaagatatttcaggatccagtgtgaaagcctccttttctgttgccaatcatctccattgaatgcaatctgtagtaaattaaggtggtgtttggatccagggacttaactttaatccctgtctctagacactaatttagagtattaaatatagactatttacaaaaactaattacataaatgaaagctaattcgcgagacaaattttttaagcctaattaatccataattagagaatgtttactgtagcatcatataggctaatcatgtattaattaggctcaatagattcgtctcgcgaattagtctaagattatggatggattttattaatagtctacgtttaacatttataattagtatccaaacatctgatgtgataggtacttaaaagttttagtcccatctaaacagggtctaataaccgatcgaacagtatgattgtttgaactcatggatatgattatgaagcgctatggacacgccaagccacacgcccacacttgatttgattttgcttatcaccgtggcattgattcgaacaatgtatctggagagatcacatttttcaaaacaaaaaaaaaatctggggagttcagttcagacgtagcacacgcatatgcccctaaacggctttaggggctgtttggatggactaatttttaattcttatcacattggatgtttggacactaattattagaagtattaaatgtagattattgataaaacctaatccataaccctggactaattcgcgagacgaatctattgagcataattaattcacaattaacctatgtgatgctacagtaaacatgtgctaattatggattaatgaggcttaaaaaaattgtcacgtgaattagctcttatttatgtaattagttaaaataatgtccaaacatccgatgtgagattagaatttagtccctgaattcaagcatcacctgaattccttttcagctagcagaaggttatccattgtttttggttgcatcctttatggctaaacatacagaaaatttcagaggcaattacctctgttaatctacatctcacacgttgctaaaaaaaaatccgggctagaagaaccagttgtagtgttgtaccagtaataatttacatgtaactcaaatatattctagtgaaaaattcatccatgatcagtatgctgctaaaaaaaaatcattcatgcatatttgtgagttttcaactgtggcagtaaacttcttaagaacttccatactataatctataatatctcacataatctgcagcaaagaatttgttcctccagtgcatgggcaacgaccgaaaaaggcaaatcaccatgaaattcgcgggctaaaaagaaaaaggcaaaacaatctggctggaatggaggggaaatggagcgaattcttgctgttgctgccgtgtagttgtgcacttgtgcgtgggaatcatctcgcgcggccggggagaagaccgcatctgaatcctcacagcgacgtcgtggtcagtcagccgagccgttgtctggcggtggtagtggactcgtgcaaggtccaactgatcgatcatcgcgtgacttgactagacttcacttttgagagggagacttgcctggcaatggtagctattgacttagacttcatatttcgtcaactgagatgcaaaagcgctctgtagaattgaattgcagatggagcagttaagcaggtccatctctgtctctgatttggagccctgctttgtataagtttaagggtttattccacgtaaattgttcaatagatctaatagctagttttaatgttagatttgttgattctttggtcttctcattctctttggtgatcggtggctatcgcatttgtaaggtctttgatgtcgggttgcccattattcaattggcagcatcggctttatcgttcagatcaccggtgtgtttgatgacgttgtttgaggatttataagatggtgatcgatttcgtttgtatacttctatatttttgtttgtacaggagttgatcaaaactgtggctacgctcatcagctcgtatctcttatgttattctagcaagcagactatctttatttcgttttggtagttgttcttatttgactattacgtgtaaaaacactaataatctctatacaaatgtaatgtacattgtttcaatgagaaaaaaaaaagatccaaagtagtaccaaagcgcaatgctaagctggttaggtagcaggttacaagttagctataaacacgtggatgagatcagagaagagagaaaaggaaattgggctacagatttataaccaacttcggcacgaacttcaaaatgttatgtgtgtacgagatgtggcactatgtattaatgatgcagtatatatttatagataactattgcatgaatagattattaaattggctatagataatttgaagctaccagttgactatactattaaacttgctcttagtttgtgttcgttgcttgaagttcctaactcattccttctcgttttacgtgtgtacactccccaaactattaacgatgcgttttttcaaaaaaaaatctataggaaagttgtttgaaaaactcatattaatctttttttaaaaaaactattaattaattatgcattaattagtcgctccgttttacatgcaccgcaaattagttcccaaccaccaggaaaaaaaccccgccttatgattgaatctgagccatccagtttaagttctagacacatgcatttatatttgcggctaattattatttcagtggtagcttggtaggtgacatatgcatcgacagcgacacgcttgtatcaacttcatcaatatgaagatatatcgtacaacgagatgcttatgctaactttgttaatttcaagatatacatattgttaattttaagatatgctagataataaaacgtcggtctacgatgatttcgtcaatattaaaatatgctgaataataagacgtcggtctatgatgatttcgtcaatattaaaatatatttatatgctggcttaatttttagaggtgctaatagagataagggtgtgcgtgtgtacgtttataaatgcaagtatgcgtgtgtataataacatccgcgtctgtaccgtatttcgggggaaaaaagtagtgccaaagctgaaattagttgacctcagcatcaattaccttcagtctgtaccgaagttcagcttcattcgcacccccattcgcatcaggcagagaagatcataacgcgcggtactcataactcagggaatctgttgttattattctccacaaggaagatgggccgaaatcccagaggccggcctattctagaatcagtaatacgggcttcccgtcgaggcccactacatcaccgtcgaggcgaccatcaccgacacgccaacgcggcacaaaccaaatcgatcgaaaacgaagcagtccccagatctaatcccttctatcaataaagttaacctcgtgcttccacgccatcattaaattgtaaccgttggatgaatgtattagatcgcttcttagacgttggatgaaatgtaacatatagcccaacccattagtcaccgggtgagtctcttcgcctcctcagtaccaaatgtagcccacataaacacattggcccatctccacacacatctacatgtatccagcccgttaatccgtataaaagagctttatggctgaacaccccttcagttgacatgtgctatctaaattatctacaaattttgaatagggctgttaaaaagaatttctccaaaaaatctatttgtttcttcttgagattgtacctcctatctaacaaattgttgttaaccaagtcccgcagcaacgtgcggggcatcctctagttatccaatacgccctagtcctcaccgacgcttccaccacgcgtcgacgccccggcggcacttccgctccagatactcctcgcgcgccgcgccacgcccttcactcagcaagcccgccttgcgccggagctcgggtacgtgaccgactgctgggagataagagatcgcccgagcccgggattaaggcagaaaataggggagaggaggaaggagtctctgctactttggcggcgtttttttttctctattgctcatgaaagccggcgtgatctagggttttgggcattggactcggtgagtcgttccaggtgtggttgcaagatgttgtagtcagacccagagttttggccgtggcaccatgtcaaagagtgggggattgtgcgcaagcctgacgccaatcctcttggaaggagcaaggggacatggctgttccgctgatttcgtaccttcgtgagttttccggttcccctccatcatcgttatgtgcttttgttatcttaggtcctgttcagtttaatattattttcaaccattttttcgtaaagttaccaaaattttggctatgtttagtttgttgccaaattttaataaatacatatgaaatcttgctaaaatttttgacaaccttaccaaaatttggcaatgtcaaaacttggtaagattgaaaatgatagcaaagtaaacaagcccttatttcccttggatggatattgtcaaattactctaagctccatgcctcatgtactatctgtcttttaggacaaacaaatggttgcaattatatgcagtgtgcttgcgctaattgccaaacatcagttcaactatattataagttcatctatcacgattatttactcttatttttctgtactagtgatcaaccgcccttcatttcagaaataatgcatcaaagcaaatatgcggataagtagaactagtacaacttatgctgtaccacccatccatggctcacatgttacatcctcccacgttgcttatacaaacaatgaatgaataaactacagtctgttcgatctcacgcgcaaacctcaaataaaacgaccataccgacgggcgacggcccgacgccactacgccagctttagagttagaggcgcgcacatcgcttggatttgctctgcactgactcccatatataccacttcgccggctaggcgacccagccatcctctaactcgcaacacgtaagcctgcaccaagaacgactcttgcttgaccatgccgagagcgcgaggtctttcctgcctcatgtcgccgctcagcggcaagcgccacgccggtgacgcacgccgcagcagcgccgcgtgcatatgctgcatcggcccacaccacaagccgtcgtccgccgtcggcggtggcggcggctgcgtgccctgcctcgctccccacgccgaccacagcgtgagagcgcctctcaccagctgctgcggcagcggcggcggcggcggtgacaacaacctccgcggccgcagcagcaccaccaccagcgcgcgcacgccgcgcacacccaagacgccgtgcacgcccacggccaggcgactctgcggcgtccggtcccgcaccccgcgccgcgggcaggtcggctgcttccagtcgtcggcgcctgccgccgcaaggacgccgcggactcccacgacgcagcgcgcgtgctacgtccgtggcacgggcacggctcagggcaacgcgaagctgggcaggcggcgccgctggctccggtccacgggccagacgccacgccgcacggcgcgcgcgggtggcgacgtcggcaacggcggcgacgtcaaggtttacaacactggcctcgtggaggccgccgccgaggagtcggtaacaaaggaagaggagaccagctcgaacgacgagtacgcgctgctgtgcaggcagggcttcccacgcgaggacgtggccgcggtcaccatccaagcctacttccgaggccacctggtgcgcgcgtagaaaaacaaaaaaacttatatctaaccgagacctgtttgtttcggccattggtaagaggattttgcttgtgttttgcaggcgaggcgagcgttcaaggcgctgaagagcctggtgcggctgcaggcggtggcgcggggggcgtacgtgcggcggcaggcggaggtggcgatccactgcatgcaggcgatggtgcggctgcagatgcgcgtgcgcgccaggcagatgctcaccaagcccaaggaagggcagctcttgccgagctgatcatcaaagccgtacgtgtgcagtgcacgaccacgttaccgtgggaaataaacgtcgcctgaataattctggaaatctatcaagttaagatgtttggcatttgttgctgccgagaacatcgacatgggctgttggcctgttgctgtgatgaacttcccgtggatttgtaattctaaatatctgtaattcatatgttgtccttggttttttttacccgtggaaaatgcttaactgtttcgtttgggaataacccattttattttgttttcttttgattaacttgatcctgtgacccgaagaattatttgacctatatggaagtagtttagttgtacaatctttaagatttgttttcatttatcacccaggctatgtcgtgcccctcatgttgcacaagttaattagagcatcaacaacaagctacctatatgatttccaaaactaattttgagggattttaatccaaaaatcagctccaacagatcctctactctcctacccgagttttggagttcccttcccccggttgctcgctccgtttatatgcgggcgcgaaagtcgctcccaatcacgcaatcctgcctctctccttcgttcccgcgcgtgggagatagcgatctttctgcgcgtgaaagaaaaaaaatagaattttctcttggtagtttaacagaagggcccacttttaagttttagggattgaatttaggctatctattggacggaggtgttttttcacttcctattttcagtttaggaaaccaaaaacgaatttttaaaagaaaattatagataatctgttggtgatgctcttagtcaacttgtatcatgaaatcctctgtttcgtaaccggttttccttattgtcatgcattaattagtgcattaccacatgatctaaaaggaaaacggcttatggataaaacagtcaaactaaactcatggaaaggacacaatcaaaacttcactttcatatgaaaggggctggccaacattttattacaaggacgataggtaaactgcgactgttacaacggtagaaaaaccacgatgccgaacaaaacacgtagtgacgacgtactggaggccgggccagacaatctgcgacaaattaatcgacacggcgcgcaaatggcaaaggcgcaagtaaagtaacagtaggaagcatacgtgacaaccccttggaactcatgcagctcgatcgtcgatatgcccatgtttagttgttgtagttctcgacttgctcgttgcggtagtgctgctggccctggccctggccctgctggtgctggtagttgttgccggcggacggcgattgctgctgctgctgctgctgggcgttgccggcgtgcgcggcggacggcgggcgctgcaggctcttgacgtactcccacgactcgcggctggagatgttgttccaccacctgctcacgttcttgcgcgcctcgaacatgcggcgggagcgcgggtcggaggcgaggcggtcggcgttggggaggtgggacaggtcggcgatggtgaacttgtcgccggccaggtacgccgcctcctccagccgctgctcgtagatgtccagcagcttctccaggtccttcttgctcttctcgaacaccttccgcatctcctcctccttctgctgctgcttgttgccgttggcgccgctcgccgccgtcttcccgtccgtcgcgccggccaccacgcgcttgctcgacgcgttcgccacctggacctccctgccattgctgttgccgtagccgttgccgttcccgttcccgttgtcgttctgcttgggcatgttgggcggcaggaaggcgaggctgtagaccatctcggcgctgggcacgtcgaagctctgcgcctccgtctgcagccactgctcgatggacgcgcgctccagcgcgcccgtgccgatcaggtccgggtttccctgcctcgcgtacttgtgcgctatgtggcgaaggatccccctcgactctgcacgcatgtacgcattccacaccattatttacagtcgttcaagtgtcaatccgtactacaaatctcaatgctaattaccggacagggtgaggttgtcatcttcgaacgtgagcgcctcgccgagcggctgcacaattttccccagacgtgtcagtccgagaattgcacaacgacaatgtggtatgcagagcatgagtatacctgaagcttgagatattggggcatgcgctgcgtgccgcggtacgcgtcgacacggacgagctggaactcgacgtccttctcgaagaggcacatgagcacgcgggcaacctccgccgaggtgggtgacccgaaaaccttcacgctcgccggcgccatttcagttgcagtgggcggctagtgactctactgcaactgttggttgggatttgagaaggaagtattatgcagatggtggtgtgttcctgccgtttggaggatagcttgggtgtgcttatatacatgccaaagtggggagcataacacgctttgcttgccaagaggtaaatctaaagacaaaaatcaaaggggggaaaagagctaaagagcaaagcgctggatgccaaagggaaagacaaggctcatctctgctgccaaggttgtcttgtgcatcatatcatcatcacacccgcaagcaaccaggcgatgatgttcattagaaaacatcataatttgtgtgctttaacaagatctagtcgaaaatagcaaggtctgagaagatttcagggtgaaaaaaaggaaagggaaagattctgtttcgccttgatttgttcaagatctgcttaccaaaggaagtttcagattattctactactatatgtcaagtgcaaatatcttcagaaagaaagtatagtgcaaaataactcctagtaattctactactcatgtgctaaggtaattaagttgttgcaaatatcttgagagagtgaacatactacagcagacgaaatatatcagattaaaagagtctccagatcattttttaaagaaaagaagaatctccagaacaaaaacataacatgacaacgtgacaccctgatacatcaaacaaatctcgtttaataaagaagtaggagggaaaagagttcaacaaaacatggaacattcccctcaatctcaaataattatacactaagctgatatcatcaagctttaataaagggtatccttttcttctttttttttattctctgttcttctgaaaagaaatacagggattcatgaatttaactcttcaactcttgttactgtcatatgctaagggttgcaataccgcctcgcaacaagtttaatagtatagccaactactagctctaaattatctatagttaatctaatagctagttcatacaatagttacctgtaaacacaattaatatatgattccacctattatatacacatatatcttggagttcgtgctgcagctggctacaaatctatagcccgttggtgctctctcacatcctttatctcctcgaaatgtatttatagttgacttatagtctgctattgtacttgttctcagtttttttaacacctaatgtatagtgttaaactcaaataataaactcatctcaaaatataaaaacatgggagcattcgtagtattaggataagtctactaggttactgtattctacgataatggaggtagcaaaaaaagaatctttacatgtttttgaggttggtgacaatctcaataattgtgaggcgatttacaacaacacccttcccaacaggccaacacacgaatatttggccccactacatcgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32063 - DNA, 4994 bp, Oryza sativa
  unsure (1)..(4994): unsure at all n locations
aggcatgtggtgtaccttggcaagtgcacttgcacctgcagggaatggcaagttactgggaaaccttgccaacatgcattggcagtcatcacaaccgtgaggcaaccaaatatggagaaatatgttgataaggctttctctgtgctcagatttcaggcagcatatgcatcaaccatccctaacattacagacaagaagcaatggcctcaagttgagaaagaattcaagcttcttgctcctgtgtccaagaaaagaaaagtgggtaggcaaaggaagaataggatcccatctgctcttgagaagggcaaggggaaggctacaaggcaaattaagtgtccagaatgtggtgtctttggacacaggaagggaagtgctagatgtgaactaactggcaccaaaaagaggtgtgctgtattttcatctcaattattattcattttcttgctgttatatgctaactgtttttcttttggcaggaagaggaacaagaaaacaacaacaaaggtgggaaggaagaaatcaaagggtgttagtgatgaacaagtaactacaccaagaacaagagcagttacagctagagaaggagctgcagaaacacaagtgcagccatcacaaacaagcagccctggaccagtcactaggaggtaagcaccattatgctcttttcatttttctctagctttcattacttattatacactgaactaaacttcttttattatttacaccatcacaaacaccaggaggttggcattggagcttgaccaaagctctcaagtagctccagctatagtggagccacccaagaagcttacacccagaaaaaagctcgcaagcaagaagaaaagtgcaacaccacctaaacttttggattgaaatttgtcaacctgctagtgaaattggttatttgtggtctactatggcatgatattttggaaaaactaattgcaagtaatgtgcgatgatatgtgcactttggtatggcatattttgctatgtggtgtgaatatcttaagtgtatggcctaacgaacttaagtgtatggcctggcctgatgttgctatttctattattgtgcttttgtaatgatgtatggccttgcgtaatggcatgtaacttgttatgtatggccttcacagtaactctgaacttgatagtggttatgaacttggtagtactatttctaacgatgaagaagttattatgggataaaaattgatttttgttgcgcatgtgtgttaatgatgcagtatgttatgtgttgagttgttctcaagttattatgttttatcatttattcatgtgtgcgtagttgatttaattgtattatgttggctattaaccacttgagaatggaggggtaaaattgtcatttcactaggccggtccatgctggcatgctgatgtggtgctccaacccaacgaaagtggcaaaaaattagggcgtaatctctctctagtggtaaatatgttaggccaaatctaatagtggcatatggagagttgacactcgtaagagtggcaaatagttaaatttcccgtccacaccaccctagtagatgaaggctgtgttagttgagcgcaaaatttagattttggttgaaattaaaaatgatgtgactgaaagttaattatggtgtattaacatattggatggggaataaaaaatgacgggaagttttgaattccttcttaaacacaacccaaaaagaagaaagtggacaacatgtcacccgtcaccgacacgaatacagtaatgccaatacatccttcgtctactcaatacactgtaacactgttgttggcgataatccggcggcgtcacctgttttatacagaaaaacaccaaagcttcgtgagttcgtgtcgaccaggccacgcttcctgcacagacccgcccacccgtcgcccggcgcggcacgatggcgcacgcgcacatgcgaccgcacgcacggcaccacacacacccaaggctttcgtgtcaaccggcgcggcacagggggcgcatcccgctgcccaccatcgcgcggcgcacacgatggcggcacacgcgacctacgcgacctgggcgcgcgcgcgcacgcacgcacggcaccacacacacacacgtcccgggccccgtccacccatccacccacccggccgcgcgggcgccgcgagccgtacgatttgtctggatcccctttcccccccgcgccgcggggcggggtcgcggggatagtggtagccatcgagccgaaaggcgcaaaccgaaaaagccgtggctgccgttccagcaccagaccaccctctggtcccccacacctcgccgcaaaatcccttcctcgcgccgccgccgcgcaagccgccaagggtggggcctctcgtcgtctcgtctcctctcgtctcgggcgcgcatccccagacgcgcggtgacgccgtcagttccgtaaaataaccccgtcgctccccaaccgcttctttcgcactcgccgttttggttttcgttcgctgattcgctctcgtccccttccctctcctctctcgctcgctcctcttccgcggcgcgcgcgccggcgactcgccgcgtcgggccggccgacaaccgccgcgagggagaagccccctccccttggggggcacccatgacgtcgtgcgggtgcctggtgctcgagaaggtggaggaccacggcggcgaggcggcggggagggggagagggaggctcgcgcagggtggcggcggcggcggcggtggctgcggatcgtgcgcgggggagtggaggagccggtcggagaccatgttccccatctacgtgatggggagctcgcgggccagctccgccgcggcggcgcggggcatagtcgacgccgccggggaccccatatgggaggccgtcaagtcggaggccaagtctgaggtgagtactctcacgagatcgctctcgcggattgatcggacctcttcttttatccttctgatttgatcgcggcttttctgctactgtgccagacagactctgaattttgggttggaacgaggaaaaaatacgattttttttggtggtcgtgtttggattaattgaagttctgcatgttcttaggtccagagagttctttcggctcgatttgggtttgaggggttagaaatgctagttcacttgttcttctgagttagcacttcgctatattgtcttctgctttcacttgtgttgagtgagttaagcgcagttgggaaatagcatgaattgagtaatgtttttttaaaattaaaatttagttgccttgacccttgtgagaaaaaaaaatgttattagtatattttgttctcctgaatcagttactattgtgtaggagtagttgccagttcagtgtagccaagtaattcaggaggcaaaaatggtactccagttaaaaactaggagtgaagaggcaagtagtttattatagctaatttatctgattagtggagaactgaaggccaatatcgcaggttcggaagcatatcagtgactgtgtgaaagtttagtttctttttaataaaagaccaagcaataaaaccaagctccagttgcatgcgaatgagttttaaacntntttttacaaccattgagcgtnancatcgataaacgtggttaaatatgactttatggttttttatttatgatagagctttagttttatattgttgcctcttatactgttcacaggcagagaaggaacctattttaagtagcttcttgtacgccagcgtactatctcatgactgtctcgagagggcgttgagtttcgtccttgcaaacaggctcgaagatccaacattgcttgcaactcagttaatagacattttcaatgatgttatgatgaacaacaaagatatacgccgttctattcgccttgatgctcaggtgagcattgttatagtattattctgtggatgtaccatgtttgtgtaattgtgtttgcatgaagcttcattctgtattatcccattgatctcttgacaactataaaatcgctctgctgattcaggcctttaaagacagagatcctgcctgtgcacaatacagttgggcattgttgtacctcaaggtatgtatttgctagatacttcgattcagccttatgtgtaataagagccctctgcgctacaaagaaaacacaatatcaacatatatgaagaactctaatgttgcttgtgaaccacttcagggttaccattccgtgcaatcctataggatagctcatgtattatggaatcaaggtcgtaaagttctggcattggcactgcagagccgtatcagtgaggtgaacactgatttctttatgaagcatatttttacattgctttagcaaatagttctgtttcagtaacatttggtatcatattcctttcaggtttttgcagtggatatacacccaggtatatgattgttctgtaatgatgtatatttgcattttcctggtctgctagtgtgtttaacattcaagtgttgtatggtgatatgcgatatttagcctgttttatcatctttggcaggacaattttatgtcactcttctagttgataattgttggttctttttatattgcttttaaaatttgatttttgaacagtgaagttatgaacatttgtggtttatcttttatgccttatcatgttcccttttttcccactttatcttccttacattctttattactaaatctgcagcggccagaattggagagggaatattgttggatcatggaacgggtctagttattggtgaaactgccattgttggaaactgggtttcattaatgcaggtgcccagcataactcagtttttgctagctgcaaaattcaaaataaagcagtacttctagatgcaattttagttttgagcactacaacaggtgtgctgattatacatctaatgagttggtaaaacatatatacactacaatgtgccgagataggtttataacaacaatgacttcgatatggatgatattgtttggataccgaaactcag

SEQ ID NO: 32064 - DNA, 18277 bp, Oryza sativa
gtagtgtaaattttaagtatttggattttaatggagatattattttttttctcatgggctcatggcatcatgtttcccattaaggtgcttgatttagtgacacctggttatgttcatcccagactaatctaagaatatatcaaccaaaataccagtgcctggtgaagaatctttctcttgtgctcagcagattatatattccctttcacttttggcataccccctaggaaaggctcttcgatatttcctgggttaaggagtccttcagttgtgtcttattgtcttgcactgaaaaataatgcaaattatgccagcaggcctttacatagtcaaatccccaagtgatcgctgtaatatgtattttgtaatgaaatgcttatttattttacacgtgtgccttttttttgctgcatgtttttacatcatttttattttgatgagtacaatagtatttcagtcaaattgatctgacctttttttttatatataatgtttaaagtatggcagtaggaaaccctgcaaaggtagttgggtataaagataaggaagacccttctttaactatgaaacatggtaagtatgtgggtgaaatttttgtgatccaatgttttcaagttaacttttagctacatgttaaccatatgctaacatttttttctgattaaacgccagatgccagaagagattattttgagcatgttgccgttagtttttcagatgacaaagctaatggttagttttctattgtcagtaatacacattgccttttgtccattttataacatgtgattttacaaagacttcctgcatttctagaacaactcacccgtacataaataagcaattttgaacccatcaatcatatacctaagggtgtaagtggctaacccgtgaacccacttataggtcaaactaagcgggtaagtggcttattttggcctaaaagtgggttttgcggattagtcgttgacacccttattagtatctacaccttcctgtgaaaagaaatgtggttgtgtttgatgcacagtaattttaggaccctgtctgaatccatgttctctttccaggaagtgttgtgaagtaaaaaaaggttcgatgatgtttggctggcagttcaaaggaatagcatatgtttcgacatttcttcccagaggacagcactgggtatctgattatgcaagggtgcttctcttttttgcccaggtacccatggtcctgaagctccccagttatattttctcgtggcctttggaccgctgtaataatgtgatgtttatttttctggttactttgtaaggactatgtactggtagtggagaccagtacatagttgctactggtagtagagaccagcagcaactatgtacttcagaatacaagctttcttttttgaatcccagtagcatcagcgtagtgcttaagacttagtgcaagctttcttttctgaatcagtagcgtgaagtatattctacagtactagcctattaggtaaagatgtttttcttttgatgtactaacccatcagaaaaaaaatgttacatctggatgggataataaaaaaggaggcaattgttaaattcaactggttttgtgtgatgactggcgttctaacgccgtatgtagcaaaggaggaatctaaaatcatcgatttgacaattccactcgggacaccgaatccatctgatgctgaagtgctcgtgaccagaaagcaacaagtcgccgttgtacacactccggcttgccaagtaggccgcgccaatgaaaggctcaaagcccaccacagcaattaggcccaatacaatgcagacccaaccaggcagctgcaatgctgcacgaccaggtctcgtttagtaccacctcgacaactcgaggcgatggggatgggagcgcctgctatataagaggctagtggtgcgtcgttgcaacatacttacctggacggggtcgacggccgatcaagaagggccgtggcctagatcaatggctcacattgcacttggtgagcgcgttggtttaccatctccccgagtgggagagtggacgtcataatttgtggtagagggggtacgcgttcgcgcggcccctgccaattacctaaatttaaaatttggtccctcttgtttacttacaggccctttgataagtaagttgacgggtgctatgtgctactaccatgaggtgaagctaagcggataagcgagagattaagctaaaatattcccatcgaggtggtcacttgcctactacggagtttcgtatttaaaaaaattttgaaaaaaaataaaaacaatattttgttcaattttaaatctgtcttattttattttttttaaaaaaataaaaatataaatcacgtatagagtattattcatgttttatcatcttataacaataaaaagttaattattataaaataatagagtattattcatgttttatcatcttataacaataaaaagttaattattataaaataattttatattagatggacgataaaagttagacacgaaaactaatagttacacttaaaatgtaatttttattaattataaaataatttaatattagatgaacgatcaaagttggaaaataaaactcatagttacacttaaaaatagaacagataaaactcatagttacacttaaaaatagaacggatgtcgtattcgcttgcaaatggtaagccgcagctcatcggcagaaaaagctctatcattcattccattagaagaaaggtctagatgagaggctgatgcagaatagtccaattcgaagaaaagcccttttccggggtcttttggctttttttcagacctgtacataattctgtatatacttttactctctctattagaccttatttggatgggatgtcccagtcacatcggatgtttgacacagattaaaaatattaaatgtagactattgacaaaacatattctataactctggactaattcgtgagacgaatctactgagcctaattaatctatgattatcctatgtaatgctacagtaaacatgtgctaattatagattaattaggcttaaaaaaatatcacgtaaattagctcttatttatgtaattagttttgtaagttgtctatgttttatactcaaaattagtatcttgtgatccaaacaccaccttaatatactgggcaaagcttctgtactccttacaaaaaaaaatcgaagaaaagagacgatatgccgatgcagaaaaatccagctcatatggatgcatacgctgcgtccctgccggagtgaacagtagcctcacacagtgacacagacacggctatacaagatgacagcgtcactggcacagtcacacaccatgagagccgcatcccgtgcgttgcgtaggctagctcgccgcatcagcaccggatcaccaccatgtcatcaccaatctccccaagattattcaattcctcacttggattatactactaatctcgcctccccccgcgcgattaatttatcgccatggcgccatcagcgagcgtttacttctgccagatccagcgcagcatctctgctattctccagcctcgcgggaagggagggggaggccgaaggggaggtgctcgacatggaggccggcacggtgcggtgcgcggcgaactacgcgccgctgacgccgctcagcttcatccagcgcgccgcggcggtctacggcgaccgcgccgcggtggtgtgcggggagaggcggcacacgtggagggaggcgcggcggcggtgcgtccgcgtggccgccgcgctcgccgcccgcttcggcgtcgcccgcggcgatgtggtgagtggaaatagtacttaccaacacgagcttcccgtgatttgatctgttcctgctttcttttcgtcttggcttatcgtggcgtggcgtgtcgtgtctgcgagctttgatgcggcgattaggcagtttagctggtgtttggatcagagacttaactttagttcctatattcaggtactaatttagagtattaaatatagactacttataaaacaaattatataaatgaaagctaatttgcgagacaaattttttaagcctagttaatctataattagagaatgtttactgtagcatcacataggctaatcatggattaattagattcaatagattcgtttcgcgaattagtccaagattatggatgtgctttattaatagtctatatttaatatttataattagtgtctaaatatttaatgtgatagggtattaaaagttttagtcccatttaacagggccttagtttagcctacgtaccatgcgcacgctcgtgttgaagtcacatgattggtactgacaccgtgacacggtgacaccgagtaatcgtggcaaaatcatgaaactcggcgacgcgtaatgttgcttgcaatcattggtttcacggggacctccattgggagtttctggagatgcgtagatggataagcttaaggtctcggtcacaaactcacaatcacagcccacttcattcccatccttgtcggtccatttgatgatccaaataatctcggcctgatttaacgattagcatttacatctaacgggccaatctagtgaaattctgtaatgtgcaaggcccaatcacatatattttctcgtggcctagcacctccgtaaatagtggagtaatgtccttgttatgtcaaagccatagcggcatagcgcgcgccctgtacttttgaagcagggcgagaatacttaagctaggagtctcttttccttctgcccctctccccgaaacgacttgcatatgttaagcaagctagcgttccttctgagccaggatcataacttgttaggactggttcattctgtagagaccatcagcaattatgtacttcagcgcagtgcctaaggcctagtacaagctttcttttatgaatcttagtagcatcaagtattggtttgggcttgtttaaaattttcattatgtggttctggactcactgtgtgagtttgctattttgtgaactatgtaataattggttgtagctcgtttgagtaaaggccgggatatttgattctattatctaaaaaaaatcaaaaaaagaaattctaccgtagttagcctattgggtgtgtttggataatggaaaataggaggtgggattgagattgagaaatgaatatagggttaggattaaatggaagaggaataatgaatggttaagatttaaagatatcttttggttggtgggaattcattttctaatcccattagccaaacaccgcaattaggtgatgtttctcatttaggtataatccgtcagaaaaaaatagcacaccgtggatgggtaataaaaaggaggcaagtgttcaagttcaactagttttgcatcttcctaacgccgtacgaagcaaaaagggaattcatccacaccaaatccacatttgattaagtgtggtgatctgaaaaggaaaaaaaaattcacactgactcccttacaccaaatctaagggagtccgtattagattcggcctacttaagggagtcaaagtggactttttccatctgaaaacaagtcgccgctgttcgttcacactgcagcttgccaggtcgccccaatcaaagcccaccagggcaagtaaagccccaaagacaatgcaggcccaaccctgcggccgcaatagcaatcctgctcgagcacggccagctctcgtttagtaccacctcgataactcgaggcgatggaggcgggatggtggatctaagtggagtgtgactgtgtgagggagaggtgctggacatggatgccggcacggtgcggtgcgcggcgaaccacgcgccgctgacgccgatcagcttcatccagcgcgccgcggccgtctacggcgaccgcgccgcggtggtgtgcggggagaggcggtacacgtggagggaggcgcgggggcggtgcgtccgcttggccgccgcgctcgccgcccgcggcgatgtggtgagtggaacaccaatgctgctagctcttttagcttatcgtgtgcgcgagcatttgctacttagatgtttcttcttttgaaccaacaaggtaggaagtggcggatgcagcttagatcgatggcccgaaagtttttggtagaaaacttgttaagtatgctaaacatatagtttacgagtaatatttccgctaatctttgccatgagcccatgaatagttgaagctagataacctcacgtcctcgcggatcttctcctatcagtactcttgatattaatgttctctctatgcatcagcatgtaaacagcttgattttttgttttgagaataaacagcttgattcagttagcgataaagcttctgcattgccgcgtatacttcttcagttagtgggataattttaccttgctgctaatatcctcgtgcattgccgctatttatatttttgcaacgccagttataaatctgagtctacagtctactgacaccgagtaatagtagcgaagtcatgaaaactctcgatcatgcgaatggccttctctgcagtttagatctttcacttttatactttcagtatgaactgcgaagtaatgtggcttccatgcaaattattggttattcggagatccataggaattctggagaaaatggtaaggattttaggtcccactcacagtccactccacctcttcatgttccttggtcaggccactcaacgatcgaaataatttcgacctgatttaatcatgggtcagtctgaaaactaggcccaggcgtatgacccacattgtcgtgtgtcccatgttcaggttgctgtcctgagcccaaacgtgccggctatgtacgagctgcacttcgccgtgccgatggccggcgcggtcctgtgcacgttcaacgcgcggcacgacgcggccatgatctccaccctcctcagccactccggcgccaaggtgttcttcgtcgagtcgcacctcctcgacgttgggagagccgctctgaggcgcctcgccggctcaaccagcgccgcgagccttccggttctcctaaccatctccgacgacggcgccggcgcccgcgactcgggctgcgtggactacgaggatctcgtcagggacgcgccgtcggagtttgacatccggtggccggtggacgagatggacccgatcacgctcaactacacctccggcacgacgtcgcggcccaagggcgtggtgtacaaccaccgcggcgcctacctcaacaccatcgcgacggtcctcgcgtacgacatcaccgccatgccgacgtacctgtggactgtgcccatgttccactgcaacggctggaacctgccgtggggcgtcgccatgcagggcggcaccaacatctgcctccgccacttcacggcgaaggtcatcttcgacagcatcgcgcggcacggggtgacgcacatgggcggcgcgccgacggtgctcaacatgatcgccaacgcgccggccgcggacaggagggctctgccggggcccgtgcgcgtcatgacgggcggcgcggcgccgccgccccgcgtcttgctcgccgtggaggagctcggcttcgtgctgtaccacatctacggcctcaccgagacgtacggccccgccaccgtctgcacgtggatgccggagtgggacgcgttgccggcggaggagcgcgcgcggctgaaggcgcggcaggggttccatcacatcgcggtgcaggacgtcgccgtcaagaactcggccacgatggagaacgtgccgtacgacgggcagacggtgggcgaggtgatgttccgggggaacacggtgatgagcgggtactacaaggacatcggcgcgacgaaggaatccatggccggcgggtggctgcacagcggggacctcgccgtgcgccaccctgacgggtacatccagctcaaggaccgggccaaggacatcatcatatcgggcggcgagaacatcagctcgatcgaggtggagtcggtgatcttcagccacccggcggtgctggaggcggcggtggtggcgaggccggacgattactggggggaaacgccgtgcgcgttcgtcaagctcaaggatggcgccaacgccacggaaggcgagatcataagcttttgccgggagaggctgccgcattacatggcgccgaagacggtggtgttcgatgatttgcccaagacgtcgacggggaagacgcagaagttcgtgctccgggagaaggcccgggccatgggcagtctcaccaagtctgccaatagtaaactgtaatatcatttctgttgttggacattggatgggatgccgtagtatgcagagttccaaagattattagctgattcgaggggttttgccgatttttgtcattaccactcgaaaacctgtgaattttgaacaaaatttaccgaacgtctgagtttaagtttggattttttttaaaaaaaatgattaatttatcgagtggtttttcaatttatactatgtcagctggcaggttgccaccaatccctgtggcaaaatttgatgttggccaaatgacttatttatcttagtggcttcaccaaaattgtgcccatcatgtggctcctattaattttactttcagtaaattgcatattggagctggtatttttacctaagattcaccatgaaccaccctatccttgatcttttcactttaaacgagatatatttaccaatactatgtattttgaactagtggcgccaggggcggagctagaacgaaatgaagaggggtgccactcacttgttttactctactttatacttatataagtgtctaagtttgaattgagaggggtgcacatatagtgaaaataaatgaactatagctaaaaagttttcttgaccgggttcctgggcacccccccctctcctacctagctccgcccctgagtggcgcactactccctccgtcccaaaataagtgcagtttttatcctgttcatatccaacgtttaaacgttcgtcttatttgaaaattttttatgacggacggccaaacgttggacacggatccacggctgcacttattttgggatggagttagtaccaattagtgagaatagaggcaataatgaaagcaaactccatggagagggtgtcggcaatctcttcctcttccacacctcgcaagcttttacttcgacgcctctcttagagcatcaccaatagttcccttacttcacccacaatcctatttttttagattttggtgaaaaaaaaagtctccaatagatgtcctatccggatccttttttttttggaaaccccctccccgcatctttcactctcttcattcgagggagagagatggcgcgtctgccgtccccaatctctcattcgcgccagatttttctcagtgaggagcgcgggcgcacgtgagtgggaggaaaacggaatctgatgttagtttaacaaaaggatcctttttaatttttggaataaaatttagatttctcttggagatatcagttttttcgctacctattttcagtttagaaaacccaaaaataattttttgggaaagattatacgtatctcttggtgatgctcttatcgccccaaacccacaaaggccttggattgagctttggggcaagaagagtaggagataagataaggatagaaggtaaccttggagccacgaattgaagaaggagctttaggaaaagagcatgtgaaaaatgaaggcgttggattgagctttggggcaaaaagagtaggagataagataagggtagaaagtaaccttggagccatgaattgaagatggagcttaggaaaagagcatgtgaaaaatgaagaagtagaagatagaagtgagaaacgagcgcagcttcgtatcagtgcacaccgaattcaaatcgctcgatgatatctaggaggggatccaaaaggtatgtaaagggagcgagacgaagacaatagtgacggacaattcaacgaccattccattatcctgtagtaatagcattcatcagttgaaaaggccgacattaacgtacataacgctgacacaattctgcatttctagcttgctctgaatagttgaatattgtccctctgtctcgatcaaatgctcttggcatttttccattgcgccaactggaagtgctttcgaaaaataattccactagcatgatactcattgagtgacccgtgatgtactacgtattctcagcgtctcacacctcctgcgtttcgtctttaatctaaccggagtgcacacatcaagtatgcaattaattaatgcacgcgaaagaagactgactcagatggagaacaacgttttggtttagtgttggtcatccgtttaattatcctccaactcactttggacaaatcggattgcattagttgcaattggttcttcttcagagaggctaattagtgtgacaaatcgatcccgattgctggtacacgagctgccatggaaggctgtatgccgagcgatgcaaactacgcgccgctcaccccggtgagcttcttggagcgcgccgccgtcgtgtacggtgaccgcacggccgtcgtctctggcggcagggagtactcgtggcgcgagacgcgggaacggtgcctcgctggggcgtccgcgctcgcgcgcctcggcgtcggccgccgggacgtggtaagtgatcgaccagagcttgatgcctcgatgagctttgtacttggtgccaattcagctctcaacaagacatgggttaattgctggtcaggtcgccgtcatcgcagcgaacattccggcgatgtacgagctgcacttcagcgtgccgatggccggcggcgtgctctgcacgctgaacacccggcacgacgcggccatggtgtccgtccttctcagacattcggaggccaaggttttcctcgtcgaatcgcagttcctcgccgtcgcccacgacgccctgaggctgctcgccgatgctaaagccaaatttccccttgtcatcgcgatctccgacaccggcgacagcagcagcagcgacggtggcgggctagagtacgaggcgcttctgagggacgcgccgcggggcttcgagatcaggtggccggccgacgagcgcgacccgatatcgctcaactacacgtcggggacgacgtcgaggccgaagggcgtcatctacagccaccgcggcgcgtacctgaactcgctggccgcgctgctctgcaacgacatgacgtccatgccggtgtacctctggaccgtgcccatgttccactgcaacgggtggtgcatggcgtgggccacggcggcgcagggcgggacgaacatctgcgtcaggaacgtcgtgcccaaggtcatcttcgagcagatcgtgcgccacggcgtgaccaacatgggcggcgcgcccacggtgctcaacatgatcgtgaacgcgccggcgtcggagcggaggccgctgccgaggagggtgctcatctcgacgggcggcgcgccgccgcctccgcaggtgctggccaagatggaggagctcggtttcaacgtccagcacgggtacggcctcaccgagacgtacgggccggcgacgcggtgcgtgtggagacccgagtgggacgcgctgccgctcgccgagcgcgcgcggatcaaggcgctccagggggtgcagcaccagatgttgcaggacgtcgacatcaaggacccggtgaccatggcgagcgtgccgtccgacgggcgcgccgtcggcgaggtcatgctccgcggcaacacggtcatgagcgggtactacaaggacgcggcggccacggaggaggccatgcgcggcgggtggctgcgcacgggcgacctcggcgtgcgccaccctgacgggtatatccagctcaaggatcgcgccaaggacatcatcatatcgggcggcgagaacatcagctcgatcgaggtggagtcggtgctgttcggccaccacgcggtgctcgacgcggcggtggtggcgaggccggacgaccactggggcgagacggcgtgcgcgttcgtcacgctgaaggacggggcaagcgcgacggcgcacgagatcatcgcgttctgccgtgcgcggctgccgcgttacatggcgccgaggacggtggtgttcggcgacctgcccaagacgtcgacggggaagacgcagaagttcttgctccgggagaaggccagggccatgggaagcctgcctatgcaaagcaaatccaagttgtagtcttgtactattgtactagctgcgattggttttgctgccaagatgacagcgccctgcacgactactccgatattttctgatgatacagtatttgggaagaccaacacggatgttgcataaattccgtgttaaaactgagtcaagtgcagcatcatgtaggatgcacttaaaagtaatcataaaaaagaatataccctcttattcggggaaaatgaggaatataccctcaccgtttttaaacacaccctcctccacttatatatgagttggttaattcattttagtgaactatccaacgtcatatataaatgaaaggagtgaatgcatgacatggacttttgaaaatgatattgaaccattcaacttatttagaaacttaatgcaaatatgtaaaatatgtcatgcttaaagtatcttcaatactaaaaacaagtcgcaacaaaaataatgatatcagaaagaaactagtactagtttcgagcatttgcctgagacttgctaagatcaattttgctttatgcaaggcttgaagtgtagatggaagattggaaggtgggaagtccattcatacttccgcatggtacattatatatccatccagaacatgtaacgcctataacaaaaacatgtgggatctttttatttcgaataatcctatctaatgaatattccttttcagatgcagatcgaatacaatacatcgacgttttattcaagcagccgtacaagtgccactcatcctctaaagaacagagtcaaaactcaaatttcaaagctggataaaccagtcatcaaaatctaagttacgacaacaatcatatatcgtatacaacaatcatagatcgtagagaactctttgaaatgtaccatctagagttgcagtagtctccaacatcaaaggaaacagataatgatcaacaccatgtggaaggagataacagacatgctccacatggacctagcgaactgcgacctcccagatcctcctcctgcaaaatcaactattagaaacctgccgtttctttaactcaaacaaactcagagactctgagtttgtacaggtttgcgggctcaacttactctggcaggctgttgtctgattagttgcaaggctggtttgtatgatgagcgatgaactgttggagtaaccactgtaggcgcacgttgttgatccgcaaccggtgccgttcgtctcaccaagcttcagcgttccattgcacagtggcactgacgggcatcccttgttctgtactgcagtgcagtttagcctggttgacacagtgaaaagaaatgtaaattctttggttactgcttgatcagaaacaacttagaaggagatggaaataataggggagcatactggtaggtagttgaactgcagctgcagcggatgcagtttcctgcggtgaatccataggtgccatccgggaggagcatcagattgtgatcagctgaggtatcgctgattgatgaacggcacactgaggacaccagttttccagaagttagtactaggtctaggaactcgtttcatatgacattcttaccgaagaaagtgaatagtagtaaacatcaagatccatctaagatagtactataatagtatattttgaaaccttgtgagtagcgagggtcaactttgtggattggtattggtagtttattccgtaattttaaaccacaaagtcagatagtttgtccggtgatagcaacggctaactaattatacaagtccaaagagtgcaggaattcaagctctaaagcttaaattcctcaacattgcgatggaattttgtggctttctactcatgtgctagtggagctatgtgtcatgttgtctcaatctctcaacgatcgaagcatgtgcagctagctatcttttcttgagagcaactttccgagtcacaaccagatattttgattctgataaactccatcatgcaaggggaccatagcctaagttcattgcaaataccactgaatccgagcaatatattatcagcatattgcaaataatttaccatacctaacctaagtttaatatgcaaactaacagaacaacacagctaatcttcagtctccccagtcaaccatgtagaggtagtaatacgagtaaggccgtgtttagttcgtgtgctaaaattttcttgaagtatacggacacacatttgaagtattaaacgtagactaataacaaaacaaagtatagattccgtatataaactgcgagacgaatttattaaacctaattaatccgtcattagcaaatgtttattatagcatcagattgtcaaatcatggcgtaattagactcaaaagattcgtctcgcaatttacatgcaaactgtgcaattggttttttttttgtccatatttaatgctccatgcatatatccaaacatttgatgtgatggaattttagaaagtttgaagtgaactaaacacctgcctaactaattcaagtttcttctcttatagtactagtaagactagtctactgagaaaattcactgttaaacaaaaaacttctgagctcgatcacaagattgcaagaaccatactaaacagtaacagcaaggcacgtaccagggagcgggacatctagaatctgtcccatctgcaatttcgtggggtcgtcgatcttatttctggtgagaagcgtggactccgtcaccccgtacttggcagcgatcgccgacgtgttctcccctttgccgacgctgtaggcgaggtgcatcacgttagagccttcctccttgtcgcagctgcagggcagcggaatccacagcgtctggctgacatttatcttgttggggtcggggatgttgttcgcggcggcgatctcctggtaggtgacgaaggcgttgaacacgttgcgcgcgatggcgtcgagcccgtcctgcggctgcacgacgtagatggggaggcggtccgactggccgacgtcgccgttgcagcggcagcggaaggggattttgacggtggaattggcggcgacgggggcggaggaaagcgtgccgtcggggaggccgttggcgccgaggaggtcggggagggtggtggtgttaaagcgggcgacgaggttgccgtaggtggtggcgttgggggaggtgtaaaggatggcggacttgcaggtggtgcctgaagccaccgcgcaggtgaagttggcggcggaggcgggggcggcgaggaggacgaggaggaggagggcagcggccgccggcgtggccagggcggcggtgagcgacgccatggtggggaaagctctcctcgagaggtgggaatgagaggcttggtgtttgtttgactgtcgtgttgacactggagcaggaggagtatgcctcgatgctagtgcttgtggcgacttaaatggttgcagcgtgggcctttccctatcctttggttcgattgcatcaaagtagaaaatggtgaacttgtgtggaattgattggtttgagtcagacttggagaacaaaaaatcactgaaatttcaaaattaccgatggaaatttgactacaaacgttagccatgcatgcagcttagcgtcttcaaggggagcttgactacgctaagactttggcaacccaagtcaggctaattaaattgcacaagaggccaatctggacttcaaagtcacaaatgtgaacgagtagcctcgtccacggcagcacacttggatacaagcaggacagacaggccggagctggatgcgaggaaaatggaaacagcagggcgaagttgacgtctcttcgccacacaaaccaacagccaaacagaggtgtccacatcgcaaggcaatgctaaaaaacgcgtggatatcattgagagctttctcctccgttatttatacggagcttttatgcaaaaatgcacatggataagcatagagacaatatgatcgcgagccactgattatttcgcctaattgatcaaacagcagtccggaacgataaaacgctaagccgcggaaggaaaacatgctacgaaagaatgaatgaaccaatgaacgcaatactgcggttgatcccctttctacaaagaatgttccccttacaggcaaaattggaaacctatgcagaaaagcttctcttttgtactggcacaggtatgactcattccagaggcgaaggaggcatgcctggtggatcatccgaaggtggagctggagatgaagcgctgaagtcaatagttgggtacactcctggtggcctttcgacaggttgtatcgacagaagttgtgttgagtctccaacgacatcagcccatccgtaatgaggctccgccctaattgacaatgcacagatcaacgccaaattgtaaatctgaaaatactccgaagatgtctggaagaaccaaacaagacataatcttactcgtagtacgtctcctcatcaactaccaaatcccagctctcgccagttgtgctcttgccgtatttatgaacttttctgaaatacaagagaacaacagtatctaagaaagctactactgtaatgccaggtagtatcgttgcaagaagaaccattgcagaatgacatatagtgtattagaaaaggacaagcccatgtggtttcaattcatttattaatgtcaagtgtcagtcaaaccaaatgcgagaccagcgtcatgatggaacatacccattaccaaaatgctcttctccccaagttcttgaccatcctgaaagtatcaaatcagataagtggatggcaattggaaatcagataagtcataagtcacactacgagcggtgcacacatttaacaatgcaataaacaggatctaacttctaaacctgagtatgcagacagtagatacagctcatatataaaagcaacatgttaaaatatccagcatagcttccaatagattgcaccagtgtgaatttcggccaatgcagcaggcaaactttttctatgcatcaaaggtccaaaggtgcttagcatttatgcctaataccagcatccaaagagaacaaagcccatcatcaaggtggatactgtgcatatatataaatgacgatgaaacttacgatctccaccaggggatacatgccatgtctccccttgtcgagaaccaattccagcaaagaatttctcttcccatttgtccccccatttggtgcctaagtctgtctctgcccacttatctgtcctgtaatacaaatgaattgcagtggttaccaattaacatacatcggatgttccaatcatgattgaacaggcaaataaattaaaagtataaagaacttgtgcctcaaatatgatgcacaatgtaaatgcacaacctagactacaaatttaggccacaatgcgcgcagcataagaaacatgtaatacaatgtaaagtgtatggtatagtgcttgaagataaactaaagtacagtataacaatagtctgcaaaatagcactatatatataggctcaccatttcaatacaaaaccccggccatcataatgttcaccccacctctcccaccaggattgttcatttaatcttccgtacttatgagcacctttttctgtccagcctttggcatcatatttctcccacctaggaaagaaacatgaacacttcaacagttcaagcaaatattttgcagaacaattgcaaccaaacctaaacgaaagcctgagataactctcaccatttttcataccacccagcattttctgctcctgatttcgcttgcttttcagcgctcctctctattcttgcaagattgctgtttgcacaatgtaaatcatgttatgatctacagtttacaatgttgtgctagatggtcatttattaactaatctatactttctatatagttggtacccactaaagctaaagctaaacatgcaagcatgccacatcatcatccactagccattactattctaacccatttaaaatcccatgcaagcatgccacattttcactcactagcaattactattctagcctattttaaatcccatgcaagcatgacatatcatctataatattatattatagagatcaacaagtatgtatcaaatcatcttcctcatattatttttttaacatttcaactttcatcatttcgacaatatttaacatatactcattcgtgaatcccgcagcaaag

SEQ ID NO: 32065 - DNA, 7895 bp, Oryza sativa
atggatatatggtcaaacaaaattgttccaaacagacaacaagaaattgcaagcgccaagcgcttaacacaatcaaagttctttgttcacagaagtataaccaaggggtcaacaattgtcctcccccccccccctccccaaacaattgttttcttcagcaggcagaaacaaagaacagtaaacttatttttggtgacaaaattagttaaaattcagtggagattatgtatttttgtattatttaagcaaggagctagtatcattaaaaaaatgaatttgcatgctaataatttacctccattcatcttggtaaagaacttctttccatttctcccaccaagaatcaccttcaccattctttccagacttctccgcacctaatgtgagagatttgtaatgaaaagtcaacgacggctgatcagatatgcaaaaggaaaagggcacacataaataagaaaattaactgaattcttaggaaatttaacaacaaattacaaagaccatttgctaccagagccttcattataaagatatgttcatacctaactccttatatccggtccaatcacttttctcccaccactgccacataataaattattgagatctgttagaaaaaatctttttaacaactcaagaattctgtccagcattgattaatgtgccaaaagagttagctacggcctatgaaatcctgggagattataattccaaatccctattctcagtcaagtaagaaagtgcaagttggatctattgcagagtgcgctatagctattggaacaagcacgaagcaacttgcaggatggcagacatatcttcgattctaactagtgccacaagcatcaacaacagctcattagcatcagaagttacataaagaagtcattggaatataatggctacatcccagaaatcttttctagatccttctcatacgaaaatgtggtgtttgcacaaaactgagatggtaactcttaactcaggtgcatcatacaaaggtatacaacttgataaatttgtactagaatattatcagttaagggtaaaacaacaagaacataccgtctctttccattcagtggtaccatcatgactctgtcctcccatcctagcccagcgacacctgtacccattatcaccacgatcgtctccactctccctgtaccaggtgcttccatcttcatttgtcccagactccttgactgcttcatccagaaggttgattccccattccttctcactagcaataccagtgtctataaggcaggtggcaaagaaaacaaatgcatttccttagcaaagctgaaaaatacacttggaactgcgggtcgggtgtttccttttggagtacactatgtctatcacaaaatttggaagtatcagcaaggaacccacctctcttcggcggagtatcacgggattgaggagctggccctcttggcgtgcaccgtggatagaaattctgttgtttccactgcctcctagaactatactagtgaaaacaaagtctaccatcaaaattcattctctgaacaaagagcattcgtgcaacagcagaaaggtacggtttattccactacataaagcgtgtgtcaaaagcattggcacattaacttgtcactacgacaattcagcataaagcaaaaaacaatccatatgttggaatgattagacaacatgttactgtaagtggcaaatgcgaggcctgactggataaggcagaaaaatgggccatgttcagtgacgagccgccgtgcacgtaccgaggagaagggaaggggagtgacggcattgcggtgaggctggcgcgacgcctgccccgggcggcagcggcgggcttgttcccgtcgatgcgccactcctcggtgcgctccggcgcggccgccgcggccttggagaggcgcctccgcggctcctgctgcgcgcggcagcagcatcggatcgcgcggcgtcgcggggcggggcacggccagtgcgccgcccccctcgcggtcagatcgaacggccgcgccacgagccccctggagcacgcggccatcttctcatgccacggcgagggcttcaggagcggcggcggcggcggcggactggctcagtggcggcggtggtgggagcccggaggcgagggggagggttttaaaggggcggtggcgaagagggaaaccgcgggcatcatccgaaccagcgagagagcgattgattgcgaatcagctcgcggaaatgaggagacataaatgagcaagccttttttttcggggcttttatttggatttgtttaggggtgggagatctttgcaggtgggggagaggagtggcgatgaggaggaaggagaagaacatggggcttgggaagaagacgaaggatgctggtgggtcccgcttgtcggtgggagtcaagattggcagtaatcaggaggggaccccccgatgtgggcccaccgcaaggatgccaccgtgtgctaagtttgtggtgatcggtacgcagggagccgcacggtcggcccggcccaacaagttggccagcctctctcccctactcttctggaaactaatgaaaaaaagcattttattttgtttgtgataattcacacactttatctgaaaatgcagtttaaaatcggtagtggaatcccaagacgtgagctcaaattgttttggcactcctactagaagaccccgtcccatgtcttgtgctgcttgtgtctcacgcacactagcaaagataaaattattattatcacgcgacactggtccctatatacgcacgttgggctttttactttgttgtaatttttaaccttaccaatatttagtattacaaatggcggtaccatttgctatattttggtgggattaaattttgatagtgtcagacttcagtttaaagtcttatgtagagttttaacagtggaagctttgggattttctaaaacttcataagaaaacaatgataagaatttgtttagtctatttttcaactaaattttacaatgctaaaattcattagaattataaatgaaaataaagtaaaaatttttaaataatagaaatggattgtatctctgatctctgcctgtgagcatacaaccaaaaagtctcaaaaataaaaagaaaagaacttaagaaaatgtgtgatgggttaaaccttcaacttctgacaataagatggtatactaaaataatgtttttaaaatcatatatattatatcataaaattaaattccataaatcacgtacgctaaagcatagtatagcactgatcacggatcacatggcctggtctatcttacgtggctccacgcaaagtcacagcatgtggacaaaaagcgctcctgtcccaagtggcgaccaaccaggcggctctactgaacccgatcaggaccaggccagagaccgtcgcgacaaaaggctacgtggaaaagcgactcgcgtgtctagcggccacggatcgtccacgtcacgcgcacgcgagagtgaaacggccggctcccgccacaagcgcggccaggtgctgaggtaactcgtggctcagcgcggccggtgcagatggcgcggcgccgtggaacatgtctcctacctccccggctttggatagatatactggataagcattgaccgtggagacactgacacggtgacacgcgtgttaccgtcgagaattttggaggctatctacgcttggctgtggttccgcgggcctctgccgtggccatggcagcttacgttgttgtcgtggaaaagtggcagcatctatccagttaaaatgttttgtgtcatccaaacgtttattttagtaagatttattttagctaggtagtggtgaaaatataaagcataatgaaaacaaaacttcaaaatcatttaaaaattaccatatctgtatcttaatataagagattttgatattttatttatattgtttaaccatttatcttattaaaaaatttaaaattattattattttatttgtgacttactttattatcaaagtactttttattatcaaagtacttttaagcacaacttttttttatatatttatataattttttaaaatacaatgaatggttaaatagtgcaagcaaaatatcaaaatcctttatattaagggatattaattatattaaaggatattaagggatgaaaacggtaaaattttgcgggctgataagagaggttcctcgtgactttattatgatccatgggcacttggtcagattagcccattggcaaggtccataagagttagtaggccaagactaacgatctccggttggtaggccggtagccttattgggccaaattacagcaagtaaacttacatttattcgttacagcgtggaacgacctatgcacatctttgttccggaccaaactgcctgactacacgcatacaccgtcacggcacggacacacacaacaaactactggatgtaggactggccggtgatgtcgaggtcgcggtcgccggtggacggcggcggcgcgtgcttgggcctgacggcggcctcctccgggccgtcggcgctctgcgtggcgctggcgcgcggccgcgtcgggtccctccgcccctcgttggcgtacatcccgccgccgtacgcctcccgcgtcagcggcttcatctcggagatgttgggcggctggtgctcccgctgcagctgcggctgctcgccggcgacgaggtcgacgaggtccgggtcgctcgaaggcaccttgggcttctcctccttgtcctccattgccttcttcgtgttcggcaccagcttctccatcgatcggtccctagtacgcactgactactgagctgagttgagtgagtgatgaacaacggctacgtagctgaagctatagcgtcgttcgctcttcgcgcgcctggtcttggttaaatagttctggcgttcgacggacaatggattggtacgaagtgtcgcgaacgttcgcgtgcaggcttgcgtgcgggtaaattatttgcggcgttgcgccgtgggggatccacgtatttgcgggccttgcggcgctgggcggcgcgtggagcgcttggcgcgcgaggcggggataggtcggtgcctcgtggcgcggacgtgcgacgcgcggcgggacgtggctgttgccggcggctttttagcccggcaacccacacccgctccctgcgtgcgtgaactcccacgcccacggtctcgccacgcgcggctgggccgaacaaattgccggagagccatcggcctcggccactacccaatccatcaagcccggtgccgcaaccgcaccgaatcgcacacgcaaaaacgaactcccatgcaagtagcctgttgcctaagcaattcggcggaatggcgccttgcgagctactgtgtgttccaaagtttttttttttaaactttcaactttccatcacatcaaacctttcatacacacataacttttcagtcacatcgtctttaatttcaaccaaattctaaactttgggccaatctaaacacatgctaggagttgcagcgagtgcggcgagtccgaattttcccgggtgttgcactgaagtctgggaatctgggatcaggcaaagcattaaagcatggtggaagtttcactgaaactgcttagttgatggcaagtacgtacagtacgtctatctctgaaggaggttgctgctattcggattccgtatgcttcgcacaggccactggagctccctctagccattgctattaccgttactattccagtggttatcatatgcttgattccctgcgtacgaacgaaacgaaccatgacgaagcagacgtagaagcaacatagctacgcgtccaatacgactttatttcgtacggctagtaggcccacgcgtcaaatagcaaatcacatagtaggagtattagtatatgctgcttaacaatggcactttgcagatgggccgaatctgctgcaagttgtttaacagaactttataatgtgactgtaactactttaaccttttctcttagataacttgctttaacttgtctgcccatgaggctattgaaaatttccgcaaacctagctctccctccgtccaaaatataaataattttaaataaataagatatattttaatattacgaatttaaataaaaatattataatatgttatatccacgtttaaaatctcttatattttaaaatggaacaagcactggctatagcgaactgctcagccaattgatcagggagatgaggtgtgtggtctcctcggtggacgactcgacttgaatggtcgcctcgcctctgcgttgacgagacgtctatggctactgtctctgttccccatttcagagggtggacaaccggacatgcagaggaaaatcaagcaaatctcttgtacactaacggccggcctactgactttcacgcggagtagtccaccaccaaggtctctgctactcttgtggttagtgttgagtgcttacaaaatacagtagtctaacaaagagcactgaaactgacatgacttaatttctgctggacatggacatggacatggacatggagtagtaccgaacaattgacagcgtaccatgccgttaattagttggaattgtataatcctctaacaattcccctattccaaaggaggtcctgaaatgtgtgaatgcatgaaaggatatcttcatggtcatggatttggaattcaagttattgtttttttatgtgatggatgagtagttagaacctagaggcttggaattcatactttgttcgtttgtttgtttgtaccggcacagtacatttgaaccggtcaaggaaagaacgagaaagagtggtacggtacttgactgtctgtcagtgtaatgcaaccttcaaattcactactagtttcaacaggaaaagaaaaggccgcgtgatgcctaactaagcacgttatttttcttagccaaaccacagaaaatgcatcaacgtacttcgttatgacaggcagcctatcgtttcgcttattttatgcttataaaccaaactttaaatttaaaatttagttctaagagaaattttaaatcattgagaaagtatcttaagatatctaaattctatattaatttttataccttcaggtaattattatcaacgtgaatcaaattttacatattttaccctaattttaaagttgattttgtggattttttatcgattacttttcaatcactacgaacacatatataaaagttttactataaatgattttatttagttagtaataaacagtttagatatgcatatgtataagtggtcctgtggttggcactactgaactgtactaacaagctaaggaaagtctatttatctcttgaaaggatgttctctcctttttcatgtcgcttaaaatatcactaaaaatttaaaaaatagtaagatagatcaatatgtaatatgtcactaaacaaacatgtaggattaaatttaacttaatacaagtagaaaaattaaataaatttaactattaatagaacgtacaattcatagtcaaaattattattttcgtttctaattatataaatcaaatttgaatttgcatgtttgtggaatgaacatcacatattgatttatcgtatcaaaagattttaatttttttgaagaatttttaaatgacattaaaaaagggaatatgtcctcaggaaaaaaaatccgtctcccgttgattatactctagaaactacgtctaatactacgcatgctttcatattctctttacattagtgattatatttttttttgtgagagctatatatggaaccaatcagcatgcagtcttctgtttatatctgttcaggacattcacacaggcatgcattagacacatttttccttaccaagttaagcacaagagctactagaatcatattctcatatgcatgacttcccag

SEQ ID NO: 32066 - DNA, 28540 bp, Oryza sativa
  unsure (1)..(28540): unsure at all n locations
cctcattacctgttttgctttccagatagatgttgggagaccatcaagtcatcggtaaaacgtggaactgaccaacagtttctgttctgcctgttcatcattaaattgcttagttcaaattcacattggggatgcctgatcaacagataatctctccagtcgtttttctgcccattgaaaagaaaagtattctagatgtcacataccacatgtttaaaaggtaggactgccgtgatgctaccttaaaaaagaggcaattaattagaccacaagtactactatgcacgcatgaaaatggtaatctgatggtaattacacttgtcctacttctatattgatctgcaatgctccatgatcctttgtaagtgtatcgaagatcctcggcaactttaagtccaaaaacatgtttaaaatctttaacaataagctgtttttcttaacagattagtcagacgaagatcatgctgcgccaacccttcagcaaacaaaagtgtgcaagtaaaatgagatgtggccgcctttcccggaataatacagcaagattaaccagacgttactctctcttcttccttttcttaagaaggaataaattagggtttcatattactatcattcaactttataactataggttagcgcggtatctcgaagagaaacagaaaagaatgtagtacatgacaatgacatctttaattttggaattggtcgcaatctctatccgacaagcttataccaagtccaatattccattgatgtggacatcgtatatgatctagtccggtcacagtttcgagaggctcaacaatatataatcgcctaattaataagaccatgcagtgttacatattggtttagttaacatggtatcatttaattatatgatccgatgacaaggctgaagtttattgtggaattacagcagaaagtctaattaagtatgtagatatccagcttgttgaaattttgcatggtagatcctttatgagttttctaaaaaaaatccccactgatacaaacacaatacaattatgcaacgttcacacaccattgattacatgtagactatttatctacgtggacaaaatctcttatattttaatatggaggtagtagtaattaatgacaagttatgcaaaaaaaatcacaaattaaattactcatttagacgatatcatggctaattacctccacctgttgagaaagttacattctcggacgacatgaacttcgtaaggaacacttaatttcttatgcgaatcacgaaaattctaaacgatcttaatcaagtagtaaaacatgaagaccaataaataaaccgagagaatgcctgcagaaatgattgcacttcaattattgagtaaaacagattatttgtaaaaaaaattatgtaaaacagatatcgttttcaaatttaaaactgtggaataactctcaccccagcagccaaattggagagttactcataaatattcggcacagcaaaagggaatgaataggccataatgccatatgtttcaggtgagtgaaaaatgagtcaatttgtgtgacctgacaagtctcctaatgcacactcacaaataagcaaaaccctccaaattaaatacagttaaataaattttactgttaagccgcccagattattttttactactactgaagccaagcactggagactgcactggtcgttgtcaccagtgctaagaaattgcgaccggttttctccatgaaaccgcgttaaagtattcaagcaatgcaatgcctttcttttctatataagctcgttgcctccacatccacaaccatctccacctcacctcgtccatcgtctccagtaaaaatcaagatcggcaagccaagtgcagaggcaaccaccaccaccacctggagcagagcgagcgagcgagcgagcagagcacactgtcatcaatggcggcggcagtggctgtggctgggccgtccatggaggtggagcaggacctcccgggcttccgtttccaccccacggaggaggagctcctcgacttctacctctcccgcgtcgtcctaagcaagaagctccacttcaacatcatcggcaccctcaacatctaccggcatgatccctgggacctcccaggtaaacaccaacacacagtgagagttcagcaagaacggagacagtgtttgagctggatgatctgatgatgatgatgtgtgtgtttcttgtaaaaatgtgcaggcatggcgaagatcggggagagggagtggtacttcttcgtgccgcgggacaggaaggccgggaacggcgggcggccgaaccggacgacggagcgcgggttctggaaggcgacggggtcggacaggggatccggagctccggcgacccgaagcggtgatcgggctcaagaagacgctcgtcttctaccagggtcgcgccccgcgcggcaccaagacggactgggtcatgaacgagtaccgcctccccgactacggcgccgcccgcgccgccgcgccgcctcccaaggttaaactaatgctctcttagcaattaacaagaacaatcagttgcagagttaattattagaacgaatcctttaagtgatcgcaaaatattagtactactgaattcttaaaatggtcacaaaaaaaatgatcggaatgaagtgagaatgatcatgtcatttatttcttttttgaacgaacaatgatcatgtcatatgtagtactagtattagagtattagtacattggcagtgaatgctctcattaatttggttgtttttggtgtgaaaatggggtgcaatgtagtcgttgtcccagtagacttgcagtatcaatgatgtagatattccacgaaagcgcaccaagcattaagaattaagaattgacacggttgacttgggagttgactgccttgatttttaccattgtacatgtaaatttactccagagaacaaatactccactagtagtacaattttaacttggatttttctcacactgtgtttggcggcaggaggacatggtgctctgcaagatataccggaaggcgacgccactgaaggagctggagcagagagcctcggcaatggaagagatgcagagaggatcaagtcacggagactacacggcgacgagagcatccctcgtccacgacgcctccgcctccaccggcgacgactacttctcgtcggacgacgtccacgacagcggcttcctgatccagtcctcatcctcgtcggcggcgccgtccggcagcagcagcaagaacggcggcgctggcgcaccaagggaagccaagaaggaagaagcagacgtcacggtcacggtggcgtcggcgacgagcctacagctcccggcggtgagccagctgccgagcctgcagcttccggcgatggactggctgcaggacccgttcctgacgcagctgcgcagcccgtggcaggaccagcactgcctgtctccctacgcccatctgctctactactaagcaaggggcagagaattacattgtgcatcgaagcaagaggagtcgatcacgatctccagatgcatgtgcaagagcaagagatcaaatcacccgtcgacgaagaacaagtagcgtagaatggctagctgtggattcgattgtacatatagtagtagcaccgagatatcaatcaatcttttggtcttctctcaagataatatgatgctttctgacttgacaatgctagaatctcttataagactatgattcaagaactttatattcatgtttgcgccgccaattttttgtgcaccgattataacagatcgaaacaacagatcctaggaacccagcaatacaagaaagatgtatgggccaaattttgtgcgcggagaagcccgctaaacaaactggtggctgattcggaccacagcccgcaggggacactactcacccaatgggccaaaatttctgcgcaaacaatattcgcttttgacaaccttcggagcgctgtacgagtttgagtttgtcaaagacacttgcaagtaaaatatgtttgatgtagcactagcagaagactgatcgatatgctcccccgatccagtcttcgcgactctcgcctcctgtttcggtggttgggggagatagatccagttaggtgcgcggcgccaagcggcaactttggcgttgggcttgtacgtacggcgagtgcagcgcgcggcagagacagcgctagctcatgatcgcttatcgccgtgggagctgagatgcgaaagcaattgaagaaaattaacacagataccggtcacacgatcagtttaactaggggcatcgttccaccagtaataatattatttcacaataacatgtgagataagcgaccatgtgtcatatactcatatctgttacatgatatccgcgaacgctctctgctagctttattcgtactagtatcacgtacatatacgtatgtacgcgaaggctaagctagccattagcaagcaaccagcagctgtactagcactaggagaatccgcttatgacgacgtactcccagtcgatcgtctccagtgcttaacctcctccgtagggcttctggtccctgcaggctatgttatctccgtatcctacgcggaacatgtcgcagtacctcttgtagtagccgacccggtccttggcgttgtcggtggagtagcccttgccgcactcttcaccgccgttgatgatgttggtggccatgccgtagccggggagcctcccggagctacggtcatcgccggacggcgtccactggttggtgattacgtcgtggcacgacggcttgggtgactgcgccgtcatccagaaccagatggccgtcctgaacgccaccacggggtcgcttgacaccaggtcggggttgttcaccaggtccagacccaacgcgtccccggctagctggtagttgtacttactgcataatacatacgagagcatgcatcatatcagatttattttggtggatccattgattatttgtagattagtagtaatagatttcattgcatgagacgatatgtgttgcaataacttagaactgtttgtgtgcggtttttttttatgaacgtactgagtaagctgtatgggtcctcggccgtagtagggcgggtccgacggcgtgatctcgttcacccggcagtatccccaagcaaagggtccatcaggagcagttgcccatccaccttttgtatggagtaatccgtttaatttgcaaataaaaacagaagaaattaagtgatctgaactgtgaaggttgtgactagcttgtgagtagtgagtactacctgtagtttcgtgggaggtctggccaaagaaagcggcgagctcgcgccggcgcgtttcgtcgttgccggtcgtgccgaatctagggaaatctccggcggccttgatgaacgcgtcgtaggtgtagaaggcgccctggcaaccttggtccccacggtggctcagcatcgactcgaacatcgcccgcgtgatgatcgacccaacacccgcctgctgcccgctggcgccgccggccgccgcgatcagcagcgtggcgccggcgagcgggagaagccttctcatggcgcaaatcaacaacttacaaattctgtactgtcaattgtgtttctcgatcgtgtgtgcagactgcagactgcagagcgcacggcacggctttatatacgacagtatcgcgcgagatggtcggctcgatcactccgtccgattgaactcaaacgatgtacatgcaaccgtacgagctagatgagcccgtcaaggacggcacattcagtgcaacagcgaccgcgagcatttggagcatagcatggcgtatgcacgcggcagcttgggccgtgtttagttaacccttaactaccctaaatttttaactttccattatatcatatcacatcaaaaactttcctacacatataaacttttaactttttttttctgaacttacaactttcccctaacttataacttttttcaggaactagaccgggacactgccaatgccgaagaccaaagcagtgagaagactgaagacttgaggtcgtcgagactgtcatgacgatacagccccgaaccagctgcaacctggctggccaatttgctttgccgcgtgcgtgcacaccctttggaaggctcggaatcgtgcaactaacattccggaatgaaagtttatacggctttcacagcttatacaccacatcaaagaagacctcagtctttggaagcaccgtgtcgcaaacaacagtcgcgatcttatccatcaatggatgaacaagctgagttaattttagggctgtttcccagcccctttgtctttttttttcttcttttctatctttctaccttttccttctgttgctctgtttgtttctctgcccttaattttttacccctctactgttctccctgtgttctcctacttttgtttttttaatgggtgaatagctaaagtggtcctccaagtttcatctgagactcagtttagtccttgatgtttcaatctatccatattaatccttcaagttttcattttagttcaaacttatccttgaaccaacaactctcttcataaatgacacttatacccctcatcattcacatatataagagagaaattgcatgcttgaattttttatagataatacatagtatattatgtaaaacgaaaaaaaattatgtactagcaagtgtatacgatagcaattgcttaagtttcatgtgcacatgtcgaaataatgggaagtagatctgtaatgttgtttatttatgttggctttctcttttctagtatatagatgtatacaaattaagggcaaaaatgacattttctaatagaaatattgactagaaatagccatatggcatattaagtggacccaaggatgatttcaagacaaaacaaatatttgaaggatctatgtggataaaatgaaacgtgaaggaccaaattgagccttcgctgaaacttgagggactaaattagctattcacccttttttaatctttgattcaccattagtaaaatggttataaggtaaagcctttctacctttttaagtaaaaaaaaggatttgaggtcgcctctcctgtattcgatctggggttacaaaagtttgtataaccgagcataaattattgaagaaatgtactaccatgagggcatccacaatgtggccaaaaaacagtccttataactctatatgggtacctttaccattgtgggaggtggcattaggaagagccatatgataagctaccgatagctataaagaccacccatatagattaaaatatactatctctctttttgcttctttcatgagagaactatagcatttggaagtaatttttttttagagtgtgggtcccatcttaatgtcaattgctatctatatacattgtgaaaatagaaataataaaaggccccttatatgggtcccacctatatggactatttggtccatatacagatgccctgatagtcaaaacagctatagtagcagtgcctgaaagcaagacttaaaccgataatcaggatgtgcgtgcacgcatggacggatctagaaatagcttggtacacgtataaaagtttctcatatttttctaaaaaaatattaataagtggttcgtataatcgtaaacataaacgaaacaaatgagaccggtgatcaccatccatcctgtctactactggcgacacgaggtgctcgtctcttccatgtgtctggaaggttaatcgtggtggaacatggaaacagatcgagctcgcgcctgccgcatgtcagatatatagtactaagcctgcgttttccacgtaaaaattagaagtttgaagaaattaaaacaatatgataaaaaattggaagtttatgtgtacataaaagtttgatgtgacggaaaagttgaaattttaaagaaaaaaagttgaaatctaaccaaggcctaagggtaggggttattttgcagttcttccttttgaagaactccctcctttttaagatttcgctgggctaccttcttttccagataagagtacataattctttctttgtctggtttagttcccaactttttctttgaacttttaactttttcatcacatcaaaacttttactacacacacaaacttccaacttttctgtcacatcttgttccaatttcaataaaacttccaattttggcgtaaactaaacacaccccttgtaaattggcgtaaactaatcacaccccttgtggtgatgcttagtatgtccttgccggctcgcctcctcagcacaagcaatggtttgttggttaaatagcttcagctacaagatcaactgtgcaccttattcacaacaaccgaactctagtgttaaccaccacaaattcccttgcatggtgcctgttctctctctctctttttcaattaatgttacatatacatgtgccccccaaaaaatgcataatagaaatggcaacccaaatagttacaatcccaggattttcaacatctggtccgaaagagaaaaaaaaaaggattctgcagcaccttccccccattacacccaactctttaacgtggaatgtatcccaattttctgaaggaagagcagcacgtctcaacataaacctttgagccgcaaaggagactgagcagacgcatctttagaccagagacgctcttgtctcttctcttctagctgcgaagcttcattcaacatgtccatagcatcactctgcatatttaactttgagagcgcaacagcttgcatatagaatgcggttggccaatcagggtatacgcactgcgcttgcattgcatcccggagggcagcatcaggttggtcagacatgaggtggcataagctccgtctagcgtataccgttggtgataccattgttcccacatcaacaaactgcaacccaaagaggaggtaaaggagtgagataacttcaatctaacgatttttttgtaacaccagaaggttcctgatatttgacgttccaacctgtgtgtaacactctatggctgtcttaaaatctttatcacgaaacgcaaagtctccacgtttcctagcatctaacatatccctcatctgctgagtccattcctggaacgatagctgcaacagggagattgatgaagagatagatttcttagacaacgatctgccatatgacagaaatcaaagtgctccaatatttacctcattagtcccttcatcatctctgtaatgtgtggcaactagaatctgatggattgctgtcatgtccatcctagaacaggcttcacccatgggggatagagggtgttgtggttgtggagctggagcaggagcaggagcaggaggtgcttcttcttcatgctttggaatgccaagcatctcataggaaggcacctgtttgtattttaaaataaaattaggtcagtcaaaatatggcagccataaattagtaaagaaggcttaaaccatcaaagacagaaaaaagatttagaaaagtaaggataaaaacacaatggttacctctagttttgtttgcaaaggatcaagtatggagaccagctttcctgtattgggacggtccctaggttcatactgtaaacactgagaagcaagatctaccaaagcagttgcctcttctgtagagtattttccttccaaatgtgagtccaagagcacttgaatgtttttgcctcttatcatatcgagagcctgagtgaaacaaagctaattgtcaataagaaagcacatgttttaattgttttaagcattgttaccacttacgatgtgattatgctaccaagttacatttagaagtaaaataatatttggagcagctaagagtgttagccatactatgaattcaagcagcagtcaacctcttaatgttcatgtctatataagtaaaactctgttctactgtagttgcacaggagtgttgcatcagcacgatgcaaaagaaatatatatgcagaagcagaatagcattgtatgccacctggccaaggtattttcagtacggatttcggacttcttatgctgcattggagctaggataaagaggaacaagaaaaggcatactttactagcaaaataaacttacatgggaaggaggtatgcgctttccacttagaaggtcgaggagaacagtaccaaagctgaatatgacactttctggagtaactctacctgaaaaaggagaatataccatgaagaaatgtaaaaaaaaaaaaaccttacatttagaatggtttcctcttatatttgttatcctaaggctgcctttgtgttagtcacccatatgttttagctggctaactatgagcttgacatttcttcgtaatcaccttaaaaagcacatatcaatgcttacaaaagcactcagtaggcaaacaagatgaattatttatttatctggcagggaaaaagaacatgattattatgccttattttgattataggtccagtttgtgcatatgatgtgtcatgccattagagtggaaggtacagttctgtcatcaatggacgatggttaacatctataatattcctatgaatgcccagagtaggcaattcaaataaaaaatttaggcataaagcaagaattacatgcatacagaaaaaaaaagagcaatgtgtatttatccatttaataaagagaaaatctaagaaatgtcattgacaaacatccaaatccaataaatgccattgacgagtgcaagttccataaaataccatcgtacaagcgattttgtccgagaaatgccattgccgttagggttctatccatcccgtgtcgttaaatacattgttcatcatatagcacctaaaggagggatgctaacggaaccctaacggcgatggcatttctaggacaaagttgcttgtacgatattatttcatggaactcgtacttgttgataacatttcttggaattgggcgcttgtcaatatcatttcttggattttctctttaataaatagcagttcatatctcagaggaaaagaatagtttttagtctcagggtaaaaggcatatgtaccatttctcaaatactctggaggtgtatatgcaaggtttgtgctataacttttgccatccctgctgtttttcatcaggccaaagcatgaaagacgaggatcaccattctgcaaatataaatacattaacgatttagataaacggataacatctggataaccatgtgaaggagaggttcatgtgaacaacatcatgggaaagcgatttattctttgatgagattcctaatcatttctccaatcagcacaattggtaaagagttgacattttcatttctgccatgtgctttcttccaggtactagagatgccaacaatttccacttccaatataagcatgcaaatcaacaaacagaggaagcatccaggataagagcacaaactaaattaaatcagtgccattccgtagattgcacactacttcttgcagggaggtatttgtagagataaatatactatcctcacttcctctaccacatgagacaatcctacagaataaaacatacaaacaccacaaaagaattggttgcttacctcatcaaaaaggaccctatatgcatttaagtcatgatataaaggccgttcattgctactgcagtagtcaagtgcttcagcaatgtggtgtgcaactcttaaacgcatagcccattcgatagtctggttttcccctgcaaatgtgtaaaaaaaaataatcatgataaatgaactgcaaatttaataacacacatctagtttgcgcaaattcaaacttgcatgaatggtgaatgcaattaagatcacaaaaagaagtaatacagtgcattattgttgaggttttacagaattcagtacttgcgacaactattaccaatacagtcgacagctcacccttcaccactgccagtgtaccctattgtcaggttgttcatcaaacatgaagacaacatataaagaagcctaagttctcaagtgaactacaatctcccgtaaccttaaatgcataaaaaagttaccaactgcattggtcactgtaataacaagacatttccacattggagaccctgaatcagtttaaggcatccatttgtgtacacatatagctgctgacagactcataacaacaccaacattccatcgagtgtgttaaggaagcttgtgccataatcagttcgactgactcaagatcattgccaacaataaccgaataagaacaagatatgacaaagggcagtcccaatcattcgttcggtacaccaaatgcaggaagccggtaggagccagcagttgctcaaagcagaccaatatgtcctcttttgccaacttccacactaatcaggaactacaaggcagaaaaatccaatctttttgcgaccagtgtttatcggatatggaaaaaaaaagtctcctggtgatcagaaattcagaaaggaacttatcaaaagaaagatattccaataactcacaatggaagacgtgcttggctagggtgtcgttgggcatgaactcggcgacgagaagccgctcgtccccatcgcagcagtagccgatgaggttcgccaagcggcggtggcgcagcttccccacccccttggcctcctcctgcgaaccaaagcaaataaccttaatctatcggactgatgacagcaaagacgaattctccaggcacaacaagctcttcccgaatcggggcgtacctcgaactgcttgggatcgggccacgccatcttggggaacttcttgacggcgatcgcgcggcgggtgcgctggaggcggcccctgtacacgaaattcggggccttctcgccgctctcggacacgatgttctccgcggcgaacccgcccgtggcggcacggagctccgccagcgagaactccgcgaacgccgggacctcccctctccccacgccctgcgccgccgccgaccccggcgcctggtgctggttcagggagaaggacgggcgctgcggcggcgccgccatccccggcggcttctccgggtgggtcccggcctgcagcgacgacccgcagcaacccatcccagtccccctcctggtcgtcgccgactacctcgcgggctcgctcgctgccccccctggtgcggcggtggcctgtagggcgagcgagcgagcgcgaggtcgagtaggaggagtggttgctttcgacgcggcggcctttgtacaaacacctgctcgctcgaatgggggggtttgggtttcgtctcggttttcgctgccgcggtacgcctacggagtacgccgctgtgtgcgcgtgcgtgcgcgtgtgcagtgcagggtacggcctgaggctaggccgtgggcacggtgatatgttgtttgtctcctgttcacatctcggcaaatctagcgaggggataagcaaaaatggagatgtcgtcatcatcgttttggaacaaattttatttcctccgcagtccgcaccactacaacataacactacattcacactcacaagtggaaaatactgcacatacgatgttttattacgatcttagtacgatccaacgccggaccatctgcttatgtagtttagcgtgggaccgaaacttgcaaccgtcaacaaacactaagagagaacatttatcataaaacaatagtaaacataataccgtatgtttagcagctctcctcgcgagtatgcctctgacacaccaaacaaatgaaaaccaatgatacatatctgatctcactaaattttcgttgaaatcctaaaatttttttcttgcaattatacagtagacatacgcgtagctacaccgacatatataacactatattcacacacccatgagtacgttcccaacacacagaaaaaaaggaaatactacaatgattactcggatgtctattttttgtttggtcgtattaaatatctttgaaatcattgtttctctcacgttgaaattacaccacgacaacactaactatacataggtaaactcctctaaaatgttccatatattcaattcaacgatagaaacattcatccaactcgcaaaacgctttaatgataggaaaataaatggaaccatatgacataattgttttgtgtgagccttacaatgattcatattgaacagtttagttgaagctgaaatcagagaaaacacacacataaattgcttgagatgctttgatggtgttctaagattctctttgatgtgcctttcaaaacatagtgttggagaaggagaggacatgatgtgaaatgataaccctttacctatgtgtttcctttctttcaaccaattctaattatttttagtatgttattcaccttttttttctagagaaaggttgtcccacatattagctaaagacaacaaaattttaaattggaggcctaactttggattttattttagttttttcgtcaggtctattttctatattatttttaaaccaataataacacatatataaaagtctcatcctaaactattttacgtttcttgattcggttattagtcatgggctccatagctcaaactttatttctctgtcaaattttgataagaaatggtcgagggcatcaacctgtaagcagagcatacggaaacgactagtgaaaactgaaaacgaacggtttggagtaatttctgatgttacgtcatgctttggcccacacttgctctgttcctctagtattttggtccatgagtcaacggtttaactcgtgctctcgtttttttttttttggttgttgttgtttttttgatgagttcgaaagggaaaagaaaggacaataaatccgtccgtcgtggcgacgtacggagccacagtcacgcgaaaccccctgcgcggtttacgcgcgtcgctaccgtcgacgtgcatccgaagccaaaatcgccgtgctcccgtgaattcggcgaccatgtcgctgccacgccgcggcaacgagtctcatgacacacgggcacctggaggcacgaaagctaaatttcctgatcagtgcccaccagggcaccgatgttaattttcgccgatgataccgtggccctaagggctggttgatctgtgagtttgggatggtagattagaaacgagaatactcattagtatattattaattaagtattaactattataaaattatatatatatatatatatatatatatatatatatatattataatcgtttaaaacactctttgtatagaaattatttttacataaaacatgtcgcgtgacaattcgggtagtatactaacgaaaaatgagaagttgttacgagcaatttgaacacgaaacacgtttgactaaatgggatgaagaatttagtgtgcatttactttgttgtcacctttaaccctattaaatcttgataatgtcagattttagtatgttttgatgatgccaaattttgattttgatttttatttttttagagaagggtatttctacccaaaaacgagaagtatttgttacgagtaatttgaacacaaaacatgtttgactaaatgggatggaaaaattagtgtgcatttacttcgttgccacctttaaccctattaaagcttgataatgtcagattttagtatgttttgatgttgccaaattttgattttctttaattttttttagagaatgatatttttatccggcctctaaatccaaccggatatatacaaccttttttaagttagaaattagcgctcaaataacccaatctaaaattcactcctatgtagctactcaggttactgcaaccactaggctacatgacttttcaattttgatggtgttggatgtatttggtttaaagatttaccaagattatgatagagcttataaaattggaaattttataattgtcaaactttgataagataataatgacaagaaaaggtaattcgatatggttaaaagtagcaacgaagtaaataaccttaaagtttcaccttttagaatctaattaagttctaatcgtagatgtcaaccaattgaccatccattcttcctacgtaccgtttcgtcttaatctcctattaatttatatttttcagtcttgcctctcataatccatatccaaacatacattcgttttctcgtgaaactatttccacggatgaagatgatgttttagtcctatgaaactgttgttagtgtaacactacagtaactgattacgacgtgttggcacttggcagccgaaaagcagcagaaacagtgccatcccgtagacctttttcggggaaaagcaatcccgtagattaattcatggtagaagacttttgccgtagcaagtggcagctcaaaattggagtatcctcctaaattggaacgggtaaatccaatgtttaggtatttcttactactagtcattcgctgtctccacctcctattaaagtagttgaacttgaactcaattactcaagcacagtgtctactggatatagtgctgacagaaaatgaatatggtgaaacagtcagagtttcagacagtaagaattagtccaagcaaatgcatgctccaataaattagctctcgttttggccgagggttcaatcacatgtaaatcagttttggccaagggttcaagtagtgttaactcattggagcaactcggtcgtatttttttcctttttatccagacttcattcttcagaaatccaggctagcattgtgtttatacaaagaatactttagcaattattgaatgtagtgctcaatgcagagtcaacagaatatcagaattcttcagatccctcgctgcctcgcaagacatcacttgacctgatcagctcagtcgttagtcatcagtcatcactcgtcagtttgatggaattatccagttgcatgctgttagcttccgttcccatttcgaacaatgaaaggagaaagaaaagctcctgctttttgcccagaggcagacgagtagccgagccaaatatctgttgatccttaatttgcccttaattaatatttgataattattttttcatttccagtacaacagcaagagaggacaataaagtggccaagttggcaacttaccctgtccattttttttgtggctgatctggcacgcacccgggcaacgacgacaccgtgtcgtttactaatcactcagccagttccaaacaatttactgctgcttaacggggacatgtagcttttgttactgctaaaagtacatgacttatgacgtgctactgtgctggtgccactgtaattcgtttatcaattcatcgtctgcggcgccagtgcattgtctagctctcctctcctgccttagagccatcaaaagatttttctcgaactcatagttaagataatcctcctcacgtgcactgacagcttaccaggataaaataacctgatgtggcagaagattacatcgcgttaactgccaacgaaatcgttggatagtgctagtagataatagtataatggctagctgctgtcactctcatagggtcattatcagtataaaaatgtgcaatgtttatacaccagcatccccaattctccatcgccatcgcgattactattcccgtgcaaaagacaagttgggaaatttgcgataccattttttcttcttttcccacgaaaaccttattaaagcatatgcccaaatcattactagctacgtacatacatatacgtacacaccggaagagcacgggattagcatttagcaccaattcaagttaatcattattaaagcagaaaagaggggaataatccggttatcatgataacgacatgaaccgaaccatcgatcgatcgcacacgcacggatgcatcgaagtacagattagcatatggatgcttcacctgccgcacaatagtagtagtacagtactactccattggccggaagaaataaggcgaaaaagttgcggctccaggtgctcatcccacgcgggattcgctgccgctttgcgctttcgatcattgcgtgcccctccccctcccctgggtgcgtttggttggacacgtttccgcgagacggcgagagcgacgtgacgcgccgcgccgcgcggtcgctcacgcagcatgcgttccccccccccccccccccgggtttttgcggccgtttgcaccgcgtacttgccccccgcccccgggggcatcgccacgccaggacgagacacgcacgccgcaaggccggagcgcggttggagctcggtctcgtgggtttatcaggtttacacgagacggcgcgcgcgcgaaaaaaaaaaaccccgcggccgtacgtgcagcgtgcaggtgaagacgggtggtggtggggaacttggccagatggccggacgaggcgccgtacctgctgcggtggcagactggcagtgccagcgctagtcggacggcgcgacacgacccctgcctcggtggcgctgagctgtgctgtgtaccgccagccttgcggctgcggacatcgtgctgtacctgtactatcatcggcgtcgtcccagctggctcctctgtttcgtgggccgtcacctctgggttccgttcctcttcggctaacaaggtaggtttagcccatgggccttttcttggtagctcaaaactgcacgaagttatgcaaagcagcaaagggcgtgttcttctccttttttaaaaaaataccattggcacaaatacaaacgttcacaacacgtgcgctcatccttatctttatgagtatgtccgaaccgatatattgaaattgataaagccaccacaattgatttactcttgattgataccttgcctaccaatgaaaaaaataattataatgtgttctttgtggtacatgaatttgggctgattagcggctcacaaacgaaaaaagtggttagtatataattaaatgactattaattattaaaattttgacaaatatattatttaatttttaagtaccttttatatagaaatttttttacacgaaatataccgtttagtagttttaaaatatgctaattaaaaaaaatatattatttaatttttaagtaccttttatatagaaatttttttacacgaaatataccgtttagtagttttaaaatatgctaattaaaaaaaatgagagttagttgaattaggccttttttagatcccctgataaaattttacaccatgtcatatcgaatgtttggatacatgtatgaagtattaaatatagacgaaaaaaataactagttatacagattgcgtgtaaattgcgagacgaatcttttaaaactaattgaatcatgatttgacaatgtagtgctacagtaaacattgctaatgatggattaattcggcttaacaaattcttctcgcggtttacaagcggattctgtaatttgttttgttattagactacgtttaatccttcgaatatgtgtctgtatatctgatgtaacacgttaaaactttacccccttacacggttgagtacgaatcacataagaaatacgtttccgatctttagctgtcctgtttgcctgaacgatcacatcgaaaattaagagtgatccgattagataggcaccggtgtccgtcctactaactcccaaatgatcaccgtgtcacgtcctcgaactaacgctaacaacgtgcagaaaatctccctgcatctcgtgatggttcattggatcgtagtgggctccaataagtggggcttccaggcccatcttgctggggcccaatagtaccgaaaacgaaagtagcaccaagcttccatgcacgacgacagaaacgagcgatgacattgttgtttctttgggaagaaggacaacacaaccgatccgttagcttgtccatttcgaccctaagtggtgcaaaatgattggagaattagtcaccaaaataaataattgtactagttctaagttctgataacacaactagtgaccaaccatgactagttctttagagatgttgggtttcagattttcagtacagagccgacgcaagttcagtgttcagatgcgccaaattatacggatccgtgcatgcttccgattctagtttagatcgcgaccttctagctagataaattataggttgcacaggtttgatgagcacgctaaagctggggcatgtacactgtattggtttggttgcaaagtaaagatccggcttaaaagtgcagcttctcttgactgacgatcttgattctggctttaggtgcattaaccttcacaaccacccaacttatctgaaagatctaacaagatgaaagaggaactgattctgcgtttccgaacagtgaacggtgcctgcatttgtgtttcttctttgcaaaccgaagctagtacattatactctgctactactttaagcactgagacaatgtcatagttaaatgttcaatgctcctttcagtatattagtattaagtgctaaaaataactgaaaagacataactatagaatgcagccgcaaagcctgcatcaaaggacctaaacgccagcttaaatagaaagacaatttggtaagttcgattccaacgtgatacattaactccttgacccaattccatgtgatgccaaaccgaccgaacggcttacgcgatttaacaaagattcatctttgcgattgaaaaatgcatgtgaataaaaagcagaggcctcacatgctcagcttaacggttatctttcagttcagagccaaaccctgcatggctgcgtatagctgaaaaatgagacgggaataaaattgcagctgaatccagataccatttggtattttagcaattgacattaactcgcatccaaatcaaggtctaattaacataagtttatatggttgctgcttgtcgcttaagaatcaggaaagcaacctctgaatttggaggtaatccatgaaagtgaggttgtgtagacatttgatttgaaagctaataactaaattttactgaatatttcacctaaacacaattccattccattgtgaaacgatccctatacatcatgtacgcaacctaccaaaaactaagaagaatgatgtcaaacaaatccgcattgtcctgatcactaatcttccaggaatttcccctccagagaagatcaaaagcacggcgtcagtacgttgagcagtgacaccctcgcgttcacgagcgcccggtacacctgctcgcagccgtcttccgccgccacgacgcactcctccagcctgagcagccgatccatggccgccttcctttcctcctcttcctcatcgatgcattcgtccaatggcgtctcctttgcgcctgcgccggactcgcaggcagcgaccgacaccgtgcgccgccgccaccgcaggaggtcggccacccaccacaccggcgcgaccgctacctttgcgggagaggctgcggtcggggacgccaacgaccgcgaggcagaggaggcggaggcggacgcgaggcccgcgaagaaggaggcggacgcggccgccgccgcgcacgtggcggccccgacggcctcggctagcgcggcctcgccggagtcggacgtcgctgcggcggaagaggagcggtaggagaggtcacgcaatgtggaggcgaggcgggagaggtcgcggtccgagcggcggcgcgcgcgcagcgcggcggcgaggcgggtcgcgtcgcggcggcggagcgcggcgtgggcctcggcgaggagctgcttgagcgccaggagcgcctcgcggaagcacccgtgcgcgtcggcgaggaggaggaggtcgtcgagcagccgctccgtccacggcgccgccttgcgcggcggccggagcgggtcctgcgcctgcgggtggtggagcagctccgtcaagcccgccaagagccgcgccaggtggccgaccccttcgccgatccactgcgtgccagcctgcgccggcgcctcatcagtccacccgaggagagcactcgccgactcgtgcaggccggtgacgaccgggtggaagcggccggggaggctagcggagcgggcgcgggagtacgataacttcttgtgcctcgtccggcggaggtaggacgatgccttggggatggtgagcgcggtgagccgtcggcggaatcccgctgccatttgctgcgtcgtgcacctccggcttgctcgagaagctgttgtgttcttcccggcgctcgcggtggcagtatgggctttttgctgtgcgatcgagttggtggtggtggccgtggtgtggcaagtggatcgcgggcgtttttatagggtggtgtggtgtggattggtagagcccgcacgggtgggagggggtgtggtcttgtatactgtgttcggcagctagccaggcgccagtggcggagtggcgcgagtaggagttggatttttcactccccccatgagctttgggcagcatcagcttacgatacaaggttctgaagtccgtcctgaaggggtataaccaccgtgttcaacaagctagggagagcagcggactacaggattcttctggtaatctggccagttaggacaagatagtgtactgtgcctgtttttcgtactactgttctgggccacttcaataagtttatttgtttctttctagggtaaattttctcgtttaacgaaccatttgctgtggcctcatttcctttgcttgtgcagcagggtagtacattatggagagtgaaaatttttttgaactgaatggagagtgaaaattgaaaagtcagtgccaacgtcctgtggcttgcaaacagtaatgccgttttttagctacttagatggagtaactccttttttttttcacgaccgacatactcctactatattagcacatggagtaactcttatgtaccaaaatatcacatgtaacataaaaaatatcccatgtaaaaattgctcacatgtactagaaaatactaccatagatgtaaatgattctcctatatgaggaagtaggataatcctaccatccggccaccccgagcagatgcccgggcttatcgagggataatccattaaaatatcatataattagaaattttcaaatagaattcctatattaaatagtagtactagttatagtgaggtttgtccggacttcaaaatatttcagatccacgcttgcgccatgcttgaattgataggtcattttcgtttttggactaaatatttttatataaattcaaattcgcaaaggccaataacaaattcaaactcgctccaagcgtcttggactcttgtttggattacacaggtagtagtatacaggtgcaaattggcagcacatctatcttgcattgcacggagagtaaagttagtttagggccagtacctgtggcgcgggccctgccacccggtgtgggagcacctggcgtgtggcgccccacggcgcaacgcgcggacacgtgcatgcgccggtgcgtgcctcggggacccgcgccccctcgcgcgcgccggcccacctcgctcatcacagctcactcccccgtcccacattcaatgccgtcatggccgcgcgcgcgcgtcggcgtcgcgcgccacaacgcctcctcgctcggtcgctcccctagttccctcctcctcctccgcaccggggcccctccgctccgctgtcccggccaatatgtgcactcgccaatatgtcgggtcgatcgattggtgggggcggaacggatgcggatgggtgcaccgcactggcgcagcgtcccatctggggcggggcctctcgggctcgtgcgattgggacgtttgacaccggttggcctgcgctgcaaggagagggatcgatcgatcgccatatctcgcgacttcaatgctcatcttcgtctggtgcaatgcaaatggaggggggcggggccgtacgagcagcaaatcattgcgatcgacttgccagccgctggcactggccttgctgctactccataccgtcctcgatagttccatgtggggttcatccctacatggatcgattgatcgatcggactgtgagacgatgaaatcaatcattgggtttgggttggtgtccctttctgaatccatgcatctcgcgtagtactattattttcctttggtgttatttggctgggtcgatgtgatcaactctatagatcaagacctttggtgttctttcctttggtgttatttgtgcagaattagttcgctgcaggcttgtttccaagctcccctgcatgcagggtggttggagtatctagatagctgatcatctcccgttgccctgtcacgatccttttcgtccgtttgcacgtccgcactaagattttccaggttttcctatgtcctgcttattactgacgatgcatttgactccccctgaatctggaaggaagaatccatgaccacatgttagtgtttgcagactacggctgatataccaacacaaaggccgtttgctcttatgtatggatcaaattatattataccactacgattttgtgctactacaagtctacaacctatgctcgtgatttttagtacttgcctgcatcacacctttgtttagggattccaatgagatactccagataaacagatagatctacacacatgaaagcgtgcaacaaaagaattgccgcaccatggcctaccagggacaatgaagagcataacaggcggtacaataaccgtgtatcagatgcattgcactgcaaataatttaatgaacgctaactgtgctctgattaatctacaaatctcgaggtgtttttgtagagtggggctctcgatgttaaaagctagcatgcgacgtgtcctcctgccagcagtgccatccatccttgtcacttagcaggtgacatactatcttcatcatcatcatcgattgatcattgatcaaattggtcagcatgatcagctgaacgacctgttaattaatgacaccctctttacgcacattaaggatcacgagatgctgatgtaaagcattctagagaccggataatttatgtactacttcggcctggtttagtcccaactttttcttcaaacttttaacttttccattacatcaaaacttttctacacacaaacttctaatttttccatcacatcattttaattttaataaaacttttaattttaacgtgaactaaacacacccttcttttcaaaatttatgtactaatacatagtactagtactttatattgtgcacgaattaaagcttaggccgtgtttagttgtaaaatttttcttcaaactttcaacttttccatcacatcaaaatttttctatacacaaactttcaaatttttcgtcacatcattccaattcaaccaaaattttaattttgatgtaaactaaacacacctcaagttgcaaatgcttttcgtagccaaaaccgcagaagttactgacatgactgaagattattatccagaccagcttctagcttcagatcatttacgccttgtttagttctaaatattttcttcaaactttcaacttttctttcacattgttccaatttcaaccaaatttctaattttagtgtgaaataaacacactcttagtggatagaatctccaacctgaacgttgaagtctgcagtagtagtcgacaagaaatccaatcgtatcgtccatcgtttgcagtgaagccaaattgacttggttggggttcgtgaatgtcgttgcatgtagtttgagaagcagtacgtgactgtgagagagcgactagaataaaaactagaatattagggaagaacctaatatcaaataattaggaggggtgaggctttgaacccaggtcgtctagcccaccaccttgtaaagctagccggaaaacccctgggcatttctcgagagcgactagaatgaatatgcagattcttttatgtcaaacgccaccggccgccgatttggtcggctgagttagttaatcacggctgcggcatctgtctctagaatgtgagcatgttcgtctagcggaaaaatctatcgatgaatgcagccatgtgctgcagctatcaagcttgacaatactagagaactggtatcccggtatagcaggagatcgccagatctgcatgagtgcaaacaattgtaaccgacaatactaatctgcatgagtgcaaagaattaactaataccagtatcaaatttagtatttatttaaagcttagtggctaattgcacacctgcattttcagtaatctgaacatgacaacatacttgtgtgtggattctgaatttctgagactgaaattggcattggtgcaagcagcggagaacaggtgggcttgaacacgagcaacaagaggtctcagaagtaagagcccaatctaaaacggcccaagataacgacccactaacggcccaatataaagcagcccaagccgccagccgccggccgaaacacccaccgtcgccgacttctcgtgcgcaaacagtgcggttgctcgcgcactacgccggcgagccgcgggcggcggcggcggctgggagtacgggagacgccggaatactagcctcgcatcctcctccctcgagttcgctgcgggaccgcgccatcctcgtcggagccccgggcccaggggacacgagcttctccgccctcttgtccttcggtcagcaccgacgccgccgtctcgctcgctcgctcgatcgagccgttgcttgtggccggaggaaaggtatactccctcgtttcgatttgttgccgtagcttcgcggcccgttagaagtgtttccaactttccatacacgctacgagtatcatcaggttgtttgtcagatatgggattaggctgctgttgcagttgagatgtgatccttttgctgtatgttctgcactctgtttccatgttggtgtaagcagcttgcatttggattttggagagatttgcgagacaaacgtagtgattgcctttgtagggggttgctttactgtctaggtagttcctcaatttagcgaagcaattttggcagctcgtttgattttttatttggggattcaagtcgatccgttatcaaactcctcaaattagcactagtgtttactaagtaggttgttcatatagattcccccccactctcttcatcctttggtatagcagttttttttttatttggaacggatctggtatagagaatctgaaatctataaattaagggtccgaaaagctactatgaatctacgatgcagtcatgattgaatactattttttaaaacgcatgatgactgtattaataaggggagcaaaagttgaaaactgccaaagcggtataatgatctgcttatctatgttttgtgttgtgaaggagcttgatgagggtttatgtgtaactgctgctgtagattcgatgctcataggacatccttgtttatggatgctgttattggctgttaaacagtgtttctaacaaatgtttgttttcttaacctttaggcctcaacagtcaatatggctggctcattcattactggggctttaatgtaagtagcagcagtttttgtacaaaagtactgcagtaggtaatggttttggtctgctacatgtttgttattacctattttgcaggcttattcttggatatgcatacccagcctatgattgctacaagacggtggaactgaacaagcctgagatcgagaagttgcggttctggtgtcagtactggtatgctttttatgcccttttgttttattttggactatcattcttggatttcttatgcttgatctcagctgtgtgatcatggcttttgcaggattttacttgctgttctaactgtttttgatagagttggggataattttgtatcatggtaagttgaccatttggaattgtatttttttcaggtgtaacagtaaaggggaaatcttacctgcttgctgatgataattttgtttgcgtgtaggttgccaatgtacagtgaagcaaagctggcatttgtcgtatttttgtggtatcccaaaacactggtatggtactctagtatttcaaactgctagaagaatctatctcttgtttgttggtaacacaggttgatttcaggggactgcctatgtgtatgaatcattctttaaaccgtggattgcaaaatacgaagctgatatcgatcacaatctgcttgagttgaggactagagcttgcgacatggcggttctttacttccagaaggtttccaactatggtcagacaaggctttatgaaatcttgcaatatgttgcttcacagtcacaaacccaaacatctcgcccacaggtatcttttaaaacgttgatgttactccccagtccatttatgtatttttgcttctagtatagtttgatctgttcatggtattttttttatattaacactagcctcattcttgttatgatcttttactacagtaggtgacttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32067 - DNA, 1648 bp, Oryza sativa
attcctgcagcccagctcatttgatcatccattgttggcaggatgaattacgtggaaatcgaagcggtgagaaagcctgtcggctatctaaacccgtgcaggataagtcagtcgaaccacacatacaggctagacgagaagaagctaccggaacacatcaaggcgatgactcccgaagagaagacagcttacataggacaaaggcatcaggaaaagctgctcgatgtcgctacttacgtagcaatagcgcttgaatctgcgcaggacaaggagtgcgttcatgccctgtatgcctttgagtaagttttaatatccattaagagtatatacatataatcacggctcaactaacaattttgtttgcagcgaccattggatagtctttcttctctatccaaagtacaatgaagtcatcgtcttagattctctcgacaaagacggcaagacatatcaggaatttctaagaattatcgatctgtaagttatatattatcgtaacgtgtttcaatcttcgaggaatgtaaattaattatatctgcaaatagtgcatttaaaaggtattaccagcaaggcggacaacacaaaaactcaagagaacgcatatggatgctgaacagtactacttaattttcataaatgcatgtgtctatccatttgataacctaatataccttataattaattgatgtcgaaagtgtcacaagcaaccggtgggaaccgtactatgcggatattacacctgcgagttcctaagggttaatgggaaatattacgtgaattacgacgaggaaagtaatacacacttgttaaattaatcgctaacttgtattatggcgaataatttccttaatttttcgtgatctgatgcagcttccaaaattcctaagtctgaaagagagctcgacgataaatccattgagaacatacagcgggacatgtgctacttcattcaccgtgagtgcgcacatcagcttgggaagtttttttgacaaggatggagttttgagcctgccggagaacaaaaccctgtctaactggagtaggagtttaatatagccagggtttctcgtgatctagatgcagctagcttgtatatgtcgtcggacggttttgtaagacattcaattacttgtatatgttatgtcgtcggtcgaattttgtcaatgtacatataggtgcttcgaaattatatatatgtatattattatgcttcatactccgtgtgtggctctaaaatacttgaaagagaacataatctatcgatagctcaattagttataacatccacgtgtgactctgaaatacgcgcacaaacaaaagtaaaaataatatatataatattgtttttaattttttttaaaaaaattacaccttcacaggcaggccacgtgtcagaagtcgggcagtccatatcttcgccatcgggccacgtgtccccttaggtcatttttcctagcgggccacatggcctaaaatactgtaagctgccagcgaagaaatatcttcgctgtcggccgtcctaaggctaccacaagcgaagatacttcttcgctggtggctggcttaattatgtccgccaccagtgaagaaatatcttcgctagcggccgtcctaagaccaccaccagcgaagatatgtcttcgctggc

SEQ ID NO: 32068 - DNA, 12796 bp, Oryza sativa
ctggtctttcctttgtggcagctgcgatttctgctagcggaaacccaaaatggccgccataaaagatggtttccgtagtagattcccatccatgtactaactccgttcaaaaaagaatcaacctaggatagaatgtgacctatccttagataataaatctggataagtctttgtccagatttattatcccaggatatgtcacatcctatctttatccagatttattatcttaggttgattctttttgagacagagggattatacatttattatcgtagattgattctttttgagatggagaaagtatacatataaacttgagtacgtttattaatcatcttgagggcccgaacaatataaatccttgttacttgttctctggatgcgatctcgcgtacaccatggtcccaacaatccccatactctacaaattaataccgttcacgggtatagcccgttgaaaaaaacctacgaacaggtcagcgactgtgacattagaagctttatgatagattttcctttttagctttatagcggttgaagaatgtaattttatttccttcatgttgaaatttctaatcaagtgtttcctctacgaagatgtaagtaatagaatctctacataaatgtattaattttggaagtaattaactcgcaatttctgattttttttattgactgcatttaaattaaatcgtctcaaatgatttacggataacgaacttactgttattaccgtcccggttttctggtggtcagcaagcttatacaagtggtattcactttcatcagggtttgagttatacatggaagtgatagaactaagatacgtccctatcaacaaattaaatagttgcatatatatatactagagctgatgctagcgcgctaaggtttcacggccgtttgagtcgtacagttcgtacacctagactatttttttcttctccggtacgtatagttgccaccggtttaacagtcgatttcagatggcacatatatatatatatatatatatatatatatatatatatatatatatatatatatatatatatatatatatagtctataccatggatcacaattccgaaggtatatgttaagattataggcatataatgatttaatctattccataaataaatcataatattacagatgaaaaactagcatgaacgcaccattagatctacacatgtaaactacacagtataacatgaacagatcaaatatgcgcaacatattgaacacgtaccgaggtggcggaaagaccggctgctcggtcgaaacttttcgtaggcgtctacgaaggcacgcagcacgcgagcgaagaggaagacgagccgtcgcggacgaacagggagcagtcgtgcaaagcgcttcccaaaaaccttattgctgccttctcccggtgcaggacgtcgaaggcacaagttctggagacttgctttcccgatcgcaggtgcacgccggcgagcaggatggagtaatctatgagcgacggcgcagcacagagtaggaggcaaaccctagattgatttcgcgtgtgttgcgtgaagacggcgggtcagtttatatagagaagggtcgcttgatcagggcgcccgcacgatttccattacgcgtaaccgaaccggataagtcgcgcgtaacttatccggactccacgccgtttgcacgcaccggatttttcggaacgtttccaaaacaaaaacgaaaccggataagtcacgcgtaacttatccggactccacgccgtttgcacgcaccggatttttcggaacgtttccaaaacaaaaacgaatctgaatttgcagcaaaacaaaactgcaaaaagaaactgcatctgcgcaaggtgaggaaccaattttggtggaccattcgacgcgtacatcgtgcacgtgcgccgcctgccctgccaggcgaggcgagcgagcgtgcttgttccccctcttctctccaccacacatgcttcaagtggctaggagggcatcctcccttttaaggaggtccccctatgctagaataagcaaggtggtactaaactccacatgcatgccatctcatgaggtgggcttttgttattttctaaagaattaatcttcgagtgggctaaggcccatttattaattccaacagggaactgcatatctgtttgtcgacagatttttggggcaaaatcacccacatttttccagcctttagatctagatccaatgcatagaaaaaaatgactacaaacaaactttttaccgtctgggccttaggaaacaaaaataaacaacaattaggctgaaaaacaagcccaaaacacagagcccaatagaaattagacacgaaattatcattcaaaactttgacacaatacaaatggtcggaaccatacaaaaacaaaccaaaaaaaaactctatactagtgtagaaaacagattcaacagtaatattttcactgcagagaaaacatgtatcaatcagtgatattttctctaatacctttaacaaccgatttgatcaaatgagcacatctcatatgttgagcttgaaatgccaccatgaaactcagcttctgcctgaacagcacatgtcacgattgtagaaaacagtgcatcagtaaacagctaggatatacaacgagatatctgcaaaaatggggattttctttgtgcacgaaattttttttgtgaaccaaagaaactgaaatcatataatcctttatgccaaaattaactctgaactaaaaattcataataactataaaatgcccatctagcagggcatcagcctccccagattcaacatagacattccaccgtgacaagttcaattacaagaaaaaatgaatatctagctaccaatagctaagttagttacaagaaaaaaataataagaattacatatgtaactaaggtatatttccactgtaactagactgtaagtggtgatgagttgaactgtaagtatgatctaagttatactagtgatgaatggtgctgcatgaaacacaaggcaacacagataatagaaaataacggtacaaaacttagcctacattactaactagcaaaaacaagtttgtgcctagggttcctcaaactacaagtttgtgcctaagaaaatgaagatgcctagggttcctcaaactacaagtccctcagttttcacacaattcattgataaaaccaatataaaaaaagttacaatctaattaccaacagttagttacagtgagagataacataaattacaactgtaagtgaggtatatttccactgtaactgcactataagtgatgatgagttgtactgtaagtgtgttttaagactacatgaaacctaaagtattgacttcatctgataaacaaaattcataactaaaaataccatttgaaaacttaactaaatcaccagatgtaagaagagggcattaaatacagatttagatcagccattcaaatgcctcaagagatatttttttctggggtattttcctaagagaaaacatctaaacgttacaaaagaaataaaaaaacactaataaaccataaaaggcacaagttctccttttctgtttgaatgaaaggaattaatagacacataagagttatgtccaggcgacacttgttatgcaaaaatcaagcagaatctacgcaaagacaaagaaaagaaagttaatgttggttgcatacactaacaggcaacataaatgaagtggcctcacacttgcaatgacgcaagaagcctagctaatttcagtaaaaacatataactaattcaaaaatggatgatgaccctacacatcattgattggaaaaaaacctacaacacaaggggaagcagcgcaaactcacacatattctaacttttgcatgcacaactgacaaaaggagtccctagggttcccaaacaacaagtgtcctagttttcacacaaatcagtaataaaccaatgtcaatcaattacaaaatctaactaccaacagtcagttacagtgaggtataacagaaattacaactgtaagtgaggtatatttcgactgtaactgcactgtaaatggtgatgagttacactgtaagtatgttttaagttagaattactataatttcatactacataaaacacaaaatatttaagttaggtagtctacaacatgattctaatgctttcaattacatacaccaaccatacttgtgttaaattacatgtaggggttgatagaacaaaggctcaagtaacaaggacagttgaaggttagaatatcatgcttacctattattatgcatcatatctgatcttcgtagaaaatttcatctagcacaaatttatatataaaaaattagtcatgacacatgtagtaaataaaaataatctaactacctacattcagttacagtgagaaactacaaaagttacaaccgtaactatagtgcatatggactttttacaactgtaacttttgctatattaattttccatgagaaagtatatgggtgtggggctagcaaaatggcaagcttcacgtaactagtgtatacaactatcaatctttaccaagtaagtacaatattgcaatggttcattcataataaagaataaaaaatatgcaagcatgcatgctgctgatgttctgaatgatgaaggaaagtacatctaaactttatatagaacaataacagaagggaattgtaacagaagcacatggaaatcatacatcaccttgttttgcaaattgaacacaacatatatctttaatcaacgcacagtttagatgtaagcttgctgcagcctgcacagggttgctcaatcaagattgtattgtagaagggatcttcattggttctatcgtataggacacaatgaatggagctctaaaggtgcttgcaacttaaccaggtgatccattcaaacaagatttaggtgtataattgacactgctttgtttcataaaacaaagaacatgataaaagcttttgttattctaaggtggacacatttacaatttattgttaacaaacacagaaggagacgtgcatgttaagaacagagggaaaaaacaaaatccccagtacaggacagaacaaaacagagggggaaaaagatgctagcaaacctgtaaatctgccaaaagcatgtccaatttactccgaaaaatgcaaatcacacaaaaaaaaatccccatctaccagacacaaaatcgagctcagtgacaagaccaaaaaaaaaatccagccatcgtttccaccgatggctagttcggtggttacaatttattctattcccaaatcacacaaagcagatgtacttaaaaaacagatcagacctagaaaatttcaaatagtgtgtagctttacctataaataaacagatcagagcactactcacctggaacttaacaaaataaaaaatcaacagctaggcaatctcatcggcatgacatagaaatcaacggatcaggggactaatcaaaacaagggcaggacggaagtgctccgcgtgttcaggttccatgacatagaaatcaacagatcaggggactaaaccaaaactaccgattccaaaatctaaaacagttaaacaagcatcagatccaaacattaagagctacctaaagcatcaaaacctagccggaataagattgaaaaaaaaatcaactaatgatgcaaacaaataggagacaaggagagaaaaatcagcagaaaactctccggcgagctgaatcaccatggcgacctacctctctctcgcgcgccggcaagccctctctctcgcccgcgccggcaagccagctctcactcaccggcgagatgactctctctctctctctccggagaaaacaatgaagagaaaagaaaaaaagagagaaggaaagagagcgagaagagagctgaggaaaaacaacggctacggagtacagacagaaaagcgtggagcccgacatttgagagggatggcccacatttgactataggcgcggtctgattacacgtgacgcagctgcatccccacccccgcatgcgcacgaatcatagcgcaaatcctacggtcagaaaaacgacaaatattaggagagaaatttaatgacaaatatctagcaaaatcgttccaacagtatatatatgtgatagtcgttgttggcatatagctagctagctagctatagtatatgccaattgagtgagctagagtgaccatcgatcgatcgatggggtcatcaacgacaagatttcctcacctcctggtgcttctttgcctcatcttgcgtttgttgtccctccatgcttggttgatcgatttcgacttcgatttctctgacccgtcgaccttcaacgtagacgacctgcggctgcaaagcgacgcggcgctgaaggagggatcatctgggatgatgatcgagatgaccaagaacagcacgttcagcacggggcgggtgacgtaccgcctgccgctgcggctcatctgggatgatcgctgccggacctcggtctcgtggggaagatgaccgcggacatcgagttcgacggcgccacgaacgcgctcgccctcacgctgcgcttcgacgacaacgccaccctcgcgcccgcgcacatcatcagcacgcgcgcggacgtgaagaggttgctgacgcaggaggtggccttcggcttctccgcgaccactggttcttggatcgagcgccaccgcatcctgtcctggtccttcaactcaacaacagttgctgtcgaggatcagcctcgcgagcagtcgacctctactagcttctggtaacttgcacgccccctgtactctccctcagtgaacaaaacaaattctagcggttaagtgtgacatcctgatctaattagaatttaacctgtgtgatccaagagagatagggtgtacgtttagcaccatcttgctagtttagtaagggtgaaaccaacttataatgacatgtctcaacatatcactcccgggctagtttagcaattgtaaaaccaacttataaagacttgtccctctaaccatattactccgggttaatcattttacacgaaataaatcaattcctattctttctgaccttttctttttacaaacctatactttcttgccatttgtttgcaaattgaaattttttttgtcatcttcagtgcctcttacttaccattggtttataaatcgaaaaattttatcttcaatgcctcttatttattaattttttatcaataagaaatattttggttaatgagagatatatatttcagtcttttgtcttccttcttaatttactgcttgggatgctacgaattgtattttttatgagggaatagctagattactctcttaaagttgctacttccggtaaaaaaaaaagttacttttaccattcaaaatttatctaaaatatagctacatttcctcctctcatccatagaatacacaatcatctctcgttaaatttctctccaattactttctcatcttaaacaatgataaatttttccatttagttttacccctctgtttagttgctttgaaaaaaaatataaattaaagatagttatattttgtggaaaaaaataggacaaaagaataccgtaggttcataagacataaccacttatatttttagacaactaacatacagacaagtaacatacagttaaatccatataatattatcagaagtttttgttttaacaacattagctactccactttgatatgcccaaaacatacattctacaatggcatattctttcattactggagtgagcaaataatagtattatcatatcacactcaaatagtataaactagctgcataatttgtgaaattatttagagctagtttaaattagaattaaatttgacacaatcttatttgtctgctttattaagtttgtttgttattaatcatctgatattttagttatcttactttgcacaacattaaagattgtaactttgctataacggaattatggttttcaggtgactgaagtcaccttcaaccttacactggtttgggaagggaataaggatggagaagctaagaaggggaggaacacaccagtgatggcgactctgcagcagtggcagcgcaacaaagagatcttcctctggcgatggtgggacagtagtggtcatagagtttagaatttgggggtatcaggggggggttgttccttacaacttagagggatggccttggatgtcgacaggaccagcgatgggctgtggcaatgggtggaccgcgaggcagcatgggcactgctggagccatgaggatggaagctatggtgggtggggttggctgcttggggtgggcatttggttagaccaaaacatttagtcttggtctcagccatgatcgaaatttcatgacatccatgagaatcacacaattgccaacaaatttcatgtccaaaaaatcatacatatgaaaacatacacacatacataaatgacatatcggctcttcgatcctaggtctaagtaggaggaatagttatcagggtggaggatggcagcgtgtggtcaggggcagacccagagggtagtccaggtaggcacagaactaccctagaatttggcccagaaaagaccaggtattcatttttcgtggcccatcaaagaaagcctgacccaacagaaaaaaaaccctaactctcttctctcccctctccactcactctcccggcctcccactcccgacgggcgatggtgctccagcgagccacgactccggcggccggcgctcccgtgactcgcaccgccgcgcctcccgcctccggccggcggcgcctcccgcgtacgcgcctcccactgccttcgcgcgccgcgccagcgcccgcgcgcccgcgccctctccgcccctcgccgacgcggggggcctggccgcgccctctccatcccgcgtcggcgcgtccggccggcgcccgacggcctcctggctcccgcggtcctgcccgacgcgcgccaggggccagatggaggtcctgctccggccagcctctgacggtcaagcagtaggttgtcgccggtgccggtgctggtgttgccgtctccttcctagcttgcccaactgagctcatcaagtgtaggtaattaattagcttttactcaccattgcgtgctaaatcctttcatctggtggttactgcactattcactctgagggtgcctgagctctgcatcatcgtctgtacataagcttctgtgaaattgcccttttctgcacatatcattcttcacccatcagccatgttacctactcgttcaagtgcatttcacatttcacactgatccttgtgctttataggtttttaagtgttcttacgttttgtcatatctccttagaagggagatataagacaactaattgaagaatttaacagtcaaaaacatgccttttactcctattcgatcttgtgtatgtccttggaagggatatatgagttttgagtgtcaattctctagacaaatgacatcagactgcgttttctgaacaactgtcctttttatcacaagcaaacttctacatatgttaaacaccatagatggttgctctatcaaatcaatattgtgagctgttgcaacataatagtacttactatttcgattgtattgtatttggattttttttttggctaggcctaccctgggttcaaatcctgggtccgccactgcgtgtggtaggtggctaggggctggggactccagtggtgctggtggcggcgtcgggcggtagagcagtaggaggtggtggtcggtgctggcgttggctaatgaggatagtgactccatgctggtagaggactaaggaggaggaggaggagttgaggaagtggctgcgcggaagaagaggtggtggtgaacaactcaggaggcatgcgatgcggagtcgcggaaaggcagcatgcgatgcaaagtgggacgatgtggtgtgcgagtgcgatgctgaatcaggacgggagaggttgcgtgggatgcagagctgagtgatgactgctataggttaggattaggatcttagtcgacctattggactgaaattcggtgtattcagctaaccaagcgtactaactgaattgaccaaacaaaatttggtcttttaacccccgagaccgaattggtgacaagatttctcagtctcgatcccgaccattttggtttaggctttttcttcctacccctattggctgtagggacaacgaagggtcgtgaggttaggagttagcagcgatgaatttgacaacaataggcaatggtgtcgccgccggacacgggagaaagagagaaggggaagtaggaggcggttggtctggtgggcctcgctagcgtcgttgacggccactagctagccgacgtggtaggagtgatgtggtcggtcggaggcaggaggttggcaacgagagagcacactgagccactgaggattgtgcatacggatgcgtgcggaggggacgtgaaaacggggagaagagaataaggttcactgttcacacacgaatcgagatgcaatcttggttgtctgatggattgtccaaaattttgggtattttcagtcacatgtaaactagacagttccttaatataagtatactgcaaaagatccatttttatttcctgaactgtgtgctaaaactcaattgatgtcacccctaaatttcaaattcaaataaataacgccataaccatgtttgaaggtggtttttgtttgacatgattctttttctttaatttgctggtttaggcttctgtataagtttctatatttctttaatttgctggtttagacttctgtacaagtttcaatatcatattgatgccgacgtacgtagatagatctaccttcgacaaacttctgttttatatatgcgagtatggagctagtattctttgtttgataaaaaaataggcttctcagttgttcaattttcgttccagtggcaagttatatctatctatctatctatcttctattatctactccttccgatactagcatatatcccatccgatactaagttgatatattctgatacagagggagtatctattatctattatctatctattatattaaaagtccattagacttcctagaacgctcataagctgccatgtggtatcctacaaacactcataaatcgtcacgtgtcactccaataaaatagaaaaaaatcgaatgaaaatctggaaaaacaaataggtggattttaggtcgttagatctatatatcttggaaaaaagaatatctcaaaccaccctttcacctgcccctatgctatatgtacgtactcatgcctccgttccttaatttgctttttttgtttatctccatgacaattaaacctgaattatctgtggtggcaagaaaataaccccacaaatcaacctccacctaccaggtttaaccggttcttgctctattccattttttttaactttctcctctagctggcacttaagaacaataatagacttcaaatattcataactttttaaatcatatattaaatttatgatcagtttgagcaattgtatttttaattaaaccaataattcaatatccatattgactatatttcagtgctaagagaagcatttttttccagaaccacatccatcttggggccttcactaaataaaagaaaaatactagaatttctaaataaaagtgaaaatacccccaccttaagttatttaataaaattggtggacctattgctcaccgttagacatctcacaactttctacgaatttagttactttctccaacatacatataagggctatttacctatacaaattatattgatgcttgtctaaaataaattatctttttagtagataaataaatgcctttctaaataaatgatcttcttaagataatcatagaatctaaattgtatatataacatataaagtcactaataaattagaaaaaaaattaaatgatatcatctttttacgtcataatgtgtacccatatagcctatttttatagaaaagtgattgaatataaaaaacatgatcaattgaacatcatattgaatcgtatcaagcgtgtgggttgtaccaggaatcttagcagtgaaacaaccctcaacaatgtaccaagtcaattccatattggagttagagaccatgttatttatttatttttggtaaacttgctatattatattataaattcatgtcatctattgtagaacactctagaaatgtgtttcaagcggtatatgatatccagtgcaaatgcaaatgatatatagtttcattgaaaccaaatccattgttgcgatataatatttttgttataaattcaaaactacacggtttcaagacattttagtttagaatttatatgctgcaagaagaatagaagaaaatcataacaatagttgagagcaaacccaaacaaattattgacaagaaatatgtttacaatagagtaaaggaaagttttaataaaaattcacccgcacataaacattcacaacaaaatttcaaacatagtaaataaggtgtccgcgcatgtacgcgggcttctttcctagttagaaaaaaaagatcgatttttgatgtgaaaaaaaaacagtcacacgacaaataattggcccatatagttgagattaattatgtacatgcatgcttgatcgtgacaaatacaggtcatcacaccaagctggcagtaatcgttggagctacgactgggtcgtctcttgcgatcatggcgctatgattcattctctcgcggtttagatggaaatacggagacggagcatttcaaatcgacggaaaaaaaa

SEQ ID NO: 32069 - DNA, 6501 bp, Oryza sativa
caaaagagtactctaacttgaaatgtaaaatatacactatatataggctatgtgtcgtacaaatttaagtcactaacaaataaaaatatttaggtgactaacacatactccctctgtccatattatatgtcattttggcattttcatttatctagattcacaatttgaacacttatataaatctatgcattaatctattcaaaatgtagaacatcttataaaacgaaagagaggaagtagcaaaactgaagtatacaatctatatctttagggagcatttactagtctcagtcgtttaagttttattgccaatcaatcagttttgcaactaacatcgagcaacttacttctcttttttaagtcaaataaggaatattaattctagcttaaaataaaaggttacactttggtatggatcctaccaatataaaacaaacaaatataatctatatatgcataaaaatgcatgattttaaacaaatattgatcgagtttttcagcagtggtacgtaccatttttataatgtataaaataaaaaaaatgagagaaacaagaagttgcagtattaagtatatatactaaagatatcttaccttgcaagtctaacctattcattgtgcagtttttgttcactgaaaaatatataacaaaaaaaacagacaattgacaaatagccaaaccagaaaaagaaacatactagagtacattaagcacaaaaacacatctagcttaatccctaaaataaaccaaaccgaactaattaaaagctgcggtgtgctagctgttgtactaagttaaaacttttagctggtaaataagtaaaaaaagaaaaggtgatacataactaagaaatgtgttattgacaaattgtctatgcatggaaggtttcagatagtgatagacattacttcagctctagtttacctctatcatgagtgccatacctgcatctcctgcatagagacatcaaaccaagtaacatactcctggacgaaggtttgaacgccaagcttgccgacttcgggctggcgaggatcacggaaaacgccaagggcaaactgctgatagtggccatggggtcaattgatcagtacatagctccagagtacaagatacacggcgagcttgaattaatatccagcaccgacgtctacagcttcggactcgtcctcctagagatcgcttgtaccaggaaagacagggagcagatctggaacgatatgtacatgaaccacgccggcgtggctgccgtcgccgatcccaacaagctgaagggcgagttcgacaagaggcagatggagcgtgtgatcatcctggggcactggtgctctatgaaagacccaataaagcggcctaccatgagtgatgctatggatgtcctgcagcagtacgactacaggaatctgccagatttcaactcgctcagatgagatctgatcagtgtcaagtcgaatgtggtcaggtgtgtctagagcaccctgcaggcaaccggtaatatatcccttaatcgctagcatcctcagccacgcattcacaagatagtcaactgtgtgaagatctcctggtgtttgatcgatcacttgtggttaacgcaacattattgttttactttttgtatatataggtacggatatggcgcatcatcggattgcaatattatttcagttttcatattgaattcgatttgtttttcagtttactggaggtaatatcattcattaatacttcctctatctacttttcataggcatatatattttcaaatctgaaaaatttatttttgataggcatatttcaatccaacaacctatcatcttaataactttctcggatttaatgcgtattaatgaatcctttgtttacaaggaatgactagtagcatgtttaaatagatgataagtagaattatttattcttggtctgtatatcaagaatgaaatatgactatcaaaaatagatagagagagtataattttgtgttcagttatgggttatctaaatcgttagtttgatttaacggtttttaagacatttcagaagttacttgttaaataattattattttacattgaaaatatatagtttctcgttacaaagcgtgatatttcgttaccgagatatcttttctttctcggaggattctttttttttgggtaatcagctgtgtcgaggacacccagcctgtacattatactagaatagaaaaaatgtccctgtgttgcaacgggtaagatgtttttgaatcagtatacgtgaaaattctttaaatcgggcgcccgtgcgtcccgcgcctcgccgaaaaatcgggcgccgcgcgccgcgcctctgtaacaccccaggtaaccacgtacctagagtgccacaccagaaaacactcaaaccactaacttccaaaattattagaaatttcggcagagtctctcctgtaaatacggacatccacgacaggcaattataagttaaactaataacaatatcattcccataatacgatccatccttataatctatggggaagaaactattagaaatctaaaagattattacaagaccaaaccaggatataatttaagtgtgattatggacctaagcaatatagtttgatagtgtgcaagtagatgtgtatataagggtgctacttcccgcccatgcatgccggtctcaatgcgtacctaaaactaaataaaacacaagagtgagtataaaaatactcagcaagtacaatatgaatctagaaaatacatatacacatcattgacaataaagcatgaacagaaggctttctttctttgataggaaacacatttccaaacaccaagtcaaagaagatagtagttcccatcctgggcaggcatgaattgaaatagtagtttccatcccggacaatagtgaatacatcctagcatttgccggcgaagccgagtaagcgtgatcacgttgaaatatattagaaataaatagatagagtaaacaatgcatgaatcacacaattagttcgtcatgcacttgcctccaataaagaattggtatcatgcatgatctgatggaccaccacctaatcacaaacaaaaccttagcaaacatattcaaacatgcgtataaaactatgaaaaaggtgaacctactgccccatcccatcaaaactcaataacaaggaacgccgcttggactatacacaggactgctgcttcaaacctttatatcttgaaatatgaaaaggctatgactgaaaatgtatacattttgaaaatctacagaacaatacatacaactttcgtgtcgaaagcatatttttattctgccatttaaatggtctaatttgcgcttgaaagcaggcttcagaatctgttcagaatttcagacagtccacactgaaacaaccataactggagttctactcagcccaatcagggtgtactttaccaatatggaaagctaagaaaaacctctacaactttgtctataggcggcctggctgattccactgtttaacccctccaaaaacagttcaatctactactatccagattatgacacaaaaacaacagtcatactaaaataattatatctcctaaaccatttgagatagaatcacaccctttggtcagaagatatatccaaacattatctacaacttcctagttatacacttttgcagaaaataacatttagagccccgaaacatcgaaacactgaagcactgcaaatctgcccacatgcagaactacaataaaccgaaccgcaactacccaaactccttctctagctttccctaaccacaaattaatgcactaaagccatgctagaacaactgatacaacaaggagataagcctcacctagggtttctttagagaacttgtgaggagacaataggggagactccggtctaacccctcctactcctctcctcctcctcgttccgttttctaattcgcttcttgatccaacctatgaaggtggagatctagggagagcaatttgctgtagatgggagagatgcgaacacaggaggaggggaggaaagggcgctggccagggagaggggtggcggcactatgaggggaggtgagattcggttcccctctctctaggttttaggggagaactaatgggctgggtttatgggccttctcatgttggcccacttctaaagatatttttcttttatttatttctgttaacatctttattttaacaagtcaacccaaactaaaaaaacctaaatatcttttaatatatagggtattacagcctcatccttgggttcatcattattagctttatcacctttagccttgccatctttagatgtgcctgattccgaatcatcattgggaaccatctttagtttatacctttggatgaccgttcctgagcgagtttgcttgaatgaatgtaagcactgactcttcaagttgttcatcatctgctcatactctaacatctgttctggtgttagcttatccagtgttattggaatgatgttgtcagggccaatgtcagatggtggtttagaagtctgcttgttgtccaccatgatgaaaaatgtcacaactcgcatcccaccgagcgtgccaaaagcgtgttgatgcgaaaaacacacactgacctgggagatctgcttaactccaatacaagtcctaaatcttgctcttgggttcaaaggcgtgccagttgatttgatcctacaatcaacaagaaagaaacataaagaaaccgcggttaaatccataaacgatagccggtcggctaggagctgatgacatatcgtcaatcattaagccgattttattggcaatagatcggcgatgaggaataaagcaatataaagttatatttactcgatcggctgtagatatcaacgatatataatccttctcttggaatatatttaaattaagtgattgggatagatcgagcagcaagtcgagacagtataaatcacttatatttaaagatactttaagataacgattatacatacgtttatagcatagccgaacaaatagatctaacatgtatcggctaatactccgataccactctatattaagatattaaaacagacaaaatatattaaatagccagcctaatatactttaatgcaataagatcttaatataaagggcagatttagcatgtcaagcaagcatatagggtataaaatagctaaatcaggtaagatcggttgaaactccgatactatttctatcggtgatcagaaaacaaactagatattgcagttatgaatattatttaatagatcgaactcaatcatgcagcattaagtataagaataaatataagatctagacaagatgatgaaacctctaaaatatggtggatatgttatataatctagattaataacgaaatctaactcgatcggccactctccaatgatagatatcagccgattgcaggttagattgggaaactaataaggattataaaacatatatgataactcgatgatttacataaacaagattagagtgtcataaagatgaaagcactaatcccaagaacgcaagacgccataacaagtttaccttttgttgaagatcgaaatcgatgtagctcaacccaaaagcaagaactcgtcgaaataaaagtagaaaaagggtggtgatgcgccgaaagtattattgaactgttgttgtaaattacatggggtccagtcatatttatacccgagatacatgataggtccttgccggacacgactcttatctctaacaaactctaagatacaaacgaatctttatggcagattcttgccgaaacatatctctaaagaaattattcaaaatatcctaattaatagatacaattgcctatctgtgagcttatctctatcgcggtaatccttgtgtagtccgttgatcgatcccaaagacggttttacagccatctcaacgaaatcggctatatcggctgtatcggctatcttctgtccgacccatctcagccgatgcagtcctcagccgatgcccttgcagccgatgcgtactatattctttgtatacgattctccgccgtgtcacgtcccgtttttcgtgtcttctattttgctcgatttgaaaattaacgttcatgtttattcgcctaaaatagcttaatgaaaatttcataaatgaaaaagggtttaatttgactaaataatttaattatgccgcccttttattttacggtttgttaattggagttatttaatttttatttgagttttggaagtggagctcaatttgatgaattctcccaaattcttaaaaaaaaatcccaagtccaagaaaaatctcaacattttccttttccttttccttccttttcttttcctttttctttttcctccctgatctaggtagatgcctcttctcttttttttttctctgtaatgatctccatgtctctatctccctctgatgttctgtctctctctctctcccattagtttcacctttttcaatccccaatcaatatcctccactaatatta

SEQ ID NO: 32070 - DNA, 498 bp, Oryza sativa
ccttcatgagcatgagccatttttgtaaaagccaatgactcctcatctccgggctgcttggctcctattcttctctataaaaagatgcagcacccctcctccttccttttttgtttaaccagtgcagccactgccagtcaccatgttggctactgcttcatcttcaagcacgatgtttctgcttcgctatgaaggtcatgatgcttccctcaattccctgctcgtcccttccgctcctcatctatttccattgatcaataccaaaaatcaaatcaaattgatgggcttatctgtttttcgaaatcccagccacggccatgtcgtgctgttggcacggagatatatcaaaccgtcaacgcgagaacgagcagctgcgtgggagaatcaatcctgcaccatcatcgttccgtttccagcaccatcatcttcctgctactaccgtctcctctttgctgcctacaccggaaagttgtgccgctcttatctgctacggttggt

SEQ ID NO: 32071 - DNA, 4634 bp, Oryza sativa
  unsure (1)..(4634): unsure at all n locations
nnnnnnnnnnnnnnnnnnnnnnnnnnnnnnnnnnnnnnnnnnctgtctcctattcacatgctttaaaatagatttgagtttaataattgcgcgtagtcttttatgagagtcgatggttttccatatccaacttgttatgagaaatgtgagaaaataaagttctgttgagctgtattttatagtcaacagtactgcagaaccaaatgttcgaagcaaatgcacagaaactttggtgtttttcccttacaaagcaagttactgaaaatttataaacacattttcaaatatgtgacgatacgctttgactttttagatggcttgctagcagacaagagcgaaaatacagcttcgtccgagctatttgatgaacgcacaagcacctcttctttatgaaactcaacagatccaactgatcctgtgtgccctaattaggatatttctctcaattaatttaaggctgttaccagaatttttatttcaaatgcttccttgaactacaacagttcggatatctctcaaatgcagctgatgtagatagccctaattgaagaaacagtatatttctttcgaagttgcaactcaattttttcttgcttttttacgtaccttcgtacatctaattttaggtttctactataccatagatacttgtaatccaaacatcctttttaagacgtacatgcaattggagaccactgaagtgaccagccactgccaggttgtggtctctgcttcttctaataagtaaccgggtttcttcagaaccgacggatcaaattctacactcattccaaaatactggcatggttatattatgcataaaaattcagaataaactgaaaggttgatttcaaatactacagagtgaggatggttattataaaaatttcagaacatgaaccagttgctaatccacggctgaaatccaaccagcagagtgagggttcaccctggagcaaagcagctgtgcatcattagttaccatggttaggccctgcaagtcaaatacgaaaatgaatcaatcaattaagctgaaagtagcgtaaaagattctaccttgtatctgaactctgaaggaagcagtatgattaaagaggatcacaccatccattatgcacttcatgaacagcatagatatccttattcattcaaaccccctgatctgataaatgaatcgatggagtcaacatggatagcagttttcatttcattttttaaacaacgagtcccccttcagcctgaaacaatgaacagtcacaaatgtatcaactttgatttaagaaaaaaatcatagaagtaatttagtttgttatgatagaccatcctctataaaattgcaactatcagtctcacaaatagagaactgattaatgattaggtcatgccatagactattcaattttagttctgggaagttcagttttctaaacatagctcaatcagctatataatcacacaatactccaagcaaaagagcacatgcaaaaatagtcctttatcgtctcttgttgactgaaaaagctttattgtctttcccattttttgaatggagtggcctgactatttcttatgacaccataatgaccagaacccgaagaaaacattgccaggttaaaactgaaccatgtattccgtaggctagtagcaacccatacagcagctgaatttttcagaaatgagagtgtttcatttcaccatagtttcagaattatattttcagaaatgtttagacaaaataataatctgtcccctgtctccatgagcaatcaaatttcgaagctggcaccataagttagcatcgctccagattctatttgaactgacatacaacttaaacgagaatagtgtaccaaatatacaggaacaactgaaaacatatatagggtgaataatgtgaggatatctaaaaaatgtggaattttcaggagtggagcttatgacctcttctgcattaagtggatgttttaacagcttgcttctcaacgctaaactgatctaccaagctgaactgcagagaacaggcaaaccatcataagatgaaagaaccggattcggcggtgactcttggaggagccatgggcgatggtcaatggcgagcggcaggaagcccaacgggagatcgaggcatggggaatcgacgatgcaggatgacgatttgcgctatgaggggccggcgacgagcggagacaggacaatcggcaacaatacctgaggatgagggtgagaagggaggggatcgacgacggggaggctcgtgcgacggcgagtgggcgggtgacgggatggatgtgggcgtgaggagggtgtgcgaatgaaaagggggaggagattggggcggtttccggcgtcagcggcggagacggcggagggaggcgtgggagggaggtgcggtttctgggagggttgtgggaggaggaggtgcatggggagggggcgtgggaggggcgcgatcgggagggaggcgtcgatgccgtccgatacgactcatcagattaatttggataattggatatgtgacatgatgaatgatgaatgagtaaaactatttgtttaactatagcctagactagtactaagatcaccttatactatcttttatgccggcgtttttctttagaccaccattcagctaatgttttcactttagaccgagtaatcttgcaattatttcactttgaagcactccgacttgcttcttaaccatatgaacgaccatcaactacaccagctcctattcgtaataaactccatcagctatatatgttgaccgttactttgacatatgacaaattggatataaatggataaaagagttgagagtgatccaaagtaccataaaggtaaaattacccggtcgaaagtgaaaaaattagttgaagggtggtccaatatgaaacacgagtaataaaagatgacccaaagtatactcaaatctgtattatagatatgtgaatggaaactctgaaataaaactgttccatataaggttcgaggagcgagcaatccttcctagcaacatcatttaggaatgcaaactatatcaactggtgatggtggtaattcactctgagggtattctggctgtagattggcaagtaggctgaaacagactatgacagttgtcttggcaaaatataatggtagtcctaattgtcttcgagtccaataatgaacaaaagatatataaaccaaaatgccatacacaattggaattcatacacaactaccagctattgctgctctcaaatgtcaccattctagctatttgctatcacaatctccacagctctccccatacacaagtggctcgcctgcaacctaatggccccctttacaaaaaatgatttgtgtagtaatgaatattaagttagtaactcacagaatcacagtgacgaggagtacattacaagcgacgggcttaatttgcgataaatttgtagtccaagtctgaaacagtaataagtattggtgagcacctacagcctcaagcctagcagagcagagctagccatccatgtatacgcatgttggcatctgttcagaaaactgcttcacctttcaagatcgttatcttaccataacaatttctgctccactcccctgattcaatctccagaaattgaggtgacaagatagaaaaaaaaaggaaacaaaccttacaatgtatctagaagttaaaagtagacagaaatttattctataaattaaatatgtaagaatggtacaggtattgggaatggaacgacggtcgcaagcatatgctgcctgggctgtccagttaacatgaagaagacacatcttaatcgttttctcctgtcacctctggcatcatatatattgctattttaattttgttcttaaaccatattctatgtccaagctaaaaataaacatgttattccagtactgtgatgacagaaagaatggctcaaattacatatatttctcaataatctgagtagtaccaaatttagtattcactgtggtttaaggactatttatgatcataatttccatgtttatctagaagcatttatttcttttgattggctaatatattagtatagtattatgtttatcaactttatatttactcaggtctaaactttctaaaagacgagaatgggctatgtcaatttgtacttcactaaccgtaagtctgtaaaactacgagctggagtatatatgttttatataccatctacactgccatttccatttttctttgttatacctcagatatatgttagcaaccttcttcaccaaattaaatagcaacaatctctaattcaactcaatcacatgtatttgttggaaagtggtaagaaataagctatacatgattctagaaggttctagaacattatagaagagatagtatgaggagttgagagggatagagacattcacaaggttcaattcatgcgtaaccagatcaccactcccgagcctctaatgcctttcttctattcgatgcccataaattcagctgcacaagcttttgttccctatcacttgggcttgcttgggccttttgtgcagagcacctaacccagcccatgatgcgcccattcgtggcatgaattttttttatttataatttttattattaaaagttttacaaaaataatttt

SEQ ID NO: 32072 - DNA, 2501 bp, Oryza sativa
tgtgcggggggccgcctgcaaatgggcggcgagggggcatggaattttgcaggcggcccccttgccgccctccgcgagggcgatttttgcctcccccttataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcggttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaataccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttg

SEQ ID NO: 32073 - DNA, 33510 bp, Oryza sativa
taattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcatatgttcacatttcaactcaactttgctttgttttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttacctgtaggccgaccttctgcaccctgactctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaatatagagcacagtacaaaatcgccctcccccagggcggcaagggggccgcctgcaaaattccatgccccctcgccgcccatttgcaggcgggcccccgcacagtgcaaaatcgccctcgcggagggcggcaagggggccgcctgctaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcttcgtggcataacccatccgtgacgtgtagcagcgccccaggacaagatggatataggcctgtttagttcccaaataaaagcttttcgatcaccctgtcacatcgaatgtttgaatatatacatagagtattaaatatagaaaaaaaactaattatacagcgtgtaaattgcgagccgaatcttataagcctaatagtgtcatgatttgataatgtggtgttacagtaaacatttgctaatggcggattaattaggtttaatactttcgtcttgcagtttacaggcgtaatctgtaaattgttttgttattaaagtacgttcagtacttcaaatatgtgtttgtatatccgatgtgacacgcaaaaacttttcacccaagccatagcatgagatatgacctaagcagcgtacatgccaagcccgatgtagataggcaaaagtagtaatccctccatcccaaaaaagacattcgatatattctaacgtaacaaatctggacataaaatatgtatatattcgttgtattatgatgtataggttttttttgtttgaatgggggagtactattttaggtggcactcatacacaactgcttctttaagatgcaatcgatccaagtatttactacggtcacaactactactgccaaactaaaagaaaacaacttaataaaaaggttatgatttggatggctgtgtgtaaatattgtggttggatttttatccactatatgaaaaaatgatttggagatgccatgactagcatgtgtagctaggtatatatgttgaatgaagcatgttcacaagagcatgcagtgagtcagtgacatggagtccagtattggagggcttgtcaataaatgtttcatctatggtgaccacctacaattctaggccatgtttagttccaaactttttcttcagacttctaacttttccatcacatcaaaacttttctacacacataaactttcaacttttccatcacatcgttccaatttcaaccaaactttcaatttttgcgtgaactaaacacacacccctagtgaactacaaatccaacgcagcttgccgtcatcgcagacatggcatccataaaagtcagcttcggctttcaaatgtcacagatcaagacatcttgagctaccatcacaattgttgtacttcttccctcaccaaatccgaagatccatcatctcccataaatcgagactgtacaaaactgagaagaagcaaacaaagcttatgatatatctagaggattatggggaggggaaaaaaatatggtttctgtatctcaaaagtataggaacggtgggcattgggaatggcgttatcgtaggcaaactgtagtgtcactgatgtgaagaacagtctagagcttttcctgatcgatggcatgaagcatttagctatggcgatgtatgctgaggttaccaactatctcggcacgcactcctcaaccacgctgcccgaagggagatgccacgacatggcctgttcacaaggtagatgcggctcgttgtacttaacggccgctgcttcaggcacgtcgagactggtgctgtggaattgtagacttgctctgcactgtctacacctgaatcgcgctgacgctgcagcgatccccgtgcacgtgatcttcggggagctcgctgcgtccgaggcagccaccacaatggtttcatgctgccgtgttgggctccgatcttccgaggccctcgtgggaagtgaattgatggggagcacgtacatggagcaagcaagcctccatgtcctgtgtaccaccttcatcatcctttccttcagcagggtttgcaatctccaaattagggttttttttggcgggccgggggaggggcgaaagaatcgaaattttggaagtttcggaaaatttctgagccgaaattatttagaagttttacgtatttttaatgaatttgaattaacttcgaacaaattgaaaaaatgaaaaaaaacccgtaaatttcagacgagatttgtgtttacctgtgagtgaggaaatttctgaaattgtaataactgccttccggtcaaagcagcatttacctttttcagcttttcacttcactcagagcccgaagcaacaggttggtagtagtactcaacaatcactgtctagtgttagtttttttttttaaaggaacaacggcagaagattccgttctgccggaatttaattaaggggaaaaggaaaaagtttacaatcccaggaatgggatttcaagtccaaaaacaaaataaaacaatcaagggtgcctaaaggccgatcttctaaggtctagatcttccatgacaagatgagctacctgataaactgtacaggaacgattattgaaaattctcctatttctttctaaccaaatatttcaccaagtagttaacagtgctcctctaacgtcctgcttttgatttgtcgatccatcttgatttacttgatcccaccaagtagagatatttgccggctataggatagggactagtagatttcgccaggaatgaacgagagtccaaacttctctgacatacacacagtcacagaaaagatgatttgtatcctcgaatgtagacgtgcaaagacagcatatccagttgcacggccagtgacgccttagcaggttttgggctgttagggttttgtgatgaaggatcaaccacccaaaagatcacatttttagctcagctggtgacttccatagggcatcaaaatccaatcgtgcaaaagttcctgcaaattgataggagtaggcttctttactagagtaaaccctggaaggattccagttccagttaatttcatccggttgttgggagagttagatatcttggatcattccccccaagttgcactaggtcatgcagctcttccactgttgtgaattgtcagaaagaaacaatccaattgtttgacgaaatttcaaactggacacatcgttgctttcgtttggctaaacgaaaacagagaggagcaacatcctttggacataaaccgttaaactgtctagtgttagtagtactcagcaatgttagcatgtgctgatgccaatgactaaaatgcaagaagctatatgcatgtagatgcatcaacgccacaggatgaaaaactgtattctttcaattgctaacagttttccttgaaacacattgttttgatgttacataatcttttaatttccagctgggccacataacaattagcactagtgctaacacgctagtggagaaaataggaagtccttaatatttgatattgcagtggcaagcatcgcaaacagaggttatacactacacatccattaaactcactgtttctaccccttgcaggtggcgaatcgatcatctagcaccgccggcaggctctctgccatagggatctaaagcgtgctactaaccggcttgccagacgcatgcatctcaatcatgcttaggccttgttcggcaggcccatttccaaacctggcctggaacagttcctggcctggattgaatggatccaggtaaattcactgaaagtctgaaaccacatgtcgattgaatccactccttttcttaatccacctcttcaaaaaactgcattcggttatttcttaatccatctggaatgaagccattcaagctgccgacgctaagtccaaagcactagcaggatcagaagttaagcagagaaaaggcaaaggcacatgaagcaaactggcttatatatgtatgcgtcgttgggctctgcacatacatattatgcatatataaacctgagtatatttatagcagacgcatacatatgcaaagaacatgaagcaaagcactagcaggatcagaagttaacacacaacagaggaatcagttcagactaggtattttgccacatgggtacggacccttgaaatgcctgcagtagaaatgataggaccaattatagaaaaggcatgtgacattatgacattacagaaaaatggtcaccgtgtatttttgaccattttgttgtatgaaaatggtagatgggcacatgggggaaaaaatatttgagaagtaatttacacagcatcatatgcaaaggcgttaaatgcaatgcttgtcgtagcttcaagcccacaagaactaatagcatcatacatgcatgtatgtacggaatgtaactcatctatattccaaaatctaatatgaaattcattttttccagttaacaatgtcgatttcaatgtacccagataaaattataggatgtatagtttctaccaagagagaagggactaaagtcggcaggtttttacaatatgctatgtaactgtaagcaccataagcatatgcgataactgctaacccagttgaacggataaaagaagaaattcaaaatgctgctgtccctgtagaaattcaaacaaagtatacttttttatttctcaaacatatgtcagcacactacccacactaaaacagggaatttttttttactgaacttggtgtcatctcagccatttcatgtcatctcaagcagaaaacaaggacaggaactaacctttggtgatgctaggccatttcacttctcagccaaattaaagcagactctaagtcatcttcgtaggcgccggggagagaaaggaagaagacgatgcattaccggcgagaaggcagcagagagcgcggacgtcagatgggaagaggtcgccatcgccgtcgacgctggtgcgccactgcgtcgcctcctcgcgtcgccagccgcgcgcgctgtctcctcgcttcaccagccgcacgccgccgcctcgcatccggattggagctggagggtctgatgtgaggaattgatccgggccaggaacaggggaagggagggaggccaaaccggccccgtttccaatctgggccggccaaaacgaacgacgcttccgagccagaccagatttggaaatagaggccgtttcgggccttaccgaacgaggcctaaggcgttgtcagggatggccggaatggagcaggcggcgctcgcggagcttgcacatgcaccactccaaaagtgtatttgctatgaattaatatacgactcgaggggctagcggaaggagccgccagcgagaggatttctcgagaggtaagcaaattttattttttaaaattttatcgaatgcaagcaatctgccagcaatccagagaagaaaaaaactaaatggtaaacctacccctaatcattgagtttgtcaagtaataagaggaaacatattcttggcacacatgcttcccatgcacactccatgcacaccaactagcaaatgtcacgaaaaattatagaaaaaattgaacacatatttttaatagtattacacatacctatgaaatctcatgttcaaattcattatattttagccgtaacaaaaaagacaaaattttgacagatttttactcttaaaactgtcaggtttttctcctttttattacggctaaaatacaatgaatttgaatataagactctacagatatgtataacactattaatagtacatgtcatatttttttctagaattttccgtgatattttttagttggtgtacatggagtatgcacagaaagcacatgtgtataggatatgttaaaaaatgtccttattaaggaacggtccaaaattatttctgtgagtagtataatataactagtagagagtacagtagcgtttctcatataaaaatgctagatacatcactgccatgcgcagctcaatgtttaccccgaaaaacaaaacgaattatacaaggattctgacctgcaagcagtatactcgggcatcactatcggtctcatcttttctcttatacttataattatcaatcaaaatttaaattttcacctttacatttggagttgattttgagagctttttcattgaagtttaattttcaatatttgcttttagatcactgagaacttatatataaaaattttatttacaaattatttttcgtttgtaaatatgccgttgggccaatacttcttctgtcctaatatgttgctatctaggataggatttgatctatcctaggacaacgaatctggacataagtcctaggatggggtagcaacattttggatcagacaaagtagcatatagctggaggtccagcatcaaaagcagcagtataccaagcaatctagcattccgcctactgcaccagtcggccggcaaccactaggccgcaaagctcgatcgctcctcaccgtcgtcaccgacgtggcgtcttccaggtctctcagcaaatgtgttgctgagctggtggccacaccacctctcagtctcagctgatatactcttgagctgcctcttggtgatgcagtaggccgcagtagccacagctgaagaatgcccttttttttcacgaagatgctgaatatatatcccggtttctgcatccaagcgccgcctttgccagtcaccgtcaagacgcaacttttcatttggtcgacaggtacgtcggcggcgagagaaagaaaaagaaaaaaaaacaaagaagaagcctgcaggatcgaatctggtgccggcctgtggccttggaacaatgttccccggtccaatccacgctgccggccgctagctcgctcaggcgatcaaatgacacgccacacggattctccaccaatcgatctactttcagtatcaatctgctagcacactggctgactggataagatgtactcgttctatttttaaatataacaacttttaaaatttatttatcatgtcaagtaatatttttatatatttaatctgtatttcttctcaaaaaatatcaccattccacaattttttacctattttttcctaatcaatcgtaacctttatccattgaattttacttgttttcttaacaatctcttatgttatttcttatccgtgaagatatagatggatagatagatagtacttgttgtcgaaacatgaattcggcaataataaaaggggttagcgcacgagacctaaaagtgaatggatgcgaagacaaggatttagacaggttcaggccctctcaatgagaggtaatactctactcctgtttggggatttgaatccgccgggtgtagtatagatctgacgatcatatgtgctcatgcccctcagagggcctcctgcccaccttatataggatggggggcaggattacaagatagaaaccttaaccaatacggtatcggtttcctaaatctattttataatattatcaaatcaggactttaggccgctccataatataaaaggaaacgtaatacctaagtcatgatcggttacatattccatagatataagttatcccctatgactagtcggataaccatgccatgtgggtatggggtacccataatctccacagtagcccctgagaccttcacagtcagaaaaataatcttctctcgaactagattactccaaagccgagtgcttcaatcatcttcgccatgatttcccgagtacttttaccaaatatgaagactgtggagggctgaaaaataaagtcaggtgcatcgaatagatgtacctaatagatgcaccaactgaatggttttgataattgtagtcaaccaagtgacttaatattaatatatagcatatgcagtgtgaatccctgaataacatgatcgagtgatataccgactgctttgtaaaatatgatgcgtgcaacctaaagctgactacatcattgaatacacatagcaaaacagctataaagaagcttgtatgttgtgaataaataaatttccaaagtattgggcatacaccatgcgcacactgctttaacagatgtgcttgagcccctaaaagacacatggtttcaccacacctggaaatatatagcatatgtggtataaaatccgagtaaatgaactcataaggatttatcaatcgtttggaaaatgaccaaaatatataatcagcctaagccataatattggtcaataaaaatgcacacttacgtggcaaaaagcaatgatattgtatccaatcaattgctttatgaacccaaacagcgccttgacttatataaaaagtcagcggggagctatataaagcattactgtttggcaccttttaaaatgtattgtaccaactcctaaaaagttgagtaactgcggtataaaaggattttaaggtattgggcacataatcacgcgcacttttgccaaagcaaaaagatgcctaagtccctaaaagaacgtgacaggccacacctgaaaatatgagctgcagacatattaggcctaggccaaaaaatatacctttgacaccctttaaaggattacgcatgtaacatgctctcgagtaataaatctttcaggtgatatagaccaagtgtagctcatatgaatagcttctgatctgagtgattatcctttatgggatactccaaaatagatataacaattgaattccgactggcgcaagtattaggctgataacccatacggggaataataaatagtctagtctttgagcatagaaaatagacccatgatcatcaaattcatgttgcatgtatccggaacaagtccaaattggagatataatcctcacgcttgagttgatgagcccctgagcatatagcttgtccttctgtcatagtcaccattgtccattgatggtagctgacgcagttggcatagagacaagacgaccaatatagagataatattgcccaccagaggtggcaaaaatattgttagtagtgaagatagtgataccaatcaaaagtgatgaagttgtatagccgtggaggcgaagaaaccagtcggcaacagtcaggtcagccagcaatgaatatgaaggcgcccagcgataaagttgtgtagccatagcagcgaaataatcagttggtgacagacgatgcagctagtgaagaagatgaagatgcccattagtggcgacataataagccatccatgaaggcgaggataccggtcggtggtgacgaaagcaagccgacggtgaagatgtagacacgcatcaaaggcgatgacgaaatccaccaatcatgaagatgaagaaaatagtcggcgacgacaaacgcaaccaacagtaatgatgataagcagcaatcatagatgatcaaatataatgacgaagttgcccatcaatagcagtagagtgggctatattgaagaggcttgacaggatgttgattaagataacgatgtcggtgatccagtcgatagcaaccgtgaaagtgaaataataagtcggcgaagacatagtcatccattagcaacagagttgatgtcagggccgatgaagcagaggtgctggtgatgatgtcagtgacaataatgcatcaaattggtgttatagctgttgcagatgcttcacttggaggaaagtagatgatgttgtccaactcgtcgaaactgagctgattggttgataactctgctctaaagcaaagacgaagataatgactcctggaattgactcgttggctgataaattgattgcttcagcttgtcgaattttgagagtcttgtatttgtgtagcccccgactctttggttagttgggaaacaactgaacatagagtcgagaactgtaacttcttgtcgtcgagtagtcattgcttgagtgaagataaatattgaagactggaacaccacttgttgtaataaaataacacggcatcatatttggtgacgtatgccaaggtgtcgaaactcttgtagtcgtcatggttggtgaagtagaggcaatagagtttgctgatgccgaagataataaaaatgaagttgctccaccaaggtgacaaaattgcatagccgtgatgaagtgaacacgggtcggcggcaacagaagcaaactagtagtgaagacgcgcagttgtgaagattaaagcaccagtcggcggcggcataaccagtcggcaacggaagacgatgatgtccatcagtagtggtagctgtataaaccagacgtagaggcaagggcactagtcagcagcagaagagatgactagcgatgaagacgataaggccaatcaacactggcagaatcatgcagccatgggagtgaagaaaccagtcggtagaagacgtagacagcttgcattgaaggtgatgatgcctatttgcggtggcggcgacgtggccagccgtgaagacgatagcaccagttggggtcatacgaggtggccggtcggagaagatgtagacgtcctgcaatggcggcataatgggccagccgtgcaggcgaaaacaccagtcggcggctgacgaggcggccagtcggtgaagacgtagacgcccaacaacggcagcataaaggccagccgtgcaggcggaaacaccagtcggcagcggatgaggcggccggtcggagaagacgtagacgcccaacaacagtggcataataggccaaccgtgcaggcggaaacaccagtcggcggcagacgaggcggccagtcggtgaagatgtagacgcccaacaacggcggcataattggccaaccgtgcaggcggaaacaccagtcggcggcggacgagacggccggtcggtgaagatgtagatgcctaacaacggcggcataataggccaaccgtgcaggcggaaacaccagtctgcggcggacgagacggccggtgaagaggtagacgccctacaacggcggcataataggccagccgtgcaagcggaaacaccagtcggcggcggacgagacggccggtcggtgaagatatagacgcccaacaacggcggcataataggccaaccgtgcaggcggaaacaccagtcggcagcggacgagacggccggtgaagaggtagacgcccaacaacatcggcataataggccagccgtgcaggcgaaaacaccagtcggcggcggacgagacggccagtcggtgaagaggtagacgcccaacaacggcggcataataggccaaccgtgcaggcaaaaacaccagtcggcggcgaacgaggcggccagtcagtgaagaggtagacgcccaataacagcggcataataggccagccgtgcaggcggaaacagcagtcggcggcggacgaggcggccagtcggtgaagaggtagacgcccaacaacagcggtgttgtgaccaaccaaccgtataggcgtagacaccagtcggcggcgacgacggcgagccggtggtgatgttctgactgatccattcctggagcgtaagagataagcttaaagccatgaatcccttttatgcatatctggatttggatcctgcagaacaaacatataggatgagtagtatctgatgtaaatataatactcgagaaaaattcaagcattttaaaatgtttataaatatgtatttcttttcttgttaattttgatttccccgagcagatgactcattacgtttaaacactttgcccgactagttatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatacttttgatttattccgaataatacttagcaccttgcgttactcggtctatccaacgagcccccgggtgctaggaattggcccaaaggcaactatccatgacaaaccaaacggaaagcataggaagatagaactctataacttgatagacacttttgtactcagattatgtcgcaagcaatcaagataaatattatgaaaattattgaaaaatatgatataacatctgtagcccccgactcactactcaatggagaaccaattgatgtagtgaggcagaggaaaaggaaaatatcatataaggaataaatgatgacttagctttgtaatattccccttggtgatggcagaggtggccaatgtgggaataaagttgtccatcaataacaatgaagacaccagtcggcggcgacgaaggcggtcgacagtgaaagcgaagatgctcaccaacagcggcataataggccagccgtgtaggcagagacaccagtaggcggcggcaaaggcaggccggtcggtgaagacgtggacgcccatgaacggtggtatgaccaaccaactgtataggcgaggacactagtcggcggcgacagaagtaggccggcggtgaagatgacgattcccatcagcaacggccaatggagaggcgcagccgggtcagcgtgagctatgagaggcgcagccgggtcagcgtgagccatgcaggggcgatagtcgggctcggcagcgtggaagcagccaatcgcgaacttgttgagacggtcgacagtgtcagcggatgtagccaaccatgtaggcgaagatgcaagtgagtgcgggctaacgcgcggacaaatcaagtcgatactccgcggcacggcgacggcctgaccaccacggcgtctcagtagcatatgcaatcaaacaaataattaaattgatcagcagcagcaaggaattaattaaagataaatgcacaaatatcacgtgaggtgtgattggttgctggcttgatgggcatgcatgttgccgatgcatggtcctgtgcatgctggtgacgtgtcatcgtatcatttgttggccatgttgccattcacagccttgttgaatttggttgttgatgatgtcgccggtggcgaagacgaggagcttgaggatggcgagagcgatgtcgcggtcgtagcagggatctgtcgacgtctcggactccttcgcgtgatgcaacccgcccgactagttgacgatgacgacgcggcagcagccgggcagtcctcaccgacattgaagcggcggaggaacagatccgcgactctgggaggacggcggggagggaggcgacgtagtcgtcggagcggaggaggcggaggtcgcagccgcgcgcaggcggcgtagctgcgtgcgcggccctggcgtcgttggtgtccatcagctgcaaccgtctcccatgcatgctgattagatcggttttgtcatgccttgtgtctgtagatccatcttgcagcatcatggcatcttcgttggggtagattgattggctcagtaggcttggtggtggatgaccatctgatccatcagatcgtcgctgccttagattgaatctctcctgactggtttggatccaagtcagagtgtgaaaacttgttaaagttgtcagcggcgacgacgaagcaaaaatcccgaagcgaagtgaagacgaagccgacgactctttgaggtcgatctcagcacatctccagaaattgattccatcgcacttctcaatggaaagctcgacgcaacccttacctggcgcaccaactgtcgaaacatgaattcggcaataataaaagggggtagcgcacgagacctaaaagtggatggatgcggagacaaggatttagacaggttcaggccctctcaatgagaggtaataccctactcctgtttggggatttgaatccgccggatgtagtatagatctgacgatcatatgtgcttatgcccctcagagggcctcctgcccaccttatataggatggggggcaggattacaagatagaaaccttaaccaatacggtatcggttttctaaatctattttacaatattatcaaatcaggattttaggccgctccataatataaaaggaaacgtaatacccaagtcatgatgtcacactccgaactagtcctgagcggaactagcccgtgacgctccaaattaacctgttaatcgataccagtcccatgaaacagtgctgatatcacaggaagacagaatatcacagcaacagaggtctctttattatagagtaggagtacagtcatgttgggctgcggatagatcccgagctcacaactgcattacaaaagggaaacggaagccaagacttggaccacacatgacaggcgcgacttgggaactaggccgaaaccctaaaactcatcgtagccggcttgctcctggaagaactcctcgtcagcgggatccgcttcatcttcttcagcaactgggggggggattatttatatagagcaagggtgagtacaggagtactcagcaagccatgggaaataaatgtttaatgcaggcttcaaagaaaggctgttgtttttgcgattgattttatttaaactcttttctgaaacaactaagggagtgcttcttaaacgacacggatgagacagtgcgtctcgtccggtcggagtatgtgcaatgtttcagtcttttgaattgatcaagattggcacccggccaacagctttcaaacggccacccgggcctggctgatcccatcagccgccgattttccaaacatcaaacccattccacaacagcaaatttcacaaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccacactgtgccaggaagcccaggggtcttccccgacaccagcccggcgaatccacatgtctcttagcaccatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgtggttttggaaattcatttagttcgcaagcaccgacccaggtgtcgggttttccaagtcttttgtaaaacccaagttttacccaagatgtttctcagattttaagtttgaaggcgatcatcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgccttgctcgagatcttgagattgatcctcgaaatcctcgcactgcgggtcttcgggctccgaaactacacgcgaaacgggacaactcaacaagcggcgaaaataaagccctattaatgacctctaagtgtgacattagatagatctcgagatttgaggaattttggaagctgaacggagtcaaacggacttacggttgggaagatattgaatttctaagattattggatttttggtctaaaggaaaaaggatttatttaaatctttttgaaaaagaaaagaaaagaaaagaaggagggagggaaattagacttccctcggacggctagggcgcggcctgagagaatggggcggctcggccgagcttaatgggccggccggcccaagaaggcggcccaaggcgcgcgcgcgggcggggaggggagagagagtgccggtgggccgggtccatcccgcgtggtcctgggtgggacccgcttgtcggcgactcggctcaccgtgagcgaggtgcacgcggggtgtgctagggtttggggagggaggcgcggcgcaggcgcgtggttcacggaggacgcggtgcggcgggcccacgcgcagcctcacggctcgcagtggaccgcgcgcgcgaggggcggagagaagcagcgggccggggtctgcttgacccggtcgcggccgaggtggcaccgacgtggcgcctacgtggctgccacgcgggccggcgggaggtagacgacgacgccggccggaacagacggcggacgacgacagcgagcggcggagcgaaccacggcgatacaggcgaaagcgagcacaccgggacgttgcacgggacgaggggagacgagccaacggctcggattcatcgggggatgctcgatggcggcggattacggcggcggcaaccggcagagagaaaagggggaaacggcgatgaggtcatgaggggccgattcccggcggcgagagcatctacgcggatacgggaacccatcccttgcgccggattaggaggaaacgcattgagagaggccggcgacgagaggcgcttccgagctcgggcggcgacggtggcgagcacacggcgagcgacggcagcagtcggggcggcgccggctagctacggggaggctacacatgctactaccgaaaactaaggggaagagatggattgaggagggagaacggggagatgcactaccgtgcggacggggcgcagtgacgatgggccgacggcacgggagtgatctctttggcctcgggccggggaagaggaggaagtcgagctcccggagtccccttccgcgtccacgaacgcaccggctctcccggtgcttggcgatgaacggcggaggcgagacagaggggcggcaatggcgtggtggcggcgagcgaaacgggaggaggaatggatgggaaggcgccttggtttataggacgacgatgtcggtttggaaaccgaccttgggcggtcaaggcgcgagctggcgctcggcgctcgcagccaaaacggtgacagaggcggatgacgccggcggggaggggaaaaggaaaaaggaagggagaaagggagcttgccccttgccactttgggaaaaggaggagggagcgggggcgacgcggcagagggaggaggagctctgcctccgtcccttggaggctagcgcgtggagtggcgggggccgggtcgtgatgacggcgatgacggtggggcggtgtggagcggagcggcgacatgggcggcaggcgcgggcaggcgcggcagatgctgacggcggcagcgactaggcggtcggccaccatggcgcgcgcgcgcgcgggaagcaacgggcggcgcggcgatttcagcggcgtcggcgggaagcggcagcgagggcggagggcgctcggctcggcgcggctcacgcgcacgcgtgtgcagcgcacgggcagagcgggggagaggcacagagagagagagagagatgtcgaccgaggggcagatgggccgagagggattcggcccatcgaacccgagggaggcaaaatagacttttgcggagggatttgatttgggaaggatttggattcgggattgaacttgacgatagatcggggatttgagatctgagatggcacggacactagacaacaagcaaggaaacggatttcgcaaatagggtttttaagagataatttttccgctaggcgccacgacggaacgggcgctacacatgatcggttacatattccatagatataagctatcccctatgactagtcggataaccatgccgtgtgggtatggggtacccataatctccacacttgtaaagacagatatgctagggtgggtatatgagccgaagggaatccgaacgtctggatggtgacgccttttcagtgagggctggaggtaaaatattctgaatcccggcttgagagttgatgtggagagcagagaccaccttgattccaatccctgcgatgcaagttggtgcctggattctgggcttcttctttcgcagatttgggatctggtggatgtcgactgcatgtataggtgcatatgcagtggctgcgtgcgtgttagtcatcaatacaccgaccatgcctgtagttcatagtctgtatcccagcaaaatgagatgcactggatatgcagtatcaaggggtacgtggtttcaaccccgaggtcatgcgtttaattctcaacatactcacaatatcttacttaaaaaatattgggaggagtgcctctccctcgaaatctcgtttttttcacgtacccagtaaagtttgacacggctaataactcattaacaacgctggaagatagatcataatattcagcaagatttttaccgtggtaggaaaccactcaacctagcggcaacctgcaaccgccatgtcagctgctcattctgcttgttgatttgtcttggcgaaaaaataaaaatatattttaaaacgtagctgattttaccgtttctgttttccaatcttgaattccaaaccattaatactaataacatagatataaaagtttatccataaattacttttgcttgttttctttacattgtacagcttatcagttgtagctcactgaaacgctgttaatttccatagacttgatgtttgctgcaaaactgttagcaaaagtgaattacactagcatggattcgacaaggaaaaggcgttgaaaatatcgcagggaatcatgtatctttgtgagaaggcgaggcgctttatgtagattatattccacggagatctccccagaccggaggctcgaggttgcatatgtatggtttgcttggggcaacgcagccgcaacaatcagctggacacgaaggcctccacatcgtagaccatgctgcttttggagctttggagatggagcaaatcttccatgggcgctggaaaatctctcctaattccatgggcccagcatgctaaacctaggagcgaatcacgcacaggatggatggacaggaccatggataaagaaaagcatcactttgatggcaaaagccaaattccttctccaaagacatgggagttgcagatggtgagatccattcgttttcgttggatggctctaccagtttttactttgtcaagcactactaaaaaaagcatttttcccgacgtggaggtctttttttcgcaagcggacataacccttggaaccaaataaccgcctaaaaaaataaatcgggggtgaagttcgctgtccgcctctgtgaaaatcgaccacttaagcggcaggcaaaccgtatgtggtccgcctgcaaaaattgtgcctacccctccccaccactcatttccctctctcaactctctatctctccctcaacacttgtccctccactaggctgtccccttcccctccctcccgccggaggggaagcgatggcgacggcggcgagacgcgtggccagcggggcgcggggtggcgtcgacgacgcgtgttgcgtggcggcggctcccctcccctcccctcccagatctgaccagagggatgccaggggagggcggcggcggtgaggcgcgtggccggtggggcactaggcggcaacgacgacgcgcggggcggcggtggcggctcccctcccctccccttccaaatccggtcgggggagggcggcggtgacgacgacacgcggggcagcggcagcggctcccggcgcagctcccctcccctcctagatcctgccgggatgcgattttttttgttcgttcattggatttcctgcctgattttcacagtcgttggtctgcaggcggtccgccccccgcctggaaaaattacttttggctgcctgtaaaaatgttttttctagtaatgaaggtgaaggttaaagcgatcaaaaaaggaaaacgcatcgtcctgacacgttcgccagatcggaagtcaatgagcgtgcgctaactagccatttcgatccacgtttcctccccttcgtatcgtcatggagaaggccgtgggcctcagctatatctctccctgctaaatgggagaacagcgcgcctactcacatctcactatgcagataatgccacgatgttcatctgaccgacaaagagagatatgagacacctcgctcgaattcggcattccttggggaaagttatgggcctctaaaccaacatggtgaaaagtcagattctgcggcgccgttagcgacctacaagatatctcatggatttttcccacaaacatcaccagctacccgataaagttcctcggcctcccgctggtgatctcctaattcgaaaagatacatgtccaaccattgctcgataaatgcaagacgcggttggtgcctttgcaaggaaggatgatcacggcggaaggaagagcgactcttactaaatatgtcctcacggtgtaactaatctactatctaacagctttaaagatcctagacgagatactacactcgatcgataagatgaggcggaagttcttctgggcaagaagagacgacacatcgtggggatgtgcaaagcaaatagggataaagcctgcagagtgcagacctaagaacctgggtggccttggtgtgcttaacctagaccagttcgccagagcactgagaataagatggctgtggtacaaatggactaaaccggataaaccttggaacagcactgcgatcccctgtggtcaattggacagaaacctcttcatggcgcgacgataatcactctagggttgggaaaacggcaaccttctagaactcacactagctagaaaacaagatgcccaaagagatcgcaccagtaatttttgtggcttccaagcgcaaaactaggacggtgcacgatgccctagcatccaaaacatgggtccgagacatcaacctccccttcggattaaggcagcggatcatctacgacaatacgtccatttgtggactatgatacaacgtgtgggtcccatgagtgagcaaagggacaccatttacctaaaagctgatggctaatgcagtctgctcggccaaatctgcgtatagactacaattcgttggagcgaccgaaacgatctacaactagactatctcaaaatgttaggcctcgcctaagtgcaagttcttatcaattatatactaaaagtccattaaactttctagaaacgctcttaagccgccacgtgacgttcttacaaatacaattagaccgccacatggcactatttaatcttaccgttaatttccatttaaattagtggacctaatattctagaccgttatattagatatattattttgagaaggtaataatttcctctcataatggggccgagaaaagaaaccaaacataagtatacttcgtatacttcgtgtacggacttacgtgctggaaaagaatcaactaagcttaaaaaaaacctaagtacgaactgacgataaaatcaataaagtaaaaaacaattacgtaacatcaacgaagcttaattaaaagaaaacctacgtacgaactgacgataaaatcaataaagtaaaaaacaattacgtaacatagttagtacgtagtgccataaaaaaaatcgatggtccataatatacgattttctactatttaaaaataaaaatataatactctataaacttacgcaaatatacatagttaaactagatcttctataatataaaaaaatatcctatctttaaattattttaaaattatatatctaatttgtgatccagtcggattcctttaattaaataaactattgatgtctatcttcctaaatacatcataacacatgaggctgacatataataaataatattatgataatatttttaaggaaaaatgacgaattacccttaaactgttatggtcgaccgaattacccccataaacctaaaagctagacatttttcacactcaactattaatatcggatgaaatacctcgctgacacagcttggagtggtggcagtccagtcagtattttcttaaaaagaaattgatgggacccacctatcgtatctctccctcacccatcccctccctctttcttctccctccatatctatcaataggcaaggctagaggcagtgagcaggtcctcctcagtctccgccgacgcgcacctccttgatggccgtgtggcttctcctcaacatccactggcccgtgaagaggacaacagcggtggaggcgactaagggcggtgagcagcagaggcggctcctcctcgactatctcgggcgccacatctgcactccgatggagattgttttctccatcctttctatcacatctcatcgtcacgtgatggctgccagaggcgagcacctgcgttggtcctccatggccaggttcggctgcgccccgtagctctgtctacaactgcatgccatcccaccatagttcttaatcgatccccaccaccaatgcctctctcctgacgagacagaaagcaccaatcaatcaaagaacgacaaggtagatcaattaagagagcaagtgcaggggaatggatgaaggagaaaggaaaagagcgacggggtagtggcgtgcctgctggttggcccctgtagcaaggagaaggagaagagagagagaggctgaggaatgggattgaggaagagagggagagagatagagagggtagagagtgtgacaggtaggcccccacctaatttattttttaaaaagtgctaattggactgtcatgtaggaacaagaccactccaggttgagttaggggtaattcgtccggtattaatagttgagggtgaaagatgtttggtttttgggtttagggggtaattagtacttttttttcctattttaaataatttcacatcatatttcaggtgtcaaatatcacttgacgactatacaatgctaatttaaatctatatacgaaaaataaatgaaaataacacaatttagttgtgtatttttaagtatttgatttaatttaatttgtttgggattaagattctcaattttttttcggaatctttacaactatttatcagtatgtaataagtgggcaacataaatgttgcatagatgtaaaaaaaattgtgaaaaaaatatttcataccaatgatcttgctataatacaaccatttaatccaccatgagatttatggtcatatatctatgtttttctctttgtcaaatagttttggcaacaaatgaacaatcaaataatatgtgtaataaactactcatgatatattttcttatagttgaggaattccaacacatcaagtatcaatttgatggacgtatgttatacaccctattgaagtaactataaagtatacttcaataaattagttattgtaaataagtttgggaaaatagattcattatctaaattaattagtaaaagtgtctcatgtgattatgaataataggtgttgcaaaaaatcaaacgcaaaattatagatatttctcaaaatataaccaacaatgtgatgctttagagattattgcggtagttttttcaaaataaccctttatcttggttaaaaaaatcatgtatagtacaaatagaaacaactccagcattccattattgttccattatcgtgacacatgttcttaattaaatttaaggttatacggttccaagtaatatatccaaaccagatattaacgaaaacatatttaaaatagagtcaagatctattttaaaaatatcatctacatataaacattcataaaaaaattcaagcaatattaaatatgtgtccgcgcatatgcgcggtctatcttcctagctatggctaacaatccaaaacaagcaaacttcaaaagaggggatggatgaaccagcagctttgccctccatgccacgcctcgaccgaatcagcattacacctgctggcaaagcgtgggctgcccaaaaggatctgggcagagatagagatagacaactgtggacctctagttacaggagtgggattgtgggaagcttgctcatctatatatggaggattggtggtacaaaatctcatagtaacctcagtacctcacaccctgaggaaggccctaaaattgatcattatcctggtggcctgggagctctggtgtgaaagaaacgtcaggatttgtgtggcatatagcaaccatgccaaccaccatcatcaccaagatcaacgaggcataaactttgatcgaggagggggctacaaagctcacagagattatcccctccggagagtagtccccattgttctttttgtgggtttgtgttgttttaacatagacctagtaaatatttcgggccccttagaatcacaggaatgaaaaaacggaggaattggaaaaacatataatcttgacaggaatacaaatgtaaaacagaggattgcaaaatacaggaaaaacataggaatgaccgttttattgagccggaagaaaaacataggaatttgaggagagataaaagactcaaattcttaacatgaggaacctcatgttaaatttcctccaaaacttgctgggaagaggcattccatagaaatttcatgggattacataggattcattcctttgattcaaagggctatttaggaaaaattcctatagaaataaaattctttaaaattcctatgaatttcctttgaatcaaagaggggccttcgtgttgacggtttttttcctccttctctatcaatataaaagtgacattaaagcttttggccgtccttaagaaaaaaggtgaaggttacattttggagttatacttggaataactactactcctgtcgtaagtatttgacattgagaacttgagatagttggttaaaattttaaaacttttatactgaaattgttatacacatatacatcttataaaaatgctacataattttgtaaacctattatattttataaatttattttcatataaaatttatgatcaaagtatttataaccggtaggagtttatacacttacctattaaaattgtacatatgcattccttttaaaattggtgaatattggagcacaaaaaaatggcttgaaagttggtaggcagagtgcatccgacattcaatagtcctaatcatttaaaccagcctaccttccaagaagaatataatctattaacttaataaaaaaatataagaaagtataccacgtttgctcttacgtcttagaaattcgtacattaattgaaataaaaaaatagagtacatgtacaatacaatttagaaaatactgaaatgtattaaaaataagaaataattaatattgtgataagactacatatagaaaaatacaatttaggaaaaaatctaaagcttggataaaaacaagtaatattaagagaaagagtccacgtagaaatacaatttagaagtagctagtgtttacattaaaaataattttttatggagaaaagaattcatgtaggagtccaatttgaaatttttttaaactcggactaaaataaacaatatatatatatatatatatagagagagagagagtccacatagaagcataatatcaaaatatcttaaattttggttaattattattagaggagatagctctttgaggagtataatttagaaaaaaaatagtcagtgaagaaatacaatttaaaatatttattaaaaaatcggaatataaataaaaaagattaaaagaagagtcacgtagaaatacaaggtcgaaaaaacattaattttggattaaaaattgaagaaataattaatattccgatgagagttaatctagaaatacaaatacaatttagggagactataaaatgcagattaaagatttaaaaatgattactattgtgcggtaaggaccaaagaacaaaatccaattccatcttccgaggtcctggcagccaaccggagatatacttattctttcatttctttggtccagaaagggctccaaaccttgttcaacccatgctttggtacatattctactaatctcgtgtcgtgtggtgcagcccagatggattgaacttgagagcacagaagagttcctgtaggttacccaacctgctactacatatttcaagactagctaagattggtttaagattgcatttatatcagtgtttagttttgcaagtaggccatctgcttattgttctaaaagatttcatgtcatctgctccagcatatttagttgctatccacctgcatctatgaaaaaagttgccaatgctaaattaatctagccttaattaaatataaagttgcaaacggcattttcttcccatcttaatacaatctgtcagcttgtattcagccgatacggctaaaagaatttcattttctcagagatccggcgcagcagcatacgaattgaatgcacgcgtctaaacaaatactccatataacagtaaataccggaaatcgtatagtaagaacttatatatacataattataaaccattcatttagtaagaagactgccccagcagctgcttgtttaagtcttttaggaaacatatacaagtcagtaacaagaaatctaaaatgagtaacttattaattacaagtgcagtaatcgcagaaaaaaatagtattttgtactccctccgtcccagtacagtggacgtttttgactttgtactttcaacgtttgaccattcgttttatttgaaaaattagtgtaaatataaaaaaagataagtcatatgtaaagtacttttgataataaagcaattgacaaacaaaataaataataatttcaaaattttttgaataagacgaatgatcaaaaaactataaacaaaaacttaaaaagacaagtatgggacggaggtagtaactctattactctatcaccaccaatagtaacacactgctgatataggtgcatgaacctcggtccttgtgaagcatatccccagtaactcagaatgaggagcattatatatgcatgctgagcccggatgatatataattgcacgcatggcatttcatgatgcctagtggggcacatgcgtgcaggtccaacaaatgtctccctcctatgcagggagagggtgcagacagaagcatctccattgccacaattatacctgtagatcgatgcatcatgatgaatttgacatttttattcgatgggcatgtatttgagatattgacattatgcaacatcagaatctacatttgaaagaaagcacttatatcttgccatcttggaatcgaccgagatacgatatacacccttcccttcttgtgggtcctcaacagagagcatcagaatctcactcacctctcaatcttccaagccaataacaagtgtgtacagtagagctcacacaaccacacacttatgaacacgagtacagccgatgccctataaatagccgccaccggagcacaacagatatcatatcaaaacacagcagagatcgatagatctcttctgaagtccaaaaaaaacttcagtctagctgcacactagttagcaagttacttagcgttcaacttccaaagaagacagtagctagctagtttaatcaaatccaagctgcaggatgtcttctgctgggtcacgtagctcgtcccgcaacagcaacatggcgtcagagtggagcaaagaggagaacaagctgttcgagcaggccattgcctactacggcgagggcgcgcctgatctctggcacaaggtgtcccgcgccatggggggcaccaagacagccgacgaggtgcgcctccacttcgagatcctcgtggacgatatcaagctgattgaggcaaggcgagtcccgttccccaagtacaatacacagggagcatggaactgaccgactgaggtaatataattaactactcatcctgattcaatgctctcacgtccagtaataataaccgcgtgttgctaattaacttgctatagctcttcaaagggagtagtcagcacgtgttgtgataagtttagaatcctgctgcttagcaacacaatctgcagtttcaatctagcttaattgtaagctgatagctactgtaacatctcataagaacacatatgcagggagcatattagatgtcagccatggaaatcatgccctagatggttgaacttgagcactataagctaggggttagtcagttgtcgttttctttgttgttctaatttccaaatgcactgcaacatgagagtatctgtactttctgtaacagataaatctggtgaaactaacagctagctcataatttgagcctgtggcaaaccatcatgcacacaaaattagcatgcagttctacgcactatagtatatatgcaccatttcgtgatttgttggtttgcacataggccggtataggaacacgagctagccctaatttggatatatagtgacggtttttcccctaatgccaattattcacgtgtgatctacaaccagaagaataattctctgataccaaagaaaagaaagtttgaatcatgcagtctaagcaccttgagcagtacgttgtgcttaaatcagttccagactagctaacagccaacaggtgctttaaacatctctttttcatgtcagttcatctggcaaattaaaaggtgatttctgtcttttcaagaggcacaagtgtgatgtgtccataggaaaaggcaatttattcaaagttatcctgtactctcttggaaaggggacacaaccattgtacgtaaccctagaagagggagctatatatgcgtacctcattcttctcaaaataatttaatttgtactaaatagataagtaacctcaatataccacacctagctagcatgcctacatagaaagtaaatctattatatactaaaaatccattaaacttcctacaaacgctcataagctgccacatagcgctcctacaaacactcctaggccgccacgtggcactatctaatctcaccgttgattttcacttaaattgatagacccgttaatttagaccattagattagatctattattaaaaaggtgatagtttttcctaaaaaaaaaatgcaactggtgtccctacgcaagtataattgaaaaaaaaaaataaagcttcctgctgttaggcggaagaaaaagaaataaacatctatgtacgataaaaaataataaagccaaaaaaatgtgtagttagtacccttggaaaaaacgaagatctaatgtaggactttgtataatataaaatataatattacataatatatggaagtataggcttgtaaactatatctataatataaatatcaaatatcaaatcaacggtctctacgcattatgttttaaattatttttaattatatgcccaatttatgatccattgtattcgttaaattatataaatatcggtatataaaagtaatgttgtggtcttaaatacatcatgatacatcggatcgacatacaataggtaactttagagactaaaaatctagctatgtggcgctcctacgatcggttctatccaccacgtggtgctctaataaattagagaaaaccttatgaattgtgagaaaaaaacatgcaatcatttttattggtggacctactatttttaaattattagattagatttatttaaaatactctaacctgctcgaataaaaaaaaccgcgtgaatagttgtacgtatatatacgtacttccgtactttgctactcacttaaaaaaaggaaaaatatgtaattacgattgaaaaaaaaagattagccctaccacggtcccacctaattgttacgagttacacgtacatatgtactgttcacccaaaaaagtgaaaaaatatctcaaatgtgccatacctactactactcaccggattgagaaaaaaattctcctgggcatgtacaaaccccatcatcgactttcacttaaatcatttagagaaattagaaaaataaaatctccacc

SEQ ID NO: 32074 - DNA, 2110 bp, Oryza sativa
tagaaaattataaaagaaattaatgtagacgaaaacaatttatggagaaatcgtggtagatgttcaccggttaatattttgctcttataaatgtctcaaacttagcgtacgaagtatgcccgcgcattcgcgcgggcgataaacggcgtctaagtttctactattcaaatgtaacataatggtgaagtggtgaccttaaatagatctacttttttttatcactgctaagataaactcatggtacatatttccaatttattttccaggggtggaagcatctgaggttccagcaaggaaataactccaatataaactatattccttcctgtggctagttgttgaaggaaagcatattgatatattgttactgtgttaagaagattgtggtcgattgcttggttataaataaaagaagaaagggattgtctgtatatacttttaggttgtaaagcaaatcagtgttgatcttgcaaaaaaactagcctgcatttggcattgtgtgtggttttgaacattccagctatactatatatgtagtaaacatcagtgatgtaagacttctgtactcgcgtgctagtgattataaagttgtggttactagaatctcacatgctcaatcgaccaattggtttcagaattttgaatttgtgatgttacatttgcactataaatgctcaatatcccttccaaccgagatgtaaatacaatgcagatatggggtttgccaagtgctcacagatcgagttctcacctcttgaggtagctaattatcaaccagggtatattaaaaattctgctttacactgctagctactctggaagtggattgagcatttaagctattataaggatgtaagggcctgtttactttccccaaaagaaaatttttgggtgtcacatcggatgtttgatcggatgtcggaaggagtattcggacacgaatgaaaaaattaatttcataagtcgcctggaaactgcgaaacgaatcttttaagactattaatccgtcattaacatatgtgggttactatagcacttattaggctcaaaagatttgtctcgtgatttccccctgcaattagtttttttaaaaaattatatttaatgctccatacatgtgtccaaagattcgatgtgatgttttttgaaaaaaaaattggggaactaaataaggcctatgtagcatcttgctagcttcttcacactggttggaatgcaaaaatacacaagtcattttcaacaatataaaaaaacaaataaactaaaaatgtcagaagtatgtactccctccgtttaaaattataattcgttttgactttagttcaagtcaaactattttaaaattaactaagtttgtagacaaatatagttatatttataataggaaattagtttcattaaattaataattgaatatattttcataatgtatccgtcttgggtcgaaaatgttaatactttttttacaaacgtgattaaactcgaagcagtttgactttaaccgtataatataaaacagagagggtacaatttagacagttctacaaccaaaaggaaccatccgacctgtttagttgattttaagcctaaggatagccacagaataatttacatgcttaatttcttttaaagttctttttctagtaaatattgatagtttgatactactaatccatctacatcctcgagatttttgacccagcaaaacccaataggaataaactaatatgtgaattatttcatcagaagcgtttggtaatcattccaatagtaaatcgtactataggatcaaaattgaattaaatctggccctaattacgatttcagttttcatttttgactaggaagaaaacccgcgcagatacacggtatcttaattatttactgttcatagaaataatattaagagaattaagtaatatcttaccaaatgcatataagaaattgtagattttgcctcataataacaaatatctatgtcgtgaaatagaccgtggactttaatataaatgataagaatgttttttttatacttgaacaaaaatctcttttgtccaagttatgtaaagttgcctattcaccattacttattatgattgccgctagatgc

SEQ ID NO: 32075 - DNA, 1517 bp, Oryza sativa
taggggaccgcgtcaaacaccgtaggtgcaatgaacagtgccgtttcttattaacccgattttagtgtattttccatataaatttgattccacaattcctaattttgcatatatgcattttactcaatatttgtgttatcttaactaatgaattcacccctagattaatattactcatattttatttttatataatttgtttgagttttaattagggttaattcttattccatcgtatttaaatttaattgatccaaatatggtcgcgataatattttatttatttctatccccacctaatctttattttaatttgtatgtattttaccaattttgtttttacggtttattcctaattaactattctttactcacgattaataatcttcgagatcaaatccagataaaatagacgaataagatcggcatgatgcaattaatttaaaaagtttttgaaaatccgtatttttagagttttgattttgtcggtcgaattttcagagtgttacaaacctaccccccttaaataaatctcgtcccgagatttcttaccagttttcgaatagatgtgggtactccgtcctcaagaattcttcgctttcccatgtggcttcatcctcagtgtgattgctccattgtaccttgtacatacgccacactttgctcctagtcctcttttcggcttcatccaatatccggatcgggtgttctggatatgtgagatcattgctaatgtgaatctcttccagcggggcttgctcttccggcactcgtaaacatttcttcagctgagacacatggaagactgggtgcacatccgcgatattctctggtaactgtaactgatatgcaacttctcctcgcctggcgatgatctggaatggccccacatatcttggtgccagttttcctttgaccttaaacctttttgttcccctcatcggggaaacctttagataaacgtaatctccctccttaaattccaggtttcttcttcgggtgtcggcataactcttttggcgtgattgtgctacttttagacggtcacggatcaagcgaaccttttcttcggcttcttgaataatgtcaggcccaaataccgcctgttctccagtctcggaccacattagcggggtacgacatcgtcgaccaaacaatgcctcattgggtgacatttttaggcttgcttgaaagctgttgttgtaggagaattcggcgtagggcaaacatctctcccagtccttgctaaaatccagagcacaagccctcagcatgtcttctaggacctggttggttctctccgtctggccatctgtctgcggatgataagctgtgctaaatgcgaggtaacttcctagggcttcatgtactttttcccagaaatgcgaggtaaactgtgtgcctcgatcggataaaatcctcttaggtataccatgaagacacactattctggtcatgtacaactcggcgagtttagcactactatagtttgtcctgacggggatgaatctgccgtc

SEQ ID NO: 32076 - DNA, 5847 bp, Oryza sativa
  unsure (1)..(5847): unsure at all n locations
aaatgcgaggtaaactgtgtgcctcgatcggataaaatcctcttaggtataccatgaagacacactattctggtcatgtacaactcggcgagtttagcactactatagtttgtcctgacggggatgaatcttgccgtcnnnnnnnnnnnnnnnnnnnnnnnnnaaatggaatcatatcctgttgcggtcttgggcaatccaacaataaaatccatacctacctcatcccatttccattcgggaatcctaaggggttgcagcaagcctgccggtcgctgatgctcagccttcaccttttggcacacatcacagagtgctacgtattccgccacatctctcttcatgttgggccaccagtatccttccttcagatcttggtacatcttcgtacttccggggtgcaatgaatatgccgattcgtgagcttcctttaaaattaatcccctcagtccaccctgttcgggtacgtaaatcctctttttataccataggacatctttttcgtcggttgaaaattcctttgcacgtcctgcagctaagcgttccttcacctctcggatttcctcgttgtccttctgggcttcttctatttgggttctcaaaagagattgaatgtccagggtgtttatctgcccacgaggtaggttcagctgagctatttcctccctaagctcagggaccatcccttccattctcagataattgcaatggctcttacgactcagagcgtcggccacaacgtttgctttgcctgggtgatagtgaacctctagatcatagtccttgattaattctaaccatcgcctttgcctcaagttgagatctgactgggtgaagatatacttcagactcttgtggtcagtgtagatatcgcaatggtttccaatcagataatgtctccaaatctttagcgcatgaaccacagctgcgagttctaggtcatgggtagggtagttttcctcatgtggtcgcaattgtcgcgacgcataggccacaacttttccgtcctgcatcagtactcctcctagtccttgccttgaagcatcacaatatataacaaagtctttcctgatgtcgggaagaactaaaataggcgccgaggtcagcttttctttgagctgctcaaagctttcctgacactgctctgaccacacaaacttcttttccttcttgagtagttgtgtcattggtcgggctatcttagagaacccttcaatgaaccttcggtagtatctagccaagcctagaaaactccgaatttcagtcacagatttgggtgctttccattccgtgacagcctccactttagcaggatccactgctactccaccggccgagattacgtggcctagaaaagcgacttcttttaaccagaactcacacttgctgaattttgcatataacttatgcttccgaagtttctcgagtaccaatcgcaagtgttccgcatgttcttcctcatctttggagtagattaaaatatcatcgatgaataccaccacaaatttgtccaagtagtccatgaacactttgttcataagattcataaagtatgccggagcgttggttaaaccaaacgacattacggtgaactcatataacccatagcgtgttgagaacgcggttttgggtatgtccccggttctaattttcaattggtggtatcctgaccgaaggtcaatctttgaaaacaccttagctcccttaagttgatcgaagagatcatcaatccgtggtagtggatacttgtttttgatagttacttcgttcagtgagcggtagtccacacacattctcatgctaccatctttcttcttgacgaatagcactggggctccccaaggtgacgaactggggcgtacaaatcccttttcttgcaactccctaatttgctttttaagttcttctaactcattgaccggcatccgatatggtctcttggatatgggggcagttccgggtatcaggtcaataatgaactctatgtcacgatctggtggcattccaggtaaatcttctgggaacacatcaggaaatcgctgcactacgggcattccctttaggggtagcatggtaaatatacctccggcacgttcggttagcctaggatcttaatccatggttgctctcatatccgatccccagggtgtggtcagggtaacttctctacgtctacagtcaattattcctctatgctttgctaaccaatccatacccagaatgacatcaagagtttggggtattagcaccataagattggagggaaataccacatccctaaggcggatgggtacgtcaatgcaagctgtatccactgctatctcacccccaggtgaatgtactaacattggttgtcttagtttaactctggttaaattgtgttgttgacttgctttcaaagatataaatgaatgcgatgctcctgaatcgaagagaactttaactggagtggagttgagtgaaaacatacccatcagtacgccttggtcttcctgggcctcttcagctcgaacgtggttcacttgcccgcgtccaaatccggtagcggtcctgttagtctgcggagtcctgaatagacctcgtccaacggcaggggtagcagtcccgtgaatagccgttgcattagctccggtgcaaatgggtgtcttgtttggatgaggacatttattggcgaaatgcccatactctccacagttgaaacagcttccaggccttactgatccagtggcggcctgattcggtgcaggagcgcggttctgaatggtaaccggcctgtggaaattgctggaggcggcaggtcgactggttgtcaccactgttggtctccatgccgaggaggttgtccctttaggacgctggggtgcggtctgaggcgagcggttcatggcaagcctccttttacgattgtgctccacgaccttccggtcgttctccaacctaacgaccttattgattaaactctggaaactatcgtggtcttgtccaatcatgggcccgcgtaactcgtcattcaagccttcaatgaatttgtcgatcttttcctcctcgtcggcaagatctctagtcgcgtagcgcgccagctgagtgaaacggttcaggtactcttgtactgtggtattcccttgctgtagtctcctgaactcattgttcttcatccgcatcactgcggcaggcacgaagttgtcacggaaggctgtggtaaattcctcccagtttggttctacagcatcttcttctcgggcttctttgtacgtgtcccaccaatctccggctggtccttccaattggtttgccgcaaagatcactttatcggcctcacgtactcgaacaagagttagcttcttctcaatgatccttaaccaatcttcagcatccataggttcttcagctgtggcgaatgtgggtggcttggtcctcataaactctccaaagcttgaccttccgcggttgccttggttgttcgcgatagcttgcagaagttgagtttgggtggccataactccagcaagagtggttaagtcgggtgtctgagtttcgtcattgctggttgttgcccgacgtcggcttgccatctgtgtaggttgatggagtaaatatcctaattttctaactagctcctatggctttatcccattaagggagttgtgttgatatgaactttgttttgcaagcatggtggaataaactcatttataacacaacaacaatagatatcataaataacataacagagtttcacaaatggtacataaatcatgatgcaatcgaccgcatacatacgcagtccaaataaggttcatccaaaagatacatcaaactaatcatcaatctactcgtcaatctaggtaagggaggggggtgtctcgcatactatccaaaaaccatctgatacgagatcgaagctgcaaggagtccgtcagtctagtcctccagccatccgcaggatcctggggcaggtagagggtggtcgctggcacgcgcaaacctgagtccccacggctcagaggtagtggcctctggatctggcttgggcctcttgcccggaggtcgtgtgctcttgcgagcagtgctgagggtgcgaggacctccaaggaaggtgatgcggggaacaggggtctcatcttctgaaggatcagtgatgtctggctcgatctctggctcggtgtcggtcccctctgtctcggagtcgacctggatcggagtctccaaactggaacccagctgcggagaaggtgtagggatcagtggagtgtgcaccaactccaggacaggtggttgtgccgctgtcgagtccactaggtagggtgctgactcggtagctagcatactagcctctcccagaagagcgtggaatgctggtgggtacggcggggtgagaagaagtagcggtcacggcctactgctgtggaagtagaagcccctgtggtgctgatcttggctgctcgaagctgctcctccagctggctgacgtgctcctgactctctctcagctgcccctcaagagtatccatcatcccgcggcgatcgttgtactggtcagataactgctggaactggtcgccgtggacctggagctgtgccttcagtgagtctatctcactgccccaagcctggtgctcctcctccaactgcagctgctgcgctgtgaggtcggtcacctcagtctctaactcccccacacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgctctcctcccggaacgggtgatgagcaaactcggtactcgctaactcagctcggtggatagagctgagtcggagtaaggcctcctgggctgcatcctgcatcgcggtctctggcaggtctcggtggtgacgtgtctgaaagctgtagtccaactcggaagggactcgggggtgaacctcgacccgagcctcccaaactgagccacactgtctcactcggtatgacgggaacccagagtatcgcagacgcctcaacatccgatgcagctcaatgacatacccctctgattgaggtaggctcaacacccaagtagcgggtgaatccggatctgccatctaattttaagaaaaacccaaagtcagttgagagtaaaacttgttttgtaaagaaaatagttaagagtaagatgaaaattgtaccgagtttttgtaaacatagcgtttttatttttgaaagtattactaaatgggaatttctcccttggccaacttagaaaaggggtggggcgccttttggtcttttcctacagtcgtatggctctgataccagctctgtggacccccgtttttataacaggaatcaatcgtgtaaacagtaccatttccctgtatcaagtagtctggtacacacgaattcatagctgaaataccaagtgcaaatacacgagtatctaatacgaattattacatcataagcccgcaggcatagtcttaaatcattggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccatcacagcaatgatgcacatgacagaggaattcaaaggatggctatggttctttcgcgcaaaacaagtttgtaattcttttcacaagcct

SEQ ID NO: 32077 - DNA, 15455 bp, Oryza sativa
  unsure (1)..(15455): unsure at all n locations
tggtgacatttcacatgaacctgggattatctgccaatgtttaaattctcctctgaaccctcttgaaatgctaccgctcctgctcaaatggtccaaattaaatgatcttgacaatagaaaaaatcgaaggattgacagcaaagcaatcatcacttagtacacaccccatcccaccaagaggtacaccttgcgaggctgaaggtttgtcgctctccctcgtgaatggatcaattggtgctttctgacaattattaagtttcaagttagaagtgccataaaaaagaagtacaaagtaaaggcgcaggatttaacttatacagtatagttggtggtatgacacagaatcaacatattacccttccatgagaagcttcttcccgaatatatgaccagaggcgcagaccaagtttcatctaatagccacgaggagacacaactcaatcatgttgacatacataaccagataatcttaagatttcagcagaatgaagagcaatcacagccagaatttccatgaactgggaatgctgataattgcatttcctgtaccatcttaattgcttctctaaaggtaacattgaactccttcaatctattggcatgactacttagttttcttctccaagcatattctggtggtgagccatcatcaaagtccagctgcagtattccaaaaggaaatcacaaaatgaagtcagtcatgaaagaagccaaacaaaacaatatgatcttacaaatccatgtcatattgtgttattcttggcatacattttaccagaactagtcagttttccactgtaaaagagtaaagatataactgatgaatagagtgcaactttgggtactacaatcgtcagccaaataagcacttcacatgcatcgaaaattgaaaatgaaaagggacagagaccctatatcataatcagcaaggtaacagacttgacacagcaataaaacaggtaaactaactatacaatttacacttgttagcgaaacctctctaagttagagaatgcagtaacaagtaacaacataatatcacaatcttgttactttcacaatatgaactaaacaatctttatagccgattttcatattacaaggaaagaaaaacatcactgctaatgagagcatttgagggggaaaaaaaggaaggggtaaagccctcaccaattgcagggtgctcctgctcacgagatcaccggcacgccatgagcgcttcctccggtagaacatgttgctgctcaccattgctctcccgtcgccaaaagcccaagattatcgcagagaaggaaagaaaaaaacaatttttcacaaaatctcaaactgccccagttggataaagtcctgagagaaccgaacagtcctgaaataacggaagtcgcaggaatgaaacccacaaatacacgacatggggacgaattttgaacgggacgcaaccaagaattcgagcagattaaagcgatagtagctgaacttctaccaaagtaccagccaaaaaaagaacctttaaaatcgctcacaaatgtacccagcagaagaaaatccaggaaaattcaaatcaaattatggacctgagctcgaatcaaattaggcaagaacaagttactccctctcttcataaaaattaaattagggaaaggagcggattcagggaatctcctactggaagaaatcgggaagaacccacgagctgtacccacgggaatggacggttggttcgaggggaagctacgagaaagctcgaatctattttcccctcgcggcgaggaagaagggggaacaagtaagaaatctttgacggctttattaatcctgccgtcgctttcgctgttcctcatcttctcatcttctctcctcatggcgcggctttattagcagttaagctagtgagcgaggcgtataattaaatgcaagtaattaattaactgcaggattagtgaggcaggcagcagtgccgccacatcagccgggcaggtgtcccggcgaccaaatcaacaaagcgaaagccatcatattttgctgagctccccggagggtgtgcactgtgcaggcatttggaggtggctgggcaagttaaaaggggagttttttttcacctcgccggcggcgacgtggcggtgagaggcgccaccggtatctcgcgcgaggatgtcaggatggtaaggtagcagcagcagcatcaccctgcgtggtctaacggcagattattttatcgcggaagaaagataaattctgtgagtaaacttgcagcccatttggttagacggagtttttggtagggattgggagtttagagggatgaggctattgagtgttttgtttggttaggagacataggaattttggtgggatggggatgggaattgagaaaggaactccctccttttcaatgggcctgttcggctgccattcttgctgcagcgctgagcgcttggttgcgcggctgcagcggtgcttcttgtgttagtgatatgccctagaggcaattatagagatgattgtatcacacactatgtttacatatttatccgactttgttcattgaaatagataaactcattattggttaatgaatatgtgattctttcacgagactctttatgttgtgtgttgctatttctaaaggatccctgatcaaatattatatgtggaacaaatatatttagatgatcagcacatgtattaatcgatgatcatgtctcatggatcatggtatagagataccaaattaataatgtggacatatgttgatgaacatgttgttggatagaccgaacatgagacactgcaagagccatatgtgttgtgtcatcagtgatctcatttagtgttggtgttgaatccttagacctgagattatcatagttcccaacatatgtagtagcttacttagggactgctaaacgctactccgtaattgggtagttataaaagtagttttcgggtatgctatgacacatgtagtgggatatgaataatcaagatgggattttgcccctcctatgaagagatatctctgggcccctcgatgttgtagattaaggaagtgcattgtcacgtcctgaagtttccccctttttcttgctttaaaaaaattggttaaataaattgcccgaagaaattgtttttttaacctagagctaatcctcaattaataaatgcatttaataatcaaattcggcgtggtggattttttcttgagttccccatgcttcaatacattaacaatatttttagtggaattttcagagccttggaaataattttaaccaattaaaaatgagcaagtgcaatattttaaatcccatgaaaatctatttccttttttccctcctttttctttgttgggccgtcggcccatctctctcccgcgcccctccctcttgctgggccggcccaacacccccctctctctgggacgccgacaggtgggccccacctgtcaggatgtccctaacctccggccagccgcgcccaagccggcaaccgccgctgccgccccacctcctccgctcctcccacgcccacgccgcgccgctcccgcgtcctccccacatcgccgccctctcccccgcgtctcccgccccgcccgcgcgcacgaaatgggccggattcattttgaatcccaccccactctctgtctctccacccccacgtcgccgacgaaatcgggggctatcccggccacgtccgcccctcccgtgcctataaaatccctcccccgagtcccctctccctttttccgcgctcgccgctagcgcccgtgccgctcgccgctagcgccgccgcctaccgccgcctccggcagcacgccgtcgccgcgccaagccaccgccgccgccgccgctagcttcaccgtcgcgtgggtcatctcggccaccgcctcgcgtcgccagaaccccaccggaaccccatttccctcgcaagctggtgagctatccattcctctccgcccccagccgtcaatggtggccgccgtggtcgtcctctccacccctaatccctctcctcctttcctataggtgtcgccgccgcccgcccacccctcctcgtcgccgggtcaccgccgcctttcattctccgctccggtcgccgtgctcgccggtgaggctcccctctcctacctttttctctcctctcccgcgtgcgccgccgctacatcgctatggccggccggccggttttgtgccgagccgagccgtgcctagccgccaccttcgccgtccgatcggcctcgggccgatctagaccgtcggtcccgtgggccggcgatggaccactcgtgtggtcccggtccacggtagaccggccgcctcgtgccgctgacatgcggggcccgcttgccggcgccgccacctcccttgatgacgtcggccctggtgatattgcgaaataaatcgaataaggacttttctttattagtaaaaacacagattatcttctaaaattcataagtaattcattcgagctccgtttaagtccattcaagtctcagtaaattcataaaaatccctagaatccattaaaaatggttttgcttcctgtttcagtagtcttatagcatgttttgcttatgtgctttgtttgtcgcgtagatttcagccgttttgtcgatccgcggtttctcgaagacgttgttgaggtctcatcagtgcgagagcaaggcaagtgtggacccccgtttttataacaggaatcaatcgtgtaaacagtaccatttacctggatcaagtagtctggtacacacgaattcatagctgaaataccaagtgcacatacacgagtatctaatacgaattattacatcataagcccgcagacatagtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccatcacagcaatgatgcacatgacagaggaattcaaaggatggctatggttctttcgcgcaaagcaagttttgtaattcttttcacaagcctaagacctagcatagactgatcaagtttttaataccagtgttcatattaaacaatgacggttctgtccaccatccattgtgatcccaaggatagcttcccgtcattgagtcgttatggttttctgaggacgtccacattcccgcctctcaggaagtggctccatcagcataaaaatcatcatgcaatatctcatcccacacaagttaaagaatttagagtctagccaagtgtaatacatgtcccggtgctcaataactgcgagcacggctattcgaatagatttagtttactcacactgcagtggatgtacactttacccgcactccgcgactgcccaacacatgagcctcgtcgcaacacatgagacgcgtcacggcaaagcttttcgataacctcgcattggcagtacccgctccatgaacttaaatcctcatgcactctagacgtccatgtttctagcagtgagaggagttctggcgctcccgggaaagagaggtctcacacacattaaattatggttcaagttaagttctctctctcacacactcatggcagtcctaccaatggcgacaccgatgtagggcacgcttctcggccctacctcaacggctgtcccatcgtagcgcaactgcctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccgccccagtcgaaaacagttgtttaattttatttcttctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaataatttcgcaattgggatcaacatgttcaaggaatagtgatgacttgccttgctcaaagtcttgcgggtcttggccttcgcttggatccgcaactccctcgggctctatagttacgtgcaaaaattgatttgaattcggttagaattcaaataaaaatccaaataaatccaaatgaaagtcgaatgcgaaagtcgattcctttttattaattttactatctgcgaactacggcaaacccaatttcaatttaaactattttgcgggtataattatttcgttgtcataagtttttaatttactctccccgagcattgtatataataggttagaaatttctattacgagctaaatatcggacgaaatcctagaaatattatacaatttaatttagcctatggctaaacgattaaatataatacacggctaagattcctagtaattaaatccgaatttcaaccgtgaaccgatgacttatagagattaccaaaaataatctataataatctataagaattcatctaattgtttagctactaattatatctaaattacttacaattttactctaatctgctcaagatacacatttttataattaactcggaatttcgaccgaaatactattacgctcgaggaatttccaaaaataacctatgatcaaccccgaccatttttatttcctaaatcctcctaatttctcccccaatttcccttctattttctccttttcttcttttctatattccctctttttctctcctctttttttttctttttctctcttttctctccctctctttctttttctctcctttttctctcctttttctcttctctgccggcctctcttttctttttctttttcttttttttccttctctccctctctttctttttctttttttttcttctttctctccctctcggtttctctcctccttccttctcctttccctccctcggtttctctctctctcggctctttgcttccccgggcggcgacggcggtgggcgcgaggtgaaggggggagacggcttaccggcgacggcggtggcggcgacgacggcgacggcggcgcaaggtggcgacgcacggcgcggcggccccggggcgacggcgcggcggcttcgaaggtggcggtgcggcggcacgacaacggcggcgcggcggcgcgacgacggcggcgtgtggagaaggggaagagggagaagaggagggaatggagtggggtggagaagggggattgggccggggtctttataggggagaggggaagaaataaggggaagaggggagaggggagacgcgacggcggcgcggggcgcgaggtgcatggcgacgcgacagcgacggcgacgcgcgtgcgatggcgacggcgcgcggcgatgcgacggcgatggcaacgacgcgcggcgcggcaggcggcagcggcgcggcacggggcgcgaggcgcgggctcgcggcgcgaggcgacgagacagcgcgcggcgcggcagcggcgatgggatgcgcgcggcgatgggacgtcgatggcgacggcgacagcggtggcgcgcggctcggggcgggatgcgatgggcggcgacacgacggcacggtgtgaccgcaacgatgggatggcgcggcgcgggctcgcggcgtggcagcggcagcagcacggctcgaggcggcgatggaacgcgcacgcggcgacgggatggcgacggcgacggcgacggcgcggcagtggtggcgcgcggcgcgaggtggcgatgggatgcacgtgcggcgcggggcgggacgcgacggcgacggcgcggccgcggcgatgagatggcgatggcgacggtggcgcggcgccaggcgacgagggcgacggcgcgcggcggctggcgacgagagagaggggaaagaggaggagctgggttaggggaccgcgtcgaacaccttaggtgcaatgaacagtgccgttttctaattaacccgattttagtgtattttccatataaatttgattccacaattcctaattttgcatatatgcattttactcaatatttgtgttatcttaactaatgaattcacccctagattaatattactcatattttatttttatataatttgtttgagttttaattagggttaattcttattccatcgtatttaaatttaattgatccaaatatggtcgcgataatattttatttatttctgtccccacctaatctttattttaatttgtatgtattttaccaattttgtttttacggtttattcctaattaactattctttacttacgattaataattttcgagatcaaatccagataaaatagacgaataagatcggcatgatgcaattaatttaaaaagtttttgaaaatccgtatttttagagttttgattttgtcggtcgaattttcagggtgttacagcaagtcatgcattacaattggtcatattgtacccaatttacaaatatcccgcatttctattaaatgttgcattcttttacaatgttatgtgggatgggtcctattactcagccatttattgtttaccttgtgccattgataatttgggtttcaaaatgactagatgttggtttaggaaaatgcttagccatgcctagttcaactagtacacaaatggggatcacattattacatagactttgactattagcatagctttggattggtgccaccgcaatggtgttagtttattaaaatacactgaatggtgggctatgggtgcatggttttgctagtcgcacccatggcaattaaggaccggttcacgggaaaccctgggagacttaccgtgcttaccacaagcgggagtgggtaactgcttgatctgaagtatagcttgaccctttccaaggcaccggtggcgagggtgggcgtgatggagttgggtcgtgtaacgacccgcctctcccaggccgggcccacttacatctggcagctttcataggtcatagactgccctcacagaccaacacatgtcttttctgcacactttgtcctcactcgtgtgcacccgggaagaatttcccggtcggtcacccatcccaaattgctccaggccaagcacacttaacactagagttctttggagattggcatccggaaaagaagttgcaacttgttgatatgagtattctattaatcttattaagccgtaggccgggatgttacatcgtttgtcacgtcccaaaacgaccttaaaatatatcctttaaattatgcctagaataattaaaatccgtgtgaaagcctccaaaaattaaaatgtgcaaagtaaaagtcaaacaaggcttagaggatttttgtatatttcctaaaagcctaaaatgtgtaaataaattttagtggaattttcagagcacaaataataattaagaagaaataaacaaatttaaaatgattttataaaaagaaaaaccttaaaattcccccctccccctcttgggccggctcggtccatctccctccccctctctctcctcaccccgcggcccacttggtccctccccgcgcgcgcgccgctgacaggtgggcccgccctccaccctcgctgacgggtggggcccacccgtcatccccgacctcccgccgctccgcccgcaccaagcgccgccgccgccgccgaatccgccgcatcccgtcgtccccgcgtgcaatcaataggggggaattattccccgtgattccctctccctttccccccaattttccctccctctctcccttggattcgtttagaaaccctcccctaatcccgccggcgccattgatggagcctgagaacgccgcgccggtttccttcccctccggccgccctctcccccttccaaccctatttaaaccctccccgcacctcctccgtccgtttccgcctctcgctgcccttcctcctcgccggattcgagctcgcgacgtcgctctctctctccgccgtcgccgccgagctccggtccgccgccgttgtcgccccggaccacctcccacctcggtgccgcctccttcggcttcgccgcatcctcgccgacctcgtccacctctccatttcggtcgccaaccgccggaacgccgccgaccccgtcgacccgagccgcgctgccgccttcctccgctccagccgcctcctccgtcgccgccgtcgcctcggggtgagccgtggaccgccgcttcgtttccccctctccctcccctctctcgtccgccgctccgccgtacctatggtcgccgccggcgaccataggggcgcaggcgccgcctcccgccgggcgtgccggcctggtcgccctcgggcgcgccgagtggctgccgcgtggggcccggccgtcagccgcccgcgccctcgggtgcggctgacgtgtggggcccatggcgccggctggtgcgagcccgggtgcacctggtccaccgtggaccgtgaggctgccgcatgggccccactcccatggacccggtccgcgcgcccctccccctcggctgacgcaataaacccttttaaaattagaatttaaatgaagaaattcacaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgccgcagcttcggaagatccgctcttcgtggaggttgaagccgacgtttgggaaagcgagcaaggcaagtcacatcatccttgaacatattgaatcccattttataaaattgttttgatttaaattattgcattatcgctttatttaaattcccgcgttatcactgttttatttagccatgcctatttacctttgttatgaccttattagtattgctattgttattattaccttgttcaccctagaataaacaaaaccccaactagtggaccctctactcatggtaccactagtatgaatttaggtagatgcttcgctggttaattaggcaacattaggtggttttacaactctagactttgggaatattctcatcacctggacactatggaatggttggattattgtggaattggattcacacctccccctctattcaaaatcttcaaaatggttttaggctgggctcagggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgtgctgcggcccggtagtcgagatgtcatggcacagggctggtgtcctgctgctaggggctcagtcctacttacctgtcccggaggttccggccgtaggtggggttgggtcggtactcttgtctatggctaggatgggttggaaactatgtcacgtcttccgcccgtataccgtggtggtgtgtggcacgtggttacacgtgagaaagatgtgtcttttgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccatggtcgggttgccagttcggtctgaatcatcgtaggccttgggttaaggcaggttcgtttgggttcacggccttgattaaaaatattgtatagctctaggattgtatttacaatatagctttgagcaactaagtgtcttttaatgctgtttactgcaaaccctaacccttatattataacccccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctatttcccgtttgtctttgtgtgtgctgggccttcgctgcccatgtaataaattaattatttatgcttccgcttgataaactctaaaatgtatcaacttttggtgtaccttgcctcctggaacaaggaataatacacgcacgtaaggaatgcccgttgggttatttccggtcgtgacaggtcggccggggtgtccggttgtccagctgccgcattcaccgcggcgcaagaggggaccgcccactgcccgttgggggtgggggtgaaaccttagcgtggtgtggatggttaggggagggttatgcggatgatcttgtcacgatttccccctttgcagtatcatggtgatacttcggggcatggcgacatgtgtggaatcgtgtcttgtgggtacagttgtacacctctggccagaataaaactatttgaatagccgtgcccacggttatgggcgatcaaccagattcaccgtgattagtctcaccctagtttagcttaatgaactggtgtagttcaggtggttggttgggcctgttgcaacgtggtgtagcgttggacagtgattggttaatattgattaatctactacaattgttttactgctttcaactactgcttctaaatgcctgctttatgcaaatgaacccttagcctcctttggatatatcctgcatcatacctcctcttccggtatgacttgttgagtacagtgggtagtactcagtcttgctctcttttcccccacaccagagttgaagttcttcccagttggagctaccttagaaaggttggtttcatcgctgccgtcaaggatgcctgtggagtggagtcgccccgctgctgaagtcaagcttccaagtttagttcgttttatctttttccgctgcatttgtaatcttttatatttttttgtaagacgtggatatgtatgtcaacaattgtcgtttgtgtaccctggctggtcctagacaggggtttaatgcacattcagcttagaaattctggttcgtgaatttctgggcgtgacaagttggtatcagagccaaccttgaccgtaggacaagccaactggaaccctaagagccttctgaaccccttttcatctgcatatgcctttttcacttggatttgtttcgggaaaatttggggttttgcctctttggtttgcgggaaaaatcttggtcgttcattcggattggatctttaaaattagctcagtctagggttttagtaaaattttatttggagtttattcgacagttagtcaggaatttatcgggtgatatgcattaggtcgtgtctatgtttgatggggcaattttatgcgcatcattttccatgcatctattttatgcattaagttattgtttagtcagttgcattagtgtctttatctgggttcatgaaaaatgttctatgcataaaaatcaccatgctcggttatttatttgagtcatttgttgctttgtttatttggatttgagcatgcattggttcctatcccttgtccatctttagttgtcagacctgttcctcgatcgcaagcgccgctccgagcttcagagtagccgcccttagctttatcgtcttcttagtctgtttgcttgctagtttccgtgttttaggtttgttgcttgtgggttagtcggcagtcgatatcatgtgtcagtggtatgactgccttaattaggagttatttgcttccttttcagtgttttattcaagattgagataattgcacttaaatttataagaaagattagtttctgagccccctgtttttcttccttttctcatatttctacctatcccccttcagatggtgaagacaaggaatggttcccgtgaatccaacaacgccagtggcagcgaagagcagatcaatggaccatgtgccagcgttctgacaacagtccgtctccaccgcccgagaacccaacgattgctcaggtgttagacaatcagattcagatgatgacaatgatgatgcaacagatgcagcaacagtaccatcaggtgttgcaggaggtgcagcagcaagcacaacagcagcagcagcagaacctgcagtttggtctttcacctccacaatccaaactattagagtttctccgtgtcaagccaccgactttctcaagcaccaccaacccaatcgaggccaacgattggctccatgcgattgagaagaagttgaatcttttgcaatgcaacgaccaggagaaggttgcttttgctacacaccagctgcaaggtcccgcttctgtttggtgggacaactacatggtgacccgtccagctgggacagaagctacttggtcagagttttgtcaaagttttaataaggcacaggttccctagggaattgtggaacaaaagaagagggagttccgttctttgcaacaaggaaccagaatagttatagagtatttgcatgagtttaaccgccttctgcgctacgttcctaaggacgtgcgcactaatgccgagaggcaagaaaagtttctgtctagtcttgatgatgaattgaccaaccaactgatctccaaggactatgaggactttgagaagctagtggacaaggctatctgtcaagaggagcagtgcaacaaaatgaaccgtaagaggaaggcagctcagcttaggacttcccaggggatcagtcagaagcctcgctacacgatgggacatcaaggtggaccttccaccatgattatccggcagcaccgtccttaccacccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32078 - DNA, 1450 bp, Oryza sativa
aaatacacacttatattataattaataaaaaaaatattttcaatgagagctaggtagcagttcttcagaactttggatgttgcgttatgtgttgccattcatcaaatacttatttatcatattcagcagctcccttatgttgtaagccacttaacatatcactggaattatattcaatcattcagtattgactattctgatattctcttgatagtgtatcaaacatgatgttgctgtgaaatacaaagattaactgaagagaacattcacaattttttcaccatatctttaattactgcagatctttataactcgaggaggaaacaaaaaatactcctctgttttagctcctggtcagcatgatagtttaaagtatgactctctccctgatcctcaatatagtatatttagtatgaaacttcatctggacgttgtctaaatggatctacctgaaatattctcatctatgcttttatgtaaaatatatagcaatcatagtccatatgaaacaattgtccggttatttttatgtttcttggtccaggaaatctaatgatgatggtatatcatcctgggattggaaactaagaggtgatcgttctacataccatgcgttgtttcctcgagcatggactgtctatgatggtacctactcattccttgttatagaaataaccctacgttataagatgaacttgataattacaaacattgctttagttagctttatgacttcaagtgctataagtactaattacccatggataagtgtacatagcagtggagccttttttaacaagctaactgcttttctgtataataattaggcacatttccgtaaaaaaaaaattaggcacattgtccataatatcgcaagcatgaggatattactgacaacttcttcggtttgtttaaaggtgaacctgatcctgaattgaaagtatcttgccggcaaatatctccttttattccccataactatcaagagagcagtcttcctacctctgtttttgtttacactgtaagtattcattgcttataggaatgtgctttcaagaacaggatactgagtatgttaaacctgaaagttgcttttttagtgttcattgctagtatgtttgacactttattctgtttagctgattaagtatttaatattttgctcgcactagtttagagcacatacattgcaactggtcagaataaacaaagctacattcatgtatcgcaagttctaaacccagaaaactaaaatggatagttgcattgacatttttcatttgctcaataaaccatagagaattatcataacccacaattgtgagtgatataattaaattacaaagatacacacaaatcacgtgcagactactgacaaacaaaatgccactatcgccagttccttcattgatattatttttttattcatatgaaattgcagatagtgaac

SEQ ID NO: 32079 - DNA, 634 bp, Oryza sativa
tcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgctcaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgt

SEQ ID NO: 32080 - DNA, 6829 bp, Oryza sativa
atagtcgcgtcctcggttatggacatgctcggtgatttcacatgaggggtagatttgtgaaagttttacttttgggaaagagctgtgtgcaggataaattaatgaatatagctgtgtggtcctgtgtggacgcaatatcctttttgggttggttggttggttaaaaataccgtgattgcaaatgttgtttaaatgaaatttatatctatttattgtatttaaattcacaaatgcctttacgcaaatgaaccctagctttcctttgaagccttgtatcatatattacatattcccgtacacttgtgagtactttatgtactcacccttgttgtctcacaaaatttcagagaatgccagttgtttctagaagttctgttgctaaggatgtcgaataggttgcgtgccccagttgattgcctatggtgtgtcgttggtgcctctcgcttcttgtcccactgtttatctctgtttggccctgcgtggcaaagaaattgtaaaatctggtcataagaccaatgtaaaaattatatttgtttcctatttattaatataatcgtgatgtggttgtgatattatcttttgttactgtgtgtgctagcgttgatctgggactagcacattatacacagagggatcctagttggggtcccgacatgccgaatccacttcgattccaatgttgaacttggttcatggtttaccaaatttggtcattaacagaggtgtaccagtttacctaccagacacatctctctcacacgttaccatgtgctacatgccaccacgtcatttggacggaagtcataacaaacccatcgcttaagaccgccctaggtcaataagacaatctatgccctcgtgcatcttaaacccgtctaggacttcatttgcgccctggctaggaccttatatgtcccaatccgtgtcttatttgtttataattgtggtaaacgatgtattaagccttacccattagacatgtggttgtacggagtatactttgcaacagagtcctaaagactggtccttatgattgccaatgtgcaactaacaaaaccaaacacctcgagctaagttgaaaacaagtttgagaatattgaggtagagtccatcaggtccaggctaacaagcctctaatccatcattaatcaagattatagtgtcaatcctaaagtctatatcattacaaattaattactccttcgtttcatattataagtcattttgactttttaaagttaaacttttgaaagtttcaccaagtttacagaaaaataaagtaacatttatagcaccaatttagtttcgttacatctaacattgaacatatttttgttagtttctttgttctgtgttaaaaatattactatatttttttatagacttgatcaaatctaaagaaaattaacttagaaaaaagtcaaagtgacttataatatgaaatagaggaagtaaatgtttctaatagagcattgctgagtataatgtaagcaccccatacagagttctactagttgtttttttacttaggattgtcaaacgtaattagataatatcaattaaatcagatcataacaaggaaatataggaaaggctaagtaaaatagttataacgtggtatatttaataaagcgaatacaataatttaaattaaaatatttttcacaaattagcattcaatatgattaaggagagcctgacttaccttgctcaacgaacggacttaggagactcatgcaatggactggacttgcacttcaggaacctccgaacgacagcaactgcatgaacgacaaaacaaggctatagctctgagaaaaaatggtaacagcacatcaaagcaacatacatgtattctttaagttacaacaaaattaagcaatttaaacaaggctatagctctgagatatggctatctgaagtttatatacagtttaattggatatttccgaattgtttaattattattataccattaaattatgtgtaatgcattagccctcgaggagagaaacgatcaaacgactggcatgtgagacccacaggtcaaacggtagttcaccatggaccggtttaccaagacggtccacgggaaagcagagtgagacccacgtataagttttggagaagagaccgacgagtggatcccacgggacaccatctaagcagccacatgtgtgaacacccagctacacaagggagggatgcgacaaccggcaccggcggcccagcagtgcaccgtatggcgaggaccataggagtgagggatcggagagcagaacctcaccacggacacaacgacagttgacgcagcgaggaggtgacaggcggcgaggtcatgaccacggcgagcgcgagcaacaatgacggcgatgttcagcttgacggaaaatccctgtacgggactttttctaataatttagaattcaaaattaataaatatgaagtcggatctatatatctaagactctcaccttcgtattccatcaacataattaaaaaattatattaataattataaagcttccataattccatatataactaacatatttataagagtactgctacacgtactaaaatttttttacaaaacttttactaacaaatttctcaaccgtttaatttaactagatggaagttgcaagaaatctagatttactcacagcttgacacatcagagtttgtaaacattttgtaagaaaaaattagtacgtatagacttttcctatttagaatataatcataattttaatatttattgtatctggtaataatagcacgtaataatagctctcaccttcgtattccatcatcataattaaaaaattgtattaataattataaagcttccataattccatatataactaacatatttagaatataatcataattttaatatttattgtatctggtaataatagcacgtgcaacgcacaggttagtgactagttttattaattctataagcctactctcactctttaaaattataacaaaatttggtaaggctttaaaccaaacacgtctaccaaaatttcataaggccaaaatttagtaaaatttagcattggtagggttgaaagtagctgcaaagtaaacaagcccgtatagtaaaaattctgatatttgacattgcccaacatatgtagtaactatatacatatataaatctgtacagtattataatacaagattatgatcactcacaactgcatgcagggggcaccacaaataagagaagacggagcagtgcctttcttcttcgaacatgtacaggaaattcactaggaacatcagtgatcacagttaaaacaccattcctctaataatcatcacatcagcattcgcagttagacgagctgctcccgaagcagctgttcttgggcgtcatcttccggacgctgtcctgcaggaactggagcgtgctgggcgagatgtaggaggtcctgtccatggtgttcaccttcggcgcctcgagtatggttcttggaggagacaatgcatactgcattgcccagattgcaaggggccgcatgtatatcagcgacctgtagtggccgtcgatcgtccatgcttcaggggtttggaaccagtacctggttatgtcgaaaattcgtggttagcagaagcggagtaaataattgcatctttttttaaaaaaaaagtagagtggggattagagggatatattaaaggttatggctcgttttcttttacatatgccaccagtatatcattttcatggaaatagaaatcgataaatttacgatggaagttcttataggaagttaagaactagcatttcgatatgactttgatcttaggcaattaagcagctgcagcaagaaaagcgaataaactctaagaatagtccccaaactcacttcctaaaagatgaggtacagtgatttgtatgattatatctggcaatcactgaaaatataactgtcttatataggttaagatagggcatcatcttacatctatcagcagaaaaacacaaagcgtgttattggccacagatgctaggacaggaaacataaatatagtgaaacaagagggcatacccatagccttcttcggaccatcctgcggtgaaaatgccttctgcagtagtgaaagcctgatcgtccattccatggagcagcatagtagcagctaaactgtacgttactcctgtccagatttctcttgactgcatacaagtctcgtctaccttaccatttggatgcataccgttcacagctcccatacgccctccttttaccctcatcacattatagtcaaatattttctgaagggtgcattttatcctaccctcatcaaacagaggcggcaaacctgacgatgcagtataccattgtccagccagttgatccgcatggatggagcgactgttgtaacttgttccgctgtcataattaaatatgaaccattccataactttgcttcaaatacgggcttagcttttgcaaacttcaacatgcacctctcagcataatcatggtgtccaagggtgcgggccagcgctgctgcagtttgaagggcagcaagccaaaggcaaccacagtaggcacttactccacgaactgtccaagcatcatatgtttgatcaggaaagccatcattctcaatcataccatcatcgtcatggtcaaactgttccatgtactccatagcagtacaaaccgcaggccagacatccttgccaaatgacatgtcacctgttgccgcgaaatctctgtaaacctgtagcacgaacttgggattgagatctttccatctacttgtgtcatgtatgttgtacgcattcaattcatgccaaggatcatgggccccaaggtcatgggcaacagcaccgattactttgcgagtgccccaagtaccatcagcaagaaacctgactctacttttatcttcgcgcagaacagctgtagcaaaatcacgttgaatgctcagctcaatcttaggaaacagttccagaagagcaaaagaggcatagaagtgtacatcataagtgcaccacatgaagtactctattccttccaggtataaaaacttccctacattttccctgtcatcaattatatgtgggctaaaaccaatgagtggaactgcagaattgcgactgctatgatgaagtggcaaatcattgtcctcagatagccttgagttcatcatttcatcagcatcagccatcaaagatgcactatctgtgagtaaaaagatacatatgccaaaaaactaacatcattacataagtaattaagatgctatataacgtacgcatacagaaaactattctaagtaccatcaccttcccaagtgaagatataatgggacaaaaagaaattcatgtgctagacaaagaactgtattaacgttttccccaactgagcaagcttttagaacgattttccttcttgttccagagtaacttgcatgaagcaactatcttgctacataaaacaatgagagctagttcatgaggaactatgcaatgtctttgtttgttccaaaacagctgcacattgcaatagtactatatttgtatggaccaataaatagaaataatcgtgttgtacttcattgcaaattttgtatgaatatagatccacacattgacaattgaactttttatcctttatactattctctctccagatgggaaaattgaaaattgaaagcagggagaaacaaaaaaacaaaatgttaggatggtttgctgttgacactcgcagttgggatgcagataaggacatttccgtaagaaaccattgacataaacaacttgctttctatctccaaaaaaaaaatgaaaaactgaatagtaattctattccattggtttttatgttcaaatccctcgagtttactatgtggcttgcaaaaataatttgcctaagagaagggaaaatgaaaacagtactagtaggaagcctatgcaagacatacatacctatccaaacagttcctccagcaactaggaagtacagctcattgaagagagtaaccttgtacctgcaagaatttaagcaccagaaagcacaaggatattatcttttgtgtagactaaagaaaactaagaacttaacacaaagctctataacttaacacaaggataatactgccttgcagcagccaactggtaagtcatgtacaagtacacaccactccggaaacctctcatcatggagaattggcctctgccacttatcaatttcctcttcccagtgcttatactctggcaatcatatcaataggcatattttcataagggcgtaacaggataaagaaataaatatcaaatgggatgaaagtagcagctggatgaatcaatcaatcaaatcagggtcttcaagaatgagaagacaactataatcaccataatgctaaatccatctcaatatttgcaaagatgtgtatataatgtataatagaagtttatggaaaacatactcatcaaagaatcttgcaccaagtttatagctgaccttggagaagttccataaaattttgtatacctcctgccagcagggaatgaaatagaattttatttaactagtggaccttgtaaaaaaacagatattttcgatatagaaatataaatgcacatcatttggaccagcttagaagaccaaaaaaaaaaaaaagataacatatggaatattctgtaaaattaaataaattcagggagcaattcaagaagaatgccgtgtggcttggtgggtgatgcgccgatcccctgcatgttcaagataaaatgcatatagatatacaaaatagttaaggccatgcaatagtatacatgggctgcaggaat

SEQ ID NO: 32081 - DNA, 631 bp, Oryza sativa
tttaaacatttagatggtatgatagacagtctcagtcattgtttcattgatatgacagtgtcagtcgtcaataagagaaactagtgtaacaaaagatttgccctattcagagtagaaatgtgaaataaaatatatcaaggggataatcacctggctcaatgtgccccacatttccctagctgtaacagaactttctccagaaagcccaaaagcaggcaacacagtgacatttacattttggttctcacatgctgcaacagcaaaagttacaggaggattattgttggcagtcctgcaatggtaggaatacctaatcaggaatagaaatgatattgctcatcttattagatcgcatacaaaaacatagtgcatatctacacataatttcttgcttccagtacaaacatagcacagacattatggtattgtttcaaattgtatcagagtgaaccagtagaggaatagtattgcaaacaatgacaaactactagctcttaatctctgtggcacttatcagtgccaaaggagatctgacaaacaaccatagcaagaagagtgatcagcagacaatgacttgcttgtgatgcagaagcacgccagaaactccattttctcctcgggctgcaggaat

SEQ ID NO: 32082 - DNA, 4130 bp, Oryza sativa
ttgttccctagagttcgaaattctacagatagttgtacatgtggcatgttcatcctacgtgtaaagtacattcccctaggttttcagctacaaaatgaaatcttttattattttaattttttatacatgttgtattatcctcatttacctcaatgttcaaggaaaaaaatgattaattaacaacaatgttacttttattatgaacagaaaaaacttaacttgaactgaatcttcaatttgcatgcttttgtagtacagcaacaaagctggaaattaaactgggctaacatttcttcttacaaacacgctcacactttcaaaatatgctacctaattgaggctatcattccacagaactgtaacatacccgaactctagaccttaaaaattttctgtcaaaatagttggaagctaacttttctatttttgagagccaaaaatttccattttaaaacctaggtgaagttgatataactcttgcatgataaaattttagaacaaattaaaacctttgcatctctaacctaggacaaaaatataagtttatgtgtaagcatgcatattctcatagccatgtttgacttgagtccttcatatgcatttggattgcatttggattttcgatttgcatttcataataggtctcataaatattaactaagatctagataaacaactgaaccattagggcctagtgctagctagaggaagttaaaataggaaccatacatcttaaaatatatcaacaaggccaatgtcaagccccacaaaactatttggtcatccatctgaagactagtcatgaacctggaagtgaacaaataaattaactcatataggatatattccaccttagttacctttataagcattctcttaattaaatactagagtaaacttatgcataaatagttaaggagcttattacatgtgtaaggtaaactaaaattctaacatatcaacatcacctcaggttaagaagagtctaaatataaaagttttaaaaacatttacatacatttaggaaaggaaaataattcttgctaattatttaaaataatctgtgcaagataaaatcattgaaaaattcatgtaggctctaattaacatatacaacacacagtaatttcggtataatttaataactaaatttgatacctcaaataaataagttaaaccagacaaataatagactaattataactcctaattggctaaaaccataccttgttgaaaagtgcatttaactgcatggaagtgtataggggaaataatttattaaaatactaggttaattatcatgactaaatataatttttctagaatttatcttctctgtttaggtctcctaaaaatccaaactagtttccaaagaacccatattcctctaatttctgtgagtaatctatccataatttttgaggcaaccaaagaaaatggaatctaggtatcttcatctaccttcagaaaaatccacactaaattatcctacccacaaattaaataattgaattactaaagtgggagagagaaataatcctgaaaatcattcaaatcttttgttcacccacgtttctgcccaaccctctcaccctagcttagtttgccacgacctggacccacttggcagccactctggctcatcctcaccctgtgcaaatcttccagccgaccatagacagccgagagagagagagagagattggcgccggctgtgtacgacgcgtggcctcgacgtggcagcgccgaaccgaggcttcacctccacccagctgtgtcgccactcttcacccaccatcccagtgccgatccaaccgagggaggaagctccagctctccctctctacctctctttcgtcgccggccgccaagaagagggacattgccaaccgtcgtcgagccctctccatctctaactcatactcgttccattctcatatcgccatgccgaacaactttggttttgatcccattccatttcatcttctacagcagcgggaacgccgccatgtcatggtcgctctagagcgcgctctgtgcaccgccgcagcgacatcatcgccgttcccgcttatctggaccaagccggaccaagctgtcgcgccagcgtcttcgcctcgacctcctctccatttcccctcaagaatctcgaaggatggtgctacgagtgtggagatcgtccaccgtcttcttcacctccggtcgccgtcgccattgtcgattccgcctcctccggtgagccattgtccgattcttcgcgtatacaccatccctggggcctcactaacctcatggacacacatacatgatagttcttggagctgattgagccatcgccgttcacccggaggttcttgccgccgccgagccgttacatgagccgccgtcatcaacctagctaccccagccatgtctagcatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccaagaaaagtagaggaatggaatcgcaatatcatgatcttcattttgtcttttggtcgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgagcctaggtctgcgggttgattcttagaaaccgcagggatctttttgtatattgatctctcactgacagtggaccccttggaaacaaaaatctgaaattataaaagaaaagtacctaaaacctgtaaaatccatataaaattaaatatagctcattttaagatgattcaaatttctgtgaactcaccaaattgtgaactttgatgttatggaataaaaacttgcactcacagtacaaatttagcctctaaaatttatccaagttaaatcacacataaagcatgcacaaatttataaaatgcatacaaaattcatttcaactcattttagagcaaacttagtttctacagatccaccaacatgttctctaaaaataaagtaaaataaaacatataaacactttacatcaaatgcctctaaaactattatctttaaaataactagttttgcataagatgaactttagaagtttatataaaattcatcttagatcctttttgagtaaacccaagttctgtagaatcaccaaaacatatacttccaagttataaaataaagttatatacttactgtatgataaaagcctctaaattcttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctatcgattgagcaatatgtatatatataaatgtatatagaaatacactctagctataatgaaacacaaataaaacctgttagaccagtgaatgcataatgcatagttccatccccatccaccaaaacttaaggcacttagctcatataataatttttaggttgatataataaattgctagcatggactagagctcccctagtttataaaatatgaaccatggtaataaagaccataagcctatgaactaaggttagattagttaactaaaatactcattttatacatcactagctagatgaggcaagttctggacctaaacctctaaagctatgaacctatagaacactatacacctataacacgttataacttgtaaaatacataaagaattcatattaactctaaaaattatgaaaccaaatgtgttggtcttagaaaacacatatcttcaccccagcaaacataaacttaacaagaatcaccttacaacagcatttcacaatagtacctaagtaaatcctacactataccgacgaaacttctaaaattcataattctcaaatgaaatgagataaaatataaattctttcacctaa

SEQ ID NO: 32083 - DNA, 8386 bp, Oryza sativa
acctatgttttggaggttattgaaaatgtttgaacctatgttttggaggttattgaaaatgtttgcaaatcctgcatgtcgattgtacattaacaaattaaaattgtgttaaacttgttagacaaactcctattatttacattatcaccttaaccccacatatatccatatccatcattcctatccttaggaacaatatgactataccacgttatatatgaattttggagtcactaggttattataatgcttagccatgcttagaatggtcttccttgtcattatgggttcattacaaatatgaaaaattgattttgaaataatctggacagaactttaatacttgtgattttcataaataaaatgatggaaaacatggattttaggtttgggcctcaactggtgcacatatggtgattagttgtgtaccgatagggggagagtgcacccaaaccgacctaaggacttcactcaatgtcagttcatttcgtatacagtacaaccacatgtgctagtatgggatagctcaagcttagtaaattatttatggtttagccttacattctggtagaccggtgcgtatgaattcggataactcagaggaacttcctatttaccccgacgtggtagtttaggtcactaagtctgtccaatacaacggtattgtgccacgtgggtgggttcccgttgtgtccgccaccacggcgttaagtttaaggcgtgagcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattcgttgtgctcgcggtcatgagcggcgtgtggatatctattgagtatagacttgtgtttattctcctaaatgctgaaatttacctttaaatcaatttaaagagatttgagaatgatctccttgctccttgctgccatggaaggcaatgaggtgcatatttatacatgattaatgcctattttgatgcccaatatgacaagtactagcttgttgaaatttatttgaaagtaaacctgatttggaaatgttttatgcaaataaaacttgctttatgctaaaaagaaccatattatgtcttccttgattatatgccttgcaagtagggtgttaggcttgtcttggtgcttgccctaataatgtactgactcttgctattgaattaatcttttgcttgcaggttttagacttagtctttgagtgatgcgggtaatcgactgcttcttctagtacttgaacttaatggggtaaacccctagtcggtgtgcttgtggattgggtagacaagcttccgctgttctatatatttatttggccggtcggccaatgtaactaaagtagatgtagtttataatcgctttcatcttatttgtgtttgctatgtataatcatgcttgagatgaaagtgtgaatctagtgcacatcctgtgaactagattcacatgagtatgagttaagaatatttgagatgttatagatctttagccatttttgttaagtctcctgaatgtgtaacacatctggtcactgccttcgagtggtttgacgggcgtatctcaggctgaagttgactggcaggttaaaggctcagcaatgtctccaatattcctctctcgaggcgtcggatattttattatgcttgtttgatgacttgaattattcatttcatctctcaattataatggaaggtccggagagcctatgacaagaacgaaacaaaattgaaaaaacaaatagcccaatttcttgaggactaaaaccactgaatagtactagcttgctgcaaaaatggaggaagtgcgcagtgagttgttctcggatgcttcctgccgatttcccttcaaaatcagacccaaatagcaattatgagtcaagataaattcgtgaatgagcacaaatgaaagaatttgaaattagcatgaaattgtttggctaaagaacagtacgagctaagttcaaatatgtacaaccatgtgttgttcggcatcaaaattaccaggcaacctgctggctgtggcgtgtacattggaggtgtaggggatgcgaccatttgctgttcgctagctgccggagcttgcccttgggacacaagctaagaaaagaaagagagtggaccggatgaactaaagaaccaagtaacatggatctggacaaatgattgagtggagaaaggggcgttgcggcaccgactgcagctatagctggatttgcagcacttggacgtgttaatactcaaatttggctctagaatataaaattgaaaacttttgctaaatttaaaaagaacctagacttgtcatacgaggccggtcggaccgatagcaggggccggtctgaccggcagcatgtgatcggttagactggtagagtccgactacaagtttgatttatcagttcttgggttttcttgctaaggcttgatatttgagagttctaattggtttctacagctaattgaacgtgagaaagaacctgggaagcaatttcaaccctcctatagatataagtgagctaaggcggattgaaacaaaaccaatcaatcgttaaaatcaatttaataaccaaaccatctatattttctatctcactttttcttgctacctatcccaagtatattctccttaaaccggacatcctagctggcctgttgagtctaggacaaaccggcgtgtgttcaccccgacggggtctctccgagtgctcgttcggcgacatctatccgcgccctataacggcgcgtctctgggtgccgcgccatgggttgcacataacgtgtgtggcggcagcacgattctacgtcaacagaacgctcacttgtagctggtgtacagagctcgagcctggttgatgcttggtagttaggagagggcaagcactggccaaccatggaagaagaaggggaagatgtagattagatgggcccaaaaactactgagcagtgaatttgattttcaaggcgcgttgttcttggcggggagagaaaaaaagggaatgctaatctggccatcctagtgctgatgtggcacaacttagtgtccttctcgtcagaagttccctaggaacatggacaaactcttgtaccaaaataaaaacttttattgtattaattatgtagccatggatatatgatgatgctaagggctgtggggcctctcttacaaactcctggtaaaaaatgatatgacgaggacattactcatagagaaaatttcctatgtacccataaaagttcacctaatctcttatttgcttctgaattttgctcattctcttacatacccctgaattttagtttggatcgcttccacgcccttttctctagttgactgctaaattattatgaaaaagtccatttttccctttgctacgagaaacataataaattaatggagtacattgttggatgtagaaatttgttggatgagactattatatttatgagtttgttatgcaccatattaactgcgacaaatttagttttagatttgatataaaaatttaatatttatttattagttattgaatgtttttttatgtagcatattgttgacgaaaaatccgcactcggccagtggtgccgggtctgtgctggcgcaaactaagtcgacgaacataacggtctgggagatctgcttagctccagtgcaggtccaaaggttggtgaaatacaggcgtgtcagtcaggtttatcctgaaactaacaagatatacaaatagcaggtcaatgagcctatcggctgacgagccgatggagtagttccagtcgatgccgataccagccgatagtgatagggtttggagctatcggttatatatccaatttagattctgatacttgagacaatcggctgataataataaataacaataatataatccagtagaaaccaatcggctaacattgatatgatagaataagcactgatccgaaggttgaagaatacatcggttggagatccgatgtcataaaatccagaagattagattaaacagtgaaatctttgttatcatcgtctaaatccaacttatatgcaatccttgtaaaccgatgcaacatctagatacctcatcggctgaaaccctgatgaaacccttattggcagtccaaaagcaggctagagattatggttctaaacatgacttagtagatcaaacttaactgatgcagcactaagtttgaaaagaaacacaatatctagataatcaagccgttgactgatttttcgggtggtagaagccttagctaatctaatctagtaaaataatttagccgataccggcagaaaccctaaagcgagagacaaccgatagagctaaattgagaaactaagactagattaactaagacatatgataaatagccaagcaaatatatcaacatcccatagaaatccaagaagtcaaatgtactgatgcagccttgaacgacaccaatgtagccaatacaattgactaggccggtagaacattggacttaccccttcgccggagatcgaatagcgatgtagccccgcgtcaggtgtcaagttccaccgtgataaataaaataaagtagaaaaggtaaaaggtggcgatccaccgaattgtattgatcgtggagatattacaatgaccccgggtgtacatatttatacccatgggtagatactagtccttgtaggataagaaagagactttcctaaagatgaaaggaaaacataaagtccttataggacactaaacatactttcctaaagataaaaggaaactgacaaactattcctaattagtagataacttgccatggcgcatcctccttgaacacggtcactagtggataagcttcctttaatcgattaatttccttaaccgaatatagctggaatccaactatatgtgttttgatagtaatacaatagatagattgttgtataagacaaatatatttatatgcaacataaacaactttcaataagtaataattaagtattattttttatgtcatctctaaatgtatatttatcgcaaataatatggtgcataactaactcataaatataatagtcccatttaacaaatttttaccctccgataatacactctattaatttatatgcttcttcaaagcaaagggcaaaatgggcttttctcataagaatttaacggtcaactaatggaaaattcatagcctaaactcccaagtaggcaaaaggtggtgcggacccattctcatcctcttccttcctcaagctcccgcctcctccctacaggtcttcaaggttgagctctctccttgttaagataatattttgtcccatgttcgctaagataatattttgtcccaacaaactgtatgttctttcattaaaaacacaaaaatgtatcggcaatatgaagcacttgcaccacataaatgctttaatcaggtctgttatgggtggttgcattccaaatatagcttacatgtggttggtcacctaaaaccagcacgatgcaaaaaaagataggaaaaacgtgtctgcctcgttaggacaacaaatatcatgggaaaagattcatcttctggcataagatcctgtgggaaaattaaagttttactaagtttcatatttcaactatttcatatggtattgtaggctgaatcgacaaaaaaatcattttcctcgcacttaagatttttcttgtgttgaacatagatctttttttaatttatccactcagatcttgtttttctagtagctcattttctagataggaatttcatcgtttataagcattaagctggtaatcagatgcaacaaatacatgaaccaagactagcttgtagggatctaaaaaagggaaaagcgaaattattattaaaaagggaaatgggatgatgggatacaaaatagaaaggaatgatatattgggatgtaaataaaggagtgattgacaccctccaaaatcgatagttgaccatgctttctctggcaaaatattatctcagaaaaagtccacctttgccatgttgtccaggcaatcaagtgataatgagtctcgcattacttgggtggcaaatgaaaattcctgattggcctgtgagaatcctgtaacactgttgaaaggctaagccatgtcaccattggatccagcagtgccgcttccactgctacctccgaaccgattgtaccctattgagccaatgccccttgcaacatccaccagccatccctccctctggattggtacttccgtgctcgacaatgacacggatgcaggtatgaggccttcctcacggagcttcttgaggcggtcgttgacaatcttgaggtgtgcatttgccatccatccgaggctggtaatttgctcgatggtgagaccctcgaggctcgggcggtggccattgatggcttcaatgaggagtagcttggtctcgctttcatcagcatcacgtcccaccttgtgcaactgctctttgagcttgttgacctgctcgttgaggatgtcctctaggtctgtcatcttcttgtatctgaccagatgcggcatggccttgaagtgctcgagaactctggtcgcctcccacaccgacggccaaaccttcgttgcttgcacctcaacctcaccgtacaccatgaggaatagtgttgcgaactcactaaccttcttcgtcaagcccttgagactcttcatgaatgtcacccgctgcttcacatcaatgacgatcccctgaagcttcaccttcttgcgagccatggcctacgcagttcactactttctagcaagaatgcacctgtagattgaggagagatggttagattgatgtgaaatcaaggaaaggggaatatggtggatttatagtgggagatcggattgcaacaatcgccatgttgtggaaagaaattatttcgcaaatccaaaaatatcaaatgaatcaatgcaagttaatgctttcctgacaaaaatgctcggttaatgtgtagctggcaagcatatctgtcaacctttaatcgtgcctgtcaatagccaatagatattactcgctagatgataatgagttcacaccaaatatacattcatgcccagttcatcatatatgtttgagttaatcctctttgatatgtgcaattggaattcaatttacaactacagaaacgatttttgctacattcaaagagttccaaggattgatcctgtcacgatagctgccatcggatgggccatatccacagaatggatgatttcccccatcactcataaacttgtgaacaagggagccgccttcatgctccgctcgccatcacagcttgcatctgttaaaaagcacacatggctatcttgttaagaaagagaacactagattactcggaaaccatatttttatcaactctacatttattggattgtttatccatctatgcagttgagtggagagaacattgaagctagcaatgtaatattaggctcctattaaagcccctttggtccaaaattatctcgagatatttattgcaggtcatcaattatattattaaaatttagtaaagccacaatgctcagccaaaagaactagagaaacagtacaatattccgagggaaaaaagaatttacatctttgatcgtgcagaatttagattgtgtcaatttagactattctaccacatccataacatcaattggagaaaaacaagaaagattaacaccgctatgttcgatgggtacagattttctcactatattgattggtctgccccaaccataaaagaagtatactagtataactctattttacagtgaagattgcatgaaaacctcggctagttcgtaaaattttatcttgtatctgttcatggattttgggaagcacataagcacatataaagttggcttgcaaattgcacaagaattacatttgggagtttccgtgccgcgatcatttccttcagttcttggacagaaggtgacttttatacctaaccagatcaactttgcatgcatttgtaggatgttgttccaagtataattaagtccaaaaatagcttgaagaaacagttggagaaaatagaaactcccaacgctgaagcacagaagattgttgacctgccaaacttgataagcaataaaaaaatgacaaccatagacccgatgcttttgccctatatatatcgattccattgcagatccaccacgctaggtaatccgatgaagtatgaaacgtcggcagagaaaaaatgtgatcaatgacgatgacaacccaagtcccgctg

SEQ ID NO: 32084 - DNA, 1475 bp, Oryza sativa
gcactgtagaaaccatataatcctcaacagttttccttccgttttccttcacgaacaccaacgcttaatgtagaaacacctcgtgaagcccgttgcaaagatctctcccacacggtgtccatccactatgtgccatctcatatccaacttcgtcacccattatcactgaccgtttgcacctcaactgctcccttgtctagtcccgatcccacgttgaccgaagttgacctccaaaaatcctaactctagtcgctttctcacatggtatcccaaccgcactggacatctgctcctccctgagcatagtctcgatcctcaccattaaccaagactgaccataagttacctacacactatcagacaacacgaattgactcgcattagccaacttgcgcttcttgctttccatcttcggtgcttgtcctccaagcggatcgccttgtcgactagtttttggaagtcttcgtagtcaccagagatgagatggattgacaattcatcattcaacccttcaagatatttctcttgcttctcttcatcggtgcgaacgtcctcgggagcatagcgggccaacctattgaactcgtgcaaaaattcagtgacggtcctgccatcttgcttgagttcacggaattctttcttcctcagggctaaaactccagcaggtacgtgagctctgcgaaaagcaatagagaaacgagcccaagtaataacttgtccagctggttgggtggcctggaagtggtcccaccactcggaagcagtgccatgcagttggtgagcggcaaaagcgactttctcctcatcagtacactagataaggtccaacttcttgttaaccgcgtgcagccagtcatttgcttcgacggggttggttgtgtttgaaatagtgggaggccggacttggagaaattccgacagctttgattgtggtggagcgtgtatgggagcttgagcagcaggtgcttgcgggttttgcatttggtggagcaaagctgcgatgagatggttttgattggcgagcacttgtgctaagttggggtgatcatggattggtggaggtggcggtggtggtgcgtggccttggttctgattctggttctggttcttgttctgattctgattctgagctgagttcccagcacgagcattgttagtagcaatactccttgtgtttaccatctgtagtaaccaagatgagaggaaaagaaagaagggagatattaggacaagaacacgagctattaaaccaacttatttaaattttattgatgtgatgttggttacatagagttcaagttgcttaagcaccacaaaggtacagctatatcacaacgggtcgatatagtccataccaaaaagcacacaaggcaacaaactcaagtagaagataaatgataaaaatagacgcgtactaagactacgcgtctactcgtcctttgttgcgttgtcgtccactgtcggctctgactcat

SEQ ID NO: 32085 - DNA, 9526 bp, Oryza sativa
ccacagtcaatccccttcgctccaagtagttctggacaatcaccctggctgacgcttgagcatcgtgcaccatcggaggaaggccatctcgcttgcgtgtcgtgatcttcaaggacggtccaacacggcaacgcttagaccccacaacagagcttccttctccaacctgaccatgtccgagctcgaggttacgcaattcccgcttcaggctagccatctccaacttcacacacaggttcttcctccttagccgtagaatcctactagaagcttgaataaaacctctcttcgccatcttgtagtagtcgacacgagcatcatcatacgcctgcaccatcttggccaggtgatcgatcgtggtgtcgttctcgtgctcggcatccctgaaggtggcatagtcctccgccaaactgcgagtaggatgatagcggaatggagtgtgttgcagacgtgtccagtgtcgttgaagcagcctgccaatgcccagaagcaccacttcttggcatgcgtcgatgaaggtgtcagtccctcccgttagctccaatgattccaagctagggttggtggagagcaaggtggccttgactgaccatcggggggatgccaactctttttctccttcgtctggcacagtggtaccaacaaactggacttcttcggtgtagcccagctcaacgatcaagtggcgaagctgcagaactaaccccttaagtgagacgccattgtaggggccaaggctggtcatctatttttcaaaaaaacagaacaaagaattagtaaacaattttgcaaagcaagagagggtgaagatagaataaaaaaagtttccacaattaaagaactattttctaaaaaaaaaatatcatcctaaggcttagaccacttgctcatcctacggtcaaggtggctctgataccaacttgtcacgcccggaaatatacaccatttccaaacgctcagtgcattaatcctcgtcccagaaggcgaggtacacatagacattgttgattattacaagccacacttgcggaaatgtaaagcaagtactttattacatgggcgacttaggccctcacactcaaagataaacaaataaaacagcggaagactacagaacaggcacttgatggcggagcgaactagagatccaagccttcatcttcctcaggtccatcctctggattatttttgtgagcaagactgagtaccaccaccgtactcagcaagtcacaccggaaatgcaacaataatgcatagggtaaacaaggaaatggcctaatagggtttattttgcataaagccatagtttaaacattttaatcaggttaaagctcattctaaaacacgatcctgttctaagccaatattttcatatcatcaaggtcgcatgagcctgcgaacctgtcttaacccaggctaatctccacatgactacaccatcatgatttcaccctcccaaggttttataaaacaaaactaactttgggtacattgctcagcttgcccataaccgagggcgcggctattcgaataatttttaactctgatcagaggtgtacaactttacccacaagacacaacctcaacacacgttaccacgcaccgggtactatcacagtactcgaatagaggtcgtgacaagactatccatctaggtctacccaaaacaggagaacccgctgaggtttcgccgcccgccggtccccgacaaggtaaaggatgccggatcccccaggacgagacaggtccccccttgcaccgagtgaaaattggccttaatccaggccccacacgcttccaaccaatggtctttgttttgagaagatctaaacttctagtcaggccttacccactagacttgtggttgcacgaagatgccttgcaacagaggcccgaagaccggtccttatattagccggggtgtgactaccaaaataacctgcttgcaccccaagcccagcccaaaaatatgttttagttgtacaaagcattttatcacccatctattgacaaaccagtcaatagtccataactaatccagttttagttgttaaccaccatagtctagtttatccaaaagttctacttcctccgtttcacaatgtaagactttctagcattgcccacgtttatttagatgttaatgaatttagacatatgtatgtgtgtagattcattaacatctatatgtatgtgggcaatgctagaaagacatacattgtgaaacggagggagtaggttggaactaagcatgactaagcatttacctaaaacaactagttagtccatcatgtaggatactagactagtcaagttataattttactagggttcacaatgatcatggatatcaaatcaacatcatggccataacaaagagcataggaataactaataaaacaatattaataatgaacggtataatctataaagcaatgcaatataagtaaaaccacataattttcacaatatgggattcaacatgttcaaggtagatatgacttgccttcgctcacaaagtcttcggcgtcaacggcgatgaagagctgatcttccggaacagcgggatctacacgaccaacacgaagaaatataaaaaggctaataaaaaccacatgaacagaagcgacaaagcacataaatgggttctactcatttttaaggggaaactagagatttgaacgggtcgattctgagttcaaacggtcaagatatggccatttgaagtttagttgttatttaaatggaaatttacaattttgtgaattatttttctaaaggaaaacttgaattattgagagagagcgcacgcggaccggtccacgagcgggtcccacttgccagccgctcgatccaccgtgagccgagcacaccgagggcggctcacggcacaccgacgcacaggcacgacagcaaccgagccaggcggctcgccggcgacggccaacggcgcggcggcggtgcgacggactacaggaaagggaaaaacgaaaagaggaggaggtgacggttctcaccgagcagacacggcggcgagaggtcgacggtgttgctggcggcgagggagaaacgacgaggaacttcgggttgtcggcgtcgtcgtcgttcccgcggtcctcgtgctcgacggaggggtggacggggaagaggaggaagcgaagaagcggatggtggcgacgccgggctccgacgaggtccggaccaccggcgaggggcgaccggagctgtgacggcggcggcacaagaagagagcggcgcggcggccgcgaagagaggagggacagagcggcggtgtgtggggagggaggagggagtcgagggtcccttttataggccagaggggagggataagggtgccggggagggagatcgacgccggccatggtggagctcaccattgatgaacaccatcaaaatccaccgcaaataatgcgggatcgagtgtgaaattatgggggaattggacaggatgaggtggaaattaattcccctcaattaatttgatgaaacggcgagtggaggaggcgaatctgaggttgccgtcggtaggaattcggccggagagagagaggatggctggaggttagggatgacgggtgggacccacctgtcatcgagagggagcacacctgtctctgactgggcgcgcgaaggaggaatgatggacttagtccgagggagaaggaatgagctgggctggcccaaggagagggagggggaggggggaataagttcaccttgggctgggccaagagagggagagatgggctggaagcagcccaagaggaggaaggggttttcttttagcttttcctttttataaaattcctttaattgtttttgttgccttaaaattatttaggatgctctgaaaattcaagtaaaaattggttacacattttgaagcatggggaacttattaaaaatacccactagccaacttgacataaatcttggtgaattttaattgttggaggctcttttaggctttttaaatttctagaaatgcattaaagcacaatttaaacttagagcgattttcagggcgttacacaggcccaggaagccaatcccggagcccacgagtcaccctcagcctggcctctcctttcatccgcgtcgctggcccacgctgccgtcgatggggaccgactcagcccacgccctacgctgaggcatagccgccgctgaacttccacaagccgcgcaaggagaaccggtgtcgtccttccttaaattggtgttatgcatcgccctaacactaacctctccctctatagataccgccggtcgtcgccccttttcctccccttttttcctgctatttccactgtcgccgtgccaccgacttcgcctctgcctcctcctaccgacaccgcagctagccagtgcctcggtgcgccgtcgccacagaacgatgttgtcaatgccgttgtgccggagcgtgcccatggagccatggctgctcttcctcctccgttgtgtagctgatctgtgggtcccgcgacaaaaaatccccaaataatcacagccatccaaacccttgattcaatctcaaccattggatctatttaaccctagatccatccctgtcagcgccacatcattgccctgtatcacctcatgtccatacgcatcagctgagtccacatacaccgagtccaccatactccataacactgtcagtgggccccacacatattttcttgtcagaaaaaattcaatccccgaaattaagtatccaaagaatattcccggaatattacttttttcttttaccctcagattttctctgaattcaaacttctgaaggctataaattttccattcgaactctgattcaatccattcttccaccttaagtcctctaaaatcgagctctacgtcctggtttaatttgttgtttcattttatgttctttagttagatttttcttttgtttatttgtttttcgtttgcgatcgtatagacattggagcagaagagcagtttgtttcagaagatgtcgtgcaagactgggatcaacgcaagtgcactctttgaacatattgatcccatttttatcaattgttttgttttgaatacatgcattattttatttacgaactaatgatgggtagcgtaacctaattttcattatatcctaccttgataacttttgattacccatgataccttgtcaccctagtctttgtgagttgaacattaggctcaacaggatgcaatgtcgtacaccccgtaaaatagtgaatgctgtacaattggaaactttttttttcttgttgtgcattagcttaaattgattaacgtaaattattattactccgttatgctctatagatagtagcaatatgaaataactgcatacatatatttgtattaactactcaattatagttgtctcatttatttctttcagaggataccatgaaatgcaaccctacaaaagcatagtgctaccaatgatatatatgtttgggcttcaaggatagaaactatatcaaggcggcaatatattactatttattcgctcttacagttttataacatcggattgggaaaaccatttcatgaaaaaaagtttcctgcacatggagaccaaggtgttgccctcaagtatattaggaacccaaccgccgctttattggatttaggagttggttccattgtgcaacatgtgtgctagtaggggtgaaaacggtacggaaaccatctttatcgttttcgtttcaattttttttcggaatcggaaacgctggatacaaaaacggaatcgaatattatcgaaaccgaaaacagagtgaaaacgaaccggcgcgaatacggtaacgaaaatttattagaatacaaaaacccatcaaactgataaattcaattctcaagtctcaacggtcaacaatttattataaaacacaatcatataagtccaattgttaagtctcaacagtacatcacaaaacacaaatctatggaataaattatctatatttaagagagtaatgttgttgataaatcccaatgcagaaaaaatatattcttatgtaacttcaaatttgcataacaaatattttttttaaaaaaataaaagccaaacaccgtggtagatttgcataacaaatatttttttttaaataaaaaagccaaacaccatggtattcactattcagtgctaaaaaaaatccagggtattccgagaaaatttccagaaagtttccgactgattccacgttccgacaaaactgcccttatcattttcgattctgtttctgagaaaatatttccgaattcgtttccatttccgaaaaaattccaaccaacagattccgttttggaaataagtccggaatccggaaagtttccgtaccgttttcacccctatgtgctagtggcgtcttgtgcttgcttaggttgatttctgacctggtcatatcttatttcatattctgtaaattgctagcatgcaaatatatttcgagcatggggagcagctctccaacccctgggaaaaccggttgatgcaattaagtgaagttacatgcttttagactcaagtcttaaacagtatggtgatgttatgaggttgtgtctttttaataagaaatgttatgtcagtttacaatataatcgcataaattgatatggatctgcactccaagacgctgtttgtgctaaaatacttaattaatataataaaatcatagtacttttgtacatatagaaacagcagaatagaagaaaatttctcataaatattagccatataaatttcagctctttccagtgggaatatacaagagtgcagtatatcggagatattaaagaggaccatagaatgctcgcaccacagcgattctgcggtttttcggctggcgtgttcgcttcccgtgatgtccacgctgggcgctggagctggcaatcttgcaaaaaagtccttgattaacttgataatcattcttaagtccctcactgtatgtttctgtattttgtattcttttgtaaaagccctcaatgtcttggtatatcctacgtgaaggagacgaaattccaaatataggaccgcgctctgaaaaaaggaaagtaagggtgttttctgcaaaacagaacatccctatcccctccattcccctcaaaccctagccaccactgttcacccaccccttctcttcctttccccgctcttgcgccgccgccgccttgccttccctccccggcttctcctcgccaacgacaacttgctcctcgcgctctcccctatcctccccttctcctggtgctccctccatcactctcctcccagtggagcaaggggactgggggactcgatggtgcaggattggatttgggtgcggtgatggagtttcgccgacgacagcctccccctcgagctctcccctgttctcccccatctcctggcactcccccaccgctctcctcccagcaagcagagggagcggacggcgtggcactagatccgcggcacggtgatggagttcgatagtaaggaggtcaatctgttgcctcaccccttgacccattggggaagtcgttctgatgtgtgcaagggaaaaaaagaagaagaaatccccttcatgttggatctatgcatgactgatctgcttcccgttctgtgtctaccacctgccagccatgttttttctcagatgagtgcaaacctttcctctattcttgcttgtccatggtcatgagctgcttttgacttattgccacaatcttagccgcttgccatctatatatctatatatatataatggttggaggtcagagattaatggtatggcccgtgcaaatatctaccaagattcatacacctacatgcgctgcttagggactctgcatttttcttggtagaacttgaaatcttggtacatatatagatggcaaatcttttcctgtagaactgcaaatgttttttaattaaaattgatacccccatatatttcttgatcactgcctgcgaacctctgtaactattagattcagctataacatgggattctaagtagtgaataagctggttatatttgcatatttaaatccgatttttaggtgccatctatctatttgttgtagttctctacagaatcaaatgcaaaatctgaatgttcataaccactttataatttaggccagtttgaggttgcgtcattgtgtgccatgccgtcgagcacctacacacctgctctttttaggttgaatgtgctttgtgtttctatggttcatcctatgaaatgatttattctctgaaaagttattgttatgcatggactacttttgttccagcatgatgacccttcttgggggtggatcgacagcttgagtaaccatggctgtaaaagttcaagcggagaaagttgcatggtgaatcaaattatttttctttttctagcattcttatatttgccgtgtaaaatactggcatattcagtagatgtttattatgtgaaatgatggtgaattaagttttcttatgttactcagtgcacatcagccaataaaacctgacatgctcagatttttttccgagctggtataatgttgctttggatgttgggggtccctattgactttgcctggcaaacataaccctgacttgaaaatagtgaaaacattatttgtgacataactcaagttacttattcgggaaaactttattaaatgaaaatgtatgctctagactggattgggtttaagagtaggagtttaattaagtatgcaagaaatggtttatgtgctttcatgcaattatatttaagggacttacaatttcatagttgctgttgatttaaatccaaaaaacttcttgcctaggagacacaacttactcttttttgctgagccatttattttgcatcttcctagctctgttaaaattaccgtcctcatcggctaatgaaaaagcagattaatgtacattacagttgtgtttctatgtacaagaaggtgaaagattgttaaaatctatgtttttctcttcagtttgccttctactctaggtgatactttgaagtgttggtcaatagataagtggaatcttttttcaaaaaagagaaaaaatgcaatctaattataaatatgaatatcaaatatgataattgattttgtcttatctgtataaaaaggattggttgctgccatagaaggtgctcaagtttgtcaatactgtgggtgctggttagcttgatgctctgtcggccgtgcggcaccaccactgtttaacgattccagatctggtgatattggaaccatgtgttgtcgccttgcccagggtccatttgtagtttgcttctcatggtcacttttggtgagttaagccacaacccgttcctttctacactcacttatgtatgcttggcatgtatcttccatttcctgcctccagttccctcgctagctttgctttttcatacaccattattcccttacaaatgatagtctacctttttttttaatcaggaatgctacagtatttctgatttgtactgcatatctttttctttggttgtgt

SEQ ID NO: 32086 - DNA, 20250 bp, Oryza sativa
  unsure (1)..(20250): unsure at all n locations
gttcgctctgctccattacatattttaaggagatggtcaggagtcaggacagggtttggatggttgatggttttgcttcattgtgttttttaaggtgtcatctagctgtttgatataatgtcacagaatcaaatgcaaaatctgaagattcatgacatctttagatttcaggtcaatctaatctgaattaagactcaaattatagaacatagaaaatattctctttttgtttggattatgtttaataactgcataagttagaatcacaaatcagaacatggaaaattctctctgattttttttttcttgggcctatgtaccaaataccagatattgaagcagagattagtccgaaaaatgttctttgtaagctggtatgattgagggagcatctagaagtggattttagctgataattcagtggattgatgtaatcaaataggtttagtaggtgctgtacattgttaatgtgtttttgttctatatgctcctttcagcttaattgtgcattgtatttctatagctcttcatctgatatgatgtattttttcgaaaggtattgttatgcacgcagataagtcagacctttttagagagtaataagtgcaatcctattataaatgtcaaatccgatgactcctttttcttattcatgtaaaaaggattagttgccaccatatatgatgctaaggtatgtcaaaactgtaggggcatgtttcttcctaatatgtgaagtagatttttaactatcaagcaaccttgtggctgtgctttctcatgttatactatgctaagcagttgcattgcagtttaagatgtatcattttatacccaaatctttggaaatttgtgaacatgatgtcaatcttttccttttaaattaatataagggataagaggaagaaaccagggctggcagtcttttttttgtttaccaatttttccactatgtgcaagtgcaaaagcatttcattgtcttttcagagttcacgaaagaactgggctatctatttggtagcaggacaggaagtaggaacattctttacacctataactgtttagtaaggaaatttgagggtgcctctccctcatgagtgaacaccattatttccagtgaaaaggggtaaaaagtgatttaccattatacctaactctgccatntccacagtgtgctgcctgtaataatctccatgtcacattaaacatgcccgcgtgcacaccagtaaagtgtctactcaccttccaggattgctaggaacttaatttacgggcaatgaaaaccagaaacctggtgcatacaaattctgagtctccatgtgcgattgaagaatatttattttcttaagtgattgcaaacatagtcctttacattacaacttagttgtgattcatgccccgtaatggaactgaattaacctcttttaaaagaggatgaatgattaaactgtttttcaatacattattataccttttcttgctcttttgggtattataaataattgtggtttctgaacttattaggtattttttatctgacagtattcagggtctatttcaaatcatcatgtaacatcggaattcaagttatatcacagcctgtgctagaatgaagtcctttcgtactcaacatttaccaatataagtgcatacatatcctgacttgtgatactttttaccaataacaaacgggtagggcgccgcgaagcgcgcctaaagttctagtatatataacaagagagtgtgaagtttttattggattaatcgcttaacttcctatatgtattgaaagttcgataaattcatgttgattttggtttgagtttaggcatggaaagtatggggaattctagtgtcacatgcattgcttaattagctccagctttccaaacatcatgatcaatgtattgggatctcttttcttttgacgaaatggacacatcgacatatacatagaccaatgtatagtcctaaactcctaatgaagcatatgaatgcattcatgcataattaggcagggtcccatgtagctaattcagaagaggtgagaataagatgttgatttaggaagcttacggtgcttcaggacaaaaacttgatgttcattaacatcgtgcaatacctcgaggtgtacttcagagactggattactgccgatcgagctttttctggagcagtgatagccagtaaaagaaatataggttaacaaaatgggattatatatgccggccaaaagatcaaggtggactgggtgtcctaaatcttgatatcatgaatagatgtttgttgagcaaatggctattcaagcttcttaatggtgatggcctatggcaagaccttttgcgcaacaagtacttaaaaggtaaacccctctcccacatgtcacacaaaccaggaacatcctaattttgggctggcctaatgaaagtaaaagatcaaatttttcagtatggatcttttaaacctggtaatgggatggaaataagattttggaaagacacatggttgggcttgcaaccactcaaatatcaatatccttctctgtacaatgtggttcgaaacagacattctactttggcagaggttatgagcacaacaccgttgaatgtttcattccgacgatcaattataggaccaaagttagttgagtggaatgatttgatttctcgactagctaacataaccttgtcaaatgaaaaggattgctttatttggtcgctacataaaaatggcaatttttcggtcaaatccatgtataatgcgatcatcaattccaatgtaagaatccacaagaggatcttatgggaggtaaaggtaccactaaaaatcaaagtatttatgtggtttcttcaaaaaaagtaatcttggcgaaagataacctcataaagagaaaatggaggggaaacaagcaatgttgtttttgtaatacacaagagaccatccaacatattttctttgactgtcatgttgcacgttttgcttggcgatgtgtcttctttgccttcaatattccccctccccacaatgcaaaagatatttttggtaactagctaaggggagtgcctacacccacaaaaaaaatgattttatttggagctagtgctctatgttggtcaatttggcgttgccgtaatgatatgtttttaatcataaaaaaatgcctaacatcatgcaggttatcttcatgtgtttcaattggctccactcttgatgtatgatgcttttacaggaacaacaggatactatgcgcaatggtgctacacgcttggaattggtagccaaggaacttttattccagtttgcatggcgtagtacttacagaatttcatgatagaatctacatgattttaaaaaacatgattttagtagatcatattatcggcagaagttgggggttgtcccatctcgccttttttaacctcttttctattcacttctggactttttggatgtgtgcctacgggcagaggctggagatgtaacccatttccattatctaaaaaaattaacatcatgcaattcttcgactttgataatccaagtatatgagaaagtcactgatcattggaaaaacccaaatgagaagcaatgtccttagattacagaatgctctgttctgtaataatttctcttcgatttgctgagaaatagcctcatttcaaatgtaaattttctcatgcacggacacgatgggtaggttctgatcaacttccagagttccatgtaggaggaggggctaacttttctttttaatgctgtttctctctccatttgtttcggaaataataaaataatggtatcgttgtcctctagcaaattatcaagtttttagaatatccacgagccgtatcatattttttggatgtctagcagtaaagacaacaaacattaaacattaagtatcctatgataaattttgcctatctattaaccctcaaatcccccaaactccctcgtctctcgtctctatgatattttaggacatcccctatatcgatcctaggataaaccggtttcacactaatggggtttctcccaagtgatcgttcaacggcgtctgcccctatatggcgatgaatctccgggtgccaccacaggttgaaagaatgaaaggtgctccaatgtgtattggcatggaaccaattttcggtgtcaatagtatgtatatagaattttgcacatgcacaatttaacgtgttccattgaaatttacttagaaattgcttctaggtaggtgcatgcatatttgtttaatccctatcaagaggagatgttgcacgacatttcattgctccaacatttggtttggctggtcttgaaatgcaacaaaaatgttggacaagacaatgtactgtccacaactggcaggaccggccggctggccctatgtcctatggatccatgttactactactcccatcagcatgaagccatgaacagctagatcgatcaaggagggctgtagcatcatttgcactacgacgaattgagctctacattttcgaatggttctcgatggctcatcaaattcatttctttccatgctctgccttcccaagatgccaaagtgacttggagatcctcctaattaagactattgcatgcgtggtctgctactgtggttgcacgcaaaatggatagaattcgacctcacgttgctgttcagttcctagagcctccaattcccaagactcatcatcatgtatggaggcttttaggatatgaattttcactgagcttgtgatagttgaggtccttcatagtttcactctttctctccatatatgctgctacacagttcggccaaaaaaaattaataataggtaccagtatttatatatagagctttttgcatctttgaagttgtacaatgtgaccatgtgcagtaatttgtgacaagcgtatatcatcaccgcattgatttgtcaacaaatgtgacctaggtggcccactcggccactcatgatgggtcatgctgtacactctaaagaaaaaaggaaagttatgttttagaaccctacggtacgtcataccttccaaggggactgcacaatcagagctatgaccatcatcggctcacagcactgcactctcgcattcctgaaattccaaacgcatccattgcatgtctatgctcacattctgcctgcagtcaagtcatattatgcatcattacagatactgcatttgtgtataattggtaatactgagcaacgctaaatacgggtgtttatgttaacggttttatccgaagtgaaagactgaatttgtggtagcactgataaaatctctatttgggtagcactgataatatattattctagcttcatttttctttgtttttcggtttttatatcatgcataactggactaacttcatcaaatttggtgacacacgatttttgttatatttgtgatgaaaaaattaaagtaattatgccaaatacggaagtacaaaataaaggatcttcggttcttacatacatatcccgttgggccttcaggttacatgtgtaagtgaaaccatttcgatgtgatgaattattgcaggatcaaattaataatgaaaggggaagctagctagtgtgatggttgagctatatgggtacatgactcaaccccctaccaattgttaaaatctgaatgcccacacaaatcatggtactcgacagcagcattttccatgcaataaaaaataatttagtcatttttctaaaaagaataataataatttagtcctttactgtaattaatatcgcatatacgctataggattttcttacacgggacaatgagatatggcatatatattatattatatactagcaaaagtgcccgtgcgttgcaccgggtgattacagagtgtgtatattgaccaaaagtgttgtttggtttagcaaaagtgcccgtgcgttgcaccgggaagtttacagatcagaaaaatatgcaattaattaaaatacaaattcgctgaaatatttggtatttttaagtaggtatgtgtataattaaataaatttacaagtaaaattctccattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatactttcttataggtttgcttcgaaataaacatattcaatagaactataattgtaatgcttctgaaaaaatgagcactaaaaatgtacttattctctttttttcggctcgagggaccaacaatagacttatttccgacctatgccggtcggcccacggccttttgcgcatgcgcgggcgcacttttcctcccccaggccgcaacctgggcttgggccggaaaagaggcctcactctcgatccctcttgggccgatttcggcccggacgacaccagccgtccgatctctagggttttgatcggacgaccgagcgtcaatagtggggaaacaaaacccactccctctcagccgcggaaccctagcccatttccccccctcctatctcacttcgccgccctctcctccgcgcccccgagcggcggcggcgacgacggcgcccctcccccaccaccgatggcggcggcggcggcacccccaccacccacggcggcgtcggcggcatcctcccccaccaccggcggcggatctagcgggaggggaggcgccccgcgagcggcggcgacggcgacggcgcccctcctcccgcgagcggcggcggcagcaccctcccccaccaccggcggcggatctagcgggtggggaggcgccccgcgagcggcggcgacggcgcccctcctcccgcgagcggcggcggcggtggagtcctcccccaccaccgacggtggcggcggcgctctcccccaccaccggagagtgccctctgccgccgccgccggcggatctagcgggaggggaggcggcggcggcggtgctctcccctccaccggatccacagcgacggcgacggcggcggttcggcaacgacggcgacggcgacggcggcagcggcggcgacccccttcgatctaattttttgtttttatttggatatatgtgtgctggcggcgacccccttcgatctaattttttgtttttttgcaaagtgctataaggctgcatgtgattctttgttatgtgctatgattttttatactatgtatgtatatatgcacttgttctcctggtgatgctaaccgaatagaacttggtataattcaaaccaagtcctattcgcccaaacagaaacaaagtcctaatcagctcaaacgaaaacagatgggagtttgtttcctatttttgtggaatcggacatattcttttaccgcgttgatgaatcggattcgttccggttttttttcacccggtttttttgacggacgatggaagcacctcttattttttaagtagtagtagatatggtcttccttgagctataagtggtctagagcccaaaccggagtacataaagcgcctctaccaccagcattttatttttgtccggtctcggattcatgcttatggttagcatcccatatgtctcgagcaagagatatcttgggcttggcaagcatcgggaactaggcccgtccgtacggacgcacaagctgtgcgaccacgcagcattcctgaaaattaggacgggtctcttataccactgttttttttttcttgatcttcattgcctttcaaccacgttaggaatgctggcattaatctgatacacttcttttttttcatctagattctcctagcaaacaagcagatattcattcacaaccaacgacaattagagctatatcaaagaatctcatccacctacataggagtatatgtgtagtagcgtttctgctaagtagaagaagaactgttacaacaattcaattttctcttactaaatagaaaaatgaattcctatcgtctagaacacatgttcatattatcgtcacgaaatacacttctcagatgtagttataattaccatcaaccatctgtcagagttgagaaggaaacaacttggtttagccgattcagtgaacttggaagagtgaaaactgaaaaaaaaaggaatctatagatcctaaatatatcgaaagtagtagcttaaattcaaacacataattaatattttgcactacaacggtcacccacatctcaatcgggcggcaaacctcatcggtgtcagatatggcacccatcacggtgtaaaggtcactgattgggaagtcatctctatcaggcataaggccgtcaaggatgaacttatctttgtcggacctaaactgaagcccgtcaccgataggtttgacccagatgactagtcaaacaagagcccatcaccgatgacctaatcttaatcgggccacaattagtgcccgtcatgtacggatgaatacaatcccaatcggacctaaactaaagcccgtcatagatgactcaacccaatcgggctttaacttaaacccgtcacggatgaggtcattcccattggtcttaagttaaagcccgtcactgatgagtatttcccccgaaagaaaatttattctgtttttttggctagcctcagtcctttgctagctatgcccgctgcaaaatgacagaaacaaatatatttcacaatatcccatcatccccgttcatatacaatcattcacatacacatatgccattcacatatttaacacatccattcacatacacatccattattcacatatttcacacatccattattcgcatatttcacaataacatcttcaaatgctaagcatcaaaacctgcaaaaccgagttgtaaattagaacaaatttatatttagcattgtgagtatatacataaacataacaaatatatgcataaatatatacattagtgttacaaaaaaaatatcctactaattcacaaaaatttctaaccggcggaggaggaggtcgaggaagcgagcgtgctcggggaaggttgtcggcggtgggtgtgctcgaggcgtgctctaggacagcgggggatggcgtggaggaggtcggtggaggacggtgtcctactcggggactgcgtggaggaggtcggtagaggacggcgggctcggggacagcaggggacgtcaatgcggcggcgcaaggacggcgggggatgacgtggaggaggtcaacggtggctaacgcaggctcgaggatgcagccgggctcagtggacaatggcgtcgcactcccaaacggaggcgcagtggcggcaggctcccatagggcggtggtgctagggttcagagagtggcgggacttagaaaaattttcgatctagatctgagcgagagtgaaccctaatctaaatatgatcaagcattatctcaatcgggcttagtctagagcccgtcacggtgactcatcggtgacgggtctaatagttatctcaatccggcctcaagatggagcctgtcacggatgatggacatcggtgacagacctaatagttatctcaatcgggcctcaagttggagcccgtcacgaatgatggacatcggtgatgggcttctgttaaggcccacaaagatatcattggttctctatatcaggcctcaagttgggtcccgtcactaataggtgtcatccgtgacgggctctatgcacatctaacatgtttgtgcgagtaggcatctttttgccctgtttgagatgacttcgttgtgacgtcccacaaaacgcaagcatgtatggggtttgtactagagtaggggtctgtacaaataagaggaactgtactagtgttggggtctctaattttcaagagaatctattctataccactgagtttatttgagttcaacgatttaccatagacattgtctctttctataatataccggcgactttatcaattgttctacaatacgccattgggtcagaccttcttttcaaaaatacccaaaatacccttaggctgtgttcgcatgcaccttttcccatccccttcccttcgttttccgcgtgcacgcttttcaaactgctaaacggtgcattttttgtaaaaagtttctatacaaaagttgtttaaaaaaatcaaattaatccctttttgaaaaaaaaagctaatacttaattaatcacgcgttaatggactgctccgttttccgtacgcagaagttgggttcccatctcccccatccgaactcagccttagagacatataagattaacaattgatttatcccgttagaagtttcaaaaaaataagaaaatttttatgtggcctccttacacaacgtggaagttttatggaatttgtttttggtatatttagttttgtaaatataccaaaaaaatttacaaaattttcaaggttaacaattgatttatcccaaatcaaaaggtctaaaaaggtctatttagttttatgaaaatttagttttgtaaagatattaaatatactaaattttcatgttgtgtaaagaaggccacataaaagttttcatattatttgaaagttctaatatgataaatcaattgttaaccttgtatgtccatgagggtattttgggtatttttgaaaagaatacccaacccaatgacgtattttcgataaagtcgccggtaaattatagaaagagacaatgtcgatgtaaaatcgttgaacttgtacaaaatagaatagattatctcaaaatatattcatgtgatcatttccaaagtctggtaaataagagcggccagttcacatggaaatcgatcgtgtcctcggtttgccgacgagcttggggtcgccgtagaggacgacttgctcggaggaaaaagatggagaagaagaaggaagatttttttttttccattgctgccttctaccttcttctccattatcctctgcttcatacgctggtcctaggcatgacaaaataacactcaacctgattgagttcagtagttcctcatagaaaattattgactctagagatatggtaatatggagcaaacaaaattgttagaagcttgcacagaaccggaagcgccccttgtttcaaagagagagaaggataggttattcacatttaatttgatgctcataggcaaattaaaagctaagtagtggtaattaagactccaagggaaaataggatgtctcctacactacccataatatgtggaattatcgacgtaatttcatatagtcattcgatctgaatgatacatgaagaacataagccagatgatggaacgctgttatatatcagtacgtaacagtgtccctagctagcatcacagtttaaattgaagcgtataggggttttaatttgtttaagctcgaccaaatgggaccagcgtccaggaaaatcttttgtgtacttgcgtacttatatggacagtgattgttttttcgtcccattttcttcgttttctagaatgaatatattatagcttttacactataactatttggtttagtcccacaatgataattgagagtggaaaaaataaacttaaaagatgaaaacagttcacaccaataggactagttttttgaattgtgttagcttaggatccaagttgtggatctggttaggaatatggtgaagtagactcaatatgattttactggcttatggttgatagcactagtaaaaaaactcttataggtgccggttggaaaccggcaataggtgccggtttcctggccgacaccttttggtcagcaccaatgaccctatgtcactggtgccggttgtagaaccggcacctttgtgctctcccagatcaaaaaaaagaagaagccggctccaagccgagccgagccgatgcattccatcacaaatcacagatgcaattccccggttaacaacaacaattacatatgcaattccatccggtcaacaacaacaacaacaaaattcttcatagatcaacaacaacaatcacaagtcccgagtgaacaacaatccaatcaatcacaaatcacagatcaacaaaacaagcaaatacacgaactcactccgttgttgtcaatgcgccactgccaatcgcagccagggtcccttggccaccgccgctgccacctccatttcccttggccacggctgtcgccgcatgccgccaccgcacgtcaccgccccaaccagagagggagaggaggagggagaccggatctgcgcctggtcacctatggggaggccgcccaccacctaccttggccaccgtaccaccgccgccggacatcgccgccaccaacccaccaccccgacctccccctccccagatctggccgccttcgatgaagccaacggagagggagaggaagaggcgaccggatctgctcttcctcgtcacgggccgccgatccatgcgtcgctgcgagatggggacggagggggggagcggccggctggagagagagaaagcggagggagagggggactcggcaggtgctggagggggagggaaaggggagggcggcggaggagaaggcgtgggcgggagcgggaggaggaggaggggagggcggtggagaggagcgcgaggagtcgagacttctctcgcgcgcggataaggaagagaagcaagacctacgcgcggataagttcggagatgaggccggcttggcttgcccagttcggctcggtttggtatgggtgccgatttcttaattaaccggcacctgtaatatattattggtgttggttttttaattaaccggcacctataatatattatattataggtgccggttcttcttaaaaccggtacctataatattggtgccagcttttcctaatgaaccggcacctataatccttaaaggtgtcggttgtatattttttcaacgtgcggatatgggaaaagtctcataggtgccggttataaatgaaccggcacctataaggccggtccctatgagggtttttttagtagtgtaggccggactacgtattcaaacaagtgatgtcagagataatgttcaataatatagaataattttcatggatcacacccgataacaagtctctaggatcgttgcgtaagactctgggagttgggagttatatgggttgatgtgacggagaagaatattgagctcgatgtgtgacgggttgacctggataggtcatgatagcctacgccacgtcactgacagtaatgactgccacatgtgtattcatatgatggactgcacactactcgtggccaaaatgtgctgtacatagttggcaaggtgtacactagcagatcggccaccagcgaaaatcaattttcggtcgctggcggttgtgttataccggccgtcagcgaaaaacgattttcgctggcagttgcgttataccagtcgcaagcgaaagtagtgaccaggttaaaaaaaatgatggggcaacaccgctccattcgcctccatcaacaccgattcaaattattcccaaatccactcctcgattcacaaattcacaaaaatttacatcaacaatttacaataaaggcaatcaaaatttttcattcacattccacacaaatccacacaaatcaacagatattttccattcacaatccacataaatccacacaaatgcacacaaatccacagaaatccgagcaccactgcccgcggcccggcggcgtcagtcgtgacaaggtcgaggccgacggtcgcgctccaccgcccgaggccccgtggccgtgctccctgcgccgctgccggggtggatccgtgctccccgtgcgcgccgccgggcggatccttcctccccgcgtccgtcctccccgacggcagcctcctcccctcggacagatatggcggaggggagaggagacgatgggagggcgcggtgccgcctcttccttcgtggtcgccgtcgttgccgcttccgtcgtggtcgccgtcgtcgccgtcgccagtcaccgtgcacatccgtgccgcgccctcccgcccgtcgtggtcgccgtcgtcagtgccgcgcccctcccaggaggaggaggttgggggcgcaggaaaggaggaggggagagaggtgggggaggaggaggagagggaggtgggtgggtgggtgggtgggtggagaggaggagaggagagagaggcagtgggtgggtgggtgagggaaaatatctcagcatgcgcgtgattttaaatgacgtcatttttttagcgggctctgttttttcgctggtcgaactgtttagtaatcgccagtgaaaatgttggttttcgttggcggacacttaagaggtccgcatcgaaaaatagagtattttttatggcggacgtcttaacgtgggcgccagagaaaatcggttttcgctggtggtcctatacccccaacctctgcttatgtttttgctagtagttttagcatataaccgccagtgaaaattatagtgtgacgtcatgaaaaattatttttctagtagtgattattattgttaaagagctaaattttaagtttttttaaaggactagttaagcattgattgttatcgacagtgaatatttagcctcctttgctacggttaggtcttacgacttatcccctaacactctttcaacctcaaatcctggcttcgccacttggcatagctgattccctgaatattcttcgcaaaggaaaatttgcagcctccgcggcaatgaatttgatacagatagcagcacgatacgtgcatatatagattgaactgctaattgcctcgtgttatatgaccttgggtcctgaccgtcctcaaggtaaaagagaaggattttacacggtgtaaactaagtatggcaccaaattattcagctatatataacaagttaacacgtagattagtaagtgaaacaaaacatagatggcaaacacatcgtggccacactagggggtgatgactgacgcgactataaagtttatcgcattgagcacggacgatgtacggatgtcgtgggctcgatcgtggctagggcgatgatgcgagtctaaagttggtcgcactgagcagggacgaaggacagcttgctgttctgcagatcgtagagtacgtgcatgttctgctgctggaagttgcctaatatgatctcgccgccttcaataacagcaaggcagatgatgcggctactattacccgcgtcgtcgtcgtcgacaacctcgaacacgtagttctcctggggcaggcgcatcgtcgcgccctcaaagtgcagcgccatcgtcggcacgtccggcttcggcccccgcagcggcgcggagaagcaggtgaagggatccgtggcgttgccgggcaccacgggaagcttcacctgcgcggcgaactcttcgcggacggcccggtaggtgcgcggcggcagcgaagtgatggacgtgccggagttcgatgatcgcggcgtgctccggcaccggtagctgcctcttcgacgacccaacggtgatgcccttgagcgacaggtattataaggttggatggcgagagttgtgggttagaggggtggtctggacgacggcggcgccacgcccacggccgttgctgtagagattggcaggcaagccgagcaggacagcgctcgttttcgatccggttatggtggtgaagcagtgggagaagttccccaccttgagctgcgacggcagggacaagctcccgcggccgaagccagcgatgccggtctcgtttgaggtgaagacccctctgttcgcgtgcccacagccgaataccaggccaggcactgcagccgatgatccctcgccggcgccggacgcgaacgtgaagacctcgcggccgagctcgcctcgtgtcaccgagccgtcgccgtaggatatgctgtagttgcaggcccagctagtagcgtcgttgccgccgccgccgcagggaggagtagtctcgctctcgctaggcgaaggacgacgaagcggaggggtcgaagagaggaagggtctggttgaagcaagcggaggccgggcagcgcttgcactgggtccaggcgatgtcgctgcccgtgtcgagcgtcagctgcacctcctgccgcggcgtgccggcggccaggtgcaccaggtattccgtggtggggaagccatcgtcgtaggctcccgggttcacgggggcgctcgccgagcggccacggccggccgattgagcttgagcagagagtagatgagtggcccgggccttgctgcgctgcgccatgcggcgcagaagctcccagtgggtgagtccacggccggcgtccacatgcgagagctgcagcctcagatttgccgagtcacagttgtagatagtcattgcaagtagcatcaggacactcgcagcagcatgttgcatcgtgggtgtgggaggggaaaccattctaatccctcgaggggatgtttcctcgtttgctctaaaaccatctaaacggttatcaaaaattctgaaaaaatttgacaacattcatacaacacatatatacaacttcacaaaatcttaagttcaaactcaactcacatgtcgagatataaaaaggacaaattcagcgtatgaatagtagtgcactgtttatatctaaatttgtcttttttgtttctcgatgtgtagatcgaatttgaacatgaattttggtggactaataggtatcattatactctacattgtcaattgtttttagaatttttcacaactatttacatcgaatttgaaaaaaaaagatatacgaggggatatccccttgagggattagaatccactcccgtgtgggagtcatcctaatttcttcgggggtcttgtgtttgtcaatgcaaatatttccttcttgtttggacataaaactcatgtttttgagcatatacatatatagatgtcccgtggccctgccctgtgctgcatataactaaggctgtgttccagagggattgtcccagcacgcaaaatgaagcatctattattgtatgattaattaagtatttgttatttttttaaaaaaaatagattaatataattttttaaagcaacttccttattgaaaaaacacgccgtctagccatttgaaaagcgtacacgcgaaaaatgagggaaaagattagggaactataactcccgaacgcagcctaacagtattgccatattgccgctagcatctgcaaccagtgatcgatcgctgattaactctatgtcaacgttgacttagcatacataaacgttgcctcaggtgtccgcaaacgagattaggatagaaattaattaagggaaagatgagagggggtgtacttaattatatgatgatttacactatcatttactccctccatccaaaaaaaaaggtaaaccacgggtttgcgtgccaacatttgactctccgtcttatatgaaaattttttataattagtattttcattgttgttagatgataaaacatgatgaatactttatgcgtgacttatctttttaatttttttataatttttttaaataagacggatggtcaaacattggacacggaaactagggtttgtttttgttgggatggagggagtatgtggcactccttgtgctagctacgaagcctgtcatcgaggttaggcaatgtagtgtgtggtgcgagctagagaaccagatcggccggggcatgctgaatggacctttagtcctctagtacatctacgaggtatgcaggacaattgacatctatttatcatatctattatatactccctcctccgtcccacaatataaaagattttaagtttttgattataacgtttgaccactcgtcttatttaaatttttttttgcaaatataaaaaataaaaagttgtgtttaaagtactatagataataaaagtcacaaataaaataaataataattttaaaaaaattgaataagacgagaggtcaaacgttgcaaacaaaaaactaaaaatctcttatattatgggacagatggagtactaaaaatctattaaacttcctacatacgctcttaagccaccacgtggggctcctacaaacgctcctaagctgccatgtggctctttgataaatcggcaagccaccacgtaggactcctacaaacgtttctaagctgccacgtggctctctaataaatcggtagacccactatttttatctattagatttacttttagaaacccactatttttatctatgagatttatttttagaaaaaaaaatcccataatccacctccttcccctctcccccaccagcccaccctcctccctatgtacgtacgtacgaatccctccccctcctatccaattttctcatctctttatttcttttaagtttgttacaattaaaaataataattttgaataatttccgtaaaaagaaataatcataacctttaaattccacataagtctattttatcattcttcattaccgtattcatggtgcttaattaattaactcataagaaatatttattttttatcatatcctaaccttaggatgcaattgaagctgttaaaaaaatagaaaaaacgacaatgtatattatatgatcatgtatcactatataaaacatataaataaaataaatatgatacatatgaaaaaataaaaacactcaaatcatgagtaacattccaaaaaaaaattcatctattattttaaatcatatctgaacctttcgcatgccatcccaataataaaaaaatattgtgtagaacatagataatgtagatcatatcatcatatatcatttcacaatcatgcataattacattagctcggtaatatcacaaaataaaatataacaataagttctgattagcactccaaaaaaaaccatcattctaaaatattgatatgttaaaataatattatttttcacaaaacaaagtaatgttacttaaatatttcatgaaaatcttctgatatcatcataagtttaatatttaaaccaatctacaatatcccaaactataatactctaattatgattagcactaaaaatattatctccattttaaaatatgaattatgataataatgtaaatctagatatgtccagataaatattttgatataattatatctttaatgtttaaaggactaaatttgattaaatgaaccagactgatatgtcttaattaatttttataggaggtgtatatgttgatcttttcctcttgaatctttggagtttaagcttaagttaatctgagtatatagtatataaggcccagtgtacttgactcatacatgtcttgccttatgtgtcaattctatgttacacttaaacttttatatcaattctatatatgtactgctatccaccaatcattgagacaagaatattattatatactaaaataccattgaacatcatacaaacgctgctaagccgtcacatgacctaatatttttaaacattagattagatgtattaaagtaatccctccatattaatctcccgtacacgtaccatggaaaaataagtactattcatccaaaaaaaacctggaaaaacataggtacgcacgtatgattaaaaaatattaatctttccatcctaatccttaaatttaaaactaaaactttattatgtttgtacctacctatatatgatcagtccatcgagtcctctatgactcctttcacttttggtagtagaactcaactagcctacttactaatacatttttttaagtgtgtagacagtgagctaggtgttaaaattgtgattaacgttagtcttgaggggcatggctacatcgatgcgggaccatatttcaaggcattggagaataaagccttagcagctatggccaacttaacacatttgatgggtatttatatctaattttaatggttgtatcttattaattggtagaagtggcatttaaaaatatttatacatttagacacaagtgagacatgtgcacttcggtatgaaatggagatgccttttttattgtattaatgatatattaagtttgttttttaataagtaattctatctattaaaaaggcacctagctctttcaagagaacaataataaagtagttgtgataagggagtttatatataaccaggacatggtgatttatttttaatatgagagacattcttgtaatttaatttagtgtatcaaagtctatggtcaattttagggtaaagataagataatgtatggtttttaaataaaatatggtaatataacatcttttaacattcttttaatgaagaataaataaattacccgtgcatctgcgcgggcttcctccctagttattaaaaa

SEQ ID NO: 32087 - DNA, 9541 bp, Oryza sativa
cccctccccagggcgagcaatcgccaaacagcatttccggaccgagccagcgccgtgttgccttgcaccaatcccgcgcacgctcgcgccgagctcgtgccgccccgcgcgcgccacacgcccgcacacgctcgcacgaggacgaacgacgaacgaatgccgccgtgacacctccagctttttgttccgtatctccttcgttccttaactagaagactcaataccggaggcaaaagaagcgcaatttaaacctctttcacctcctcaaatccgcccctacccccgctggaaaattccccgaaaccctaatatcggcgccattgattgagctccaaaatttgtcgcatacatcgcaaatcctctgaaattgaaggtaaaaacggattctctatgccgagtactccctttcccctctcttcccccatctaatccgacgccggagtgccgccggcgccgcctcccggtgtcgccgctctgttcggccacagctccaggccgccccaggccgagctgccgccaccaccgcgctccccttgctctactgatgctcaccatagccatcaccctcaccgaagttcgctggaaccaccgcgaccatggccgctgccgcctcctgctccaggccgccgccgcctgcaccgccgccaaccacgggaacagagtcgctgcaccctgtagatcacaaaaccggcgcccctttgcccaaaaccggccatctccaccactggcgccatggagttgtcagccgttcctgtgcagagcgagagaagaaaagaaaaatccgatttttctgttgaaaaattaatcagaaaaatcctttttatcttcctatcaagttgaccatccgtttgacctcaaaatcaaaatctgagacctattctaaactcctagaattattccgaatccatgcgtgtcagtttcgttgcaattcaagcacccgttgtcgcgaccctaattttagccctagggttcgccgttcaccgaaattccaaaaattatttctttaaatccttttcacccattgttgcactttgtgatactattttcttttggttatctttgtttttctgttatttattgtggtgatgattgttgcgtaaatagaaaacgctgacgctggtccggtagtcggagcgagtgaaatctccgcgataggaggagacggtttgtacgactacatcaagcccgaaggttgcaagatatgcaccctcccttgaacaatctaatcccagtagttagagagttattttggtagcgtacttgtcctttggagtacgatagactgcatgaatccttttaaattaattatattactattattgcattatattttctgttgttattataaacaccttaatgagccttagagtctaacaaatttaggataaaatttgagaaacacttaaacaaactattaattatttagcatgctatcgatttagtatggatattatcattgcatatgaaaacatgcttatggaactatttatagctatatgctaagaattgttaacaccgcttgtgagcggatggtacacatgatagagttcatgtgtttggttttatggacctttttatggttgtgatggatatatggatatatctatggttatttcttatttaaaattgatataataatcaacccccttgtgtcaataagaatgacatagtttcgcccatccacacgatcgatttgtagaacctggtcgtatattgctccaattgattaaacttctgaaggcctttcggtgtactggccattagctttcaagtgtgtgaagcaaagtgaaatggttcatgtttatatgatttatatatgtgggctcgatgggccctgagagttcagaactaccctatgggtccatgaagttctgggctgcccatcgaataacgaacaatggtaagtggatgcagaggtaggttggtacacaccttggaccggatcactccgagcaacatcccgagcatcctttaacttactaggcagaagggagagatatatggagcaatattacaccttgttacttttcagcccggccagctgtgggtatcgtgtgggtaaagctgggcagacgctgcagagtcgttgagtattcgaatacgccgtgccacctcttacaaatgttcttatatactgcagacttacagttcataatagtattatatatatcctctgtatggtgcataaattcagatttttatgagccttcagatttttttttactctctcagcttctcatgcagattaactgttgtattccatgtgcagaaaaatttacaaggtctgctccccttgtccaacaactatttgcataaatttcccttgaaaaaaataggttctagccttctaggcataatttatagcaaattgaaatagatatttgctgcgtgttgaactttttagttgatgattgaatagtttctggaaaaggtaaaaacaaggagaaaaggaaatcccaatgttgctaatgaggcaatataaaaaaatgctatattgcaatctgctttgtgtaaaaactttttcaatcttcaatctaactgttattgtgcattattatcaaccaaatgaagagagggtgcaacctggaattccacgaggtagatattttacgtggcgatcatgtgaattaagaccttatgttcatgggctttcattggaaaatttgagtcattaatctgataagatttcgtcctagcctattcttctccaagcttagtaaattgggtttcacttatttataatttatcgtttaatttttagcctttgattaaatgtcttgtactgaatcacgtaattttaatgtgtaagttttgcaagaatctctccaacaccttaaatgatgttgtttggaaatcagatgatcttcaaagtcaacattcctagagtaacttgggagagtaggattgtgaactattagcataccattcttttgaatcaatattcctacttctagaggcgagaaaaggagaaagcatgtctattgcacttgtacatgtgaatgaccctgtaaattatgtttggtctccactcctgttgtatgtgttgctattatcttttagagaacctttctgaaagcttaagtgaagctgatcatgcaatgagttttatttgttagtaagttttatgtgtaaacagtatgttgcgaggaacaagtatacttattttttaagataatggatttatattaaacccggcctttacacctgtgaaagtaaacttattggtcagcatcattttcatttacactgtaaagttgttttcattctcagcaggaatttcatttctgtttatcaccgttgcctaatgaaacagtgcattttctgtttgtcactgttgtcttatgaaacatcaccgtaacgttagtacaggcatattactagtatttataattagtgtcaaaacattcgatgtgatagggacttaaagttttagtcccatctaaacagggtcttagctgcgtggatggtgtttcgggctttttgggcttgggaggcacaaggtttagaactatcagccggtgagggaaacacgaatttttttgagaattaatattatttttatggaaaattgcaaaagtagtggtcaaccggggaaaatcgcgaaagtaggtccctgtcgaacgggtgcagttcgatagggcgcctatcgaacggccagagcgcgactggcgaggagatcggaaggctgccgttcgacaggacctgtcgaacagccccgttcgacaggcagggctgtcgaactgcccctgttcgacaggatgtccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatgattcattcgaagggtatgctactgagtaattatctgaagaaatttatgaaatagtactgatagtactaagttaatcgtaaagtgtttctcaaatagtacggacagaacataaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgttgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggatgaccgtgagatgtgtgggccgcttcgtacccgcgacgtgaagaggatggaccactccgatccatgctggaacgtcggggtagtggtggtgatggccgtcggcccgacgtctgcaccacatctgccgcgctccgacaggagacacgacgtagtagtgcggcagcacgtgcacggaagttgcgaaggatgctcgccacgtcgtcaagcctgacgactggaggtcttgcctctagtctttgcagtagggtgtcggactccacgtgaacatgctcaacaaattccgcctgttccacaaataatcaaggcaattaaaattatttaaccagttacacatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcgataccaatgaaggtaagctccataataactcccatcgtctggaggtgtctgaagtgccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaatgtaggattaaacaactgtgatgtgaactaacctatgaagactatcagccaaaggacgaccatctctcggagggaagtccagatacatgcccaactgtttgagaaccctgtagacattgtgtggctcgacgtgcacgtccaccacgaggtgacaagtcgtcatccagagttgcatatctcgcgtgcaaagatctgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgaatttaacaaaaaatacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtaccgccgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagttatcagcagccccaacaaataagacacatcctgcagagtgggcaccatctctccaactgtgaggtggaaagtgtgggtctcaggcctccatctatccacaagagcactcagaagcgccgcgtcaatgtggattcgttcggaccttgcacgtgaaggctcgaccaaccgtgcaaacgtcaacaacccagctgctctcagcctacaacatgacagagcgcaagttattaatacatgaaaatataaacaccttgtattagtaaaaacaatattttttcacacaccttgaaacccaacgaggatcaatacgccaatattgatccggtcctcgcatctttagcacattgcagaaagttcctgtactaagacgtcgcgatcgatggttcctatcgatctccttgtctatcagctgcccatcatattgatcagccatacctgcagatcgaaaaccacattagtacaatgcacgtatggtaacagtacagtaaatgtatgcaacataattcaagtaacaaatttgcatgccatttcaatttaaaattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattacagacgcactaaacataaattgaaagataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccacaaagaatgcaagctttcttacgacgagaacgatctttcacttcagcttcatccataaggttcttgatcctgcgcgactggcgacgacccttagtatcaactaataaatttgagtcaggaacccaattggcttgccctggaggaggacgaatgaaatcgcacaaggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaagtcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaataacggggctatacttaacactgggtttgctaaggttcagactagccatggaataccttttacagagatatttctgtgtacccctcgtgatgccctccaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactataggttttttcctaacatcttccatgtgtgtagtggtcaaacgatccagttgatcccatatggcatcaaactttctttgttgattatgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccattaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtggatgaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaactctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggca

SEQ ID NO: 32088 - DNA, 42366 bp, Oryza sativa
  unsure (1)..(42366): unsure at all n locations
ttcgataattaccctattacaacttatactacattgtcgtgtactaatttacaactattagtaacaaacaactagtttaataatccaaataaaatataacacctttgtacctattttaacacataacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttatggattactaatgtataccttaacttcactgctagagggcgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaactcgcggcctgggtggacggggctttaaaccggcctgtcgaacgcccattgttcgacagggtcggtggagggccatgtcgaacgcccccggttcgacaggcctcgcggcgccgggtggtgggccctgtcgaactccctccgttcgacaggtgagcgtgtcgaacgccagccgttcgacagggttttgtcgactgcccgtcgttcgataggtgccctatcgaattgcacccgttcgacagggacctactttcgcgattttcccccgttggccactacttttgcgattttccataaaaataatattaattctcaaaaaaattcgggaaacactgctgtcttgctcctgagcatgtgtactaggtgacatagctgagacacgtacaaagaaattgaggcgatttatgtgtaggtgggtgttagctctatggttttgagattacagcggcaaagcatgaaacgtattgaagtttgtggtgaaaaaacagtataactagagaagtagatatggaatgaatggttcaaaatgaaccgttgcagagagcagacccaaaatccggatcctctgcgtcacagttgatcaatgcaatgaacggtactgtagatacagaaccatttggctaagagaaataagtatgttttgaagattaaatatgatgatattgttgtacaagtcattttagggaataccaaaaggatgagtagaagtaaatgttatctcactaatatcttagtctttaaccatgaatgcctaatataattcttagtacaatgaaaaatcgcatgattcaataagcggcgtataaaaaaaaagttcattggtatcataacatgcttagcagtgtcataatatgctaactatacttagaaaaaaattacgaatatacttattttttcaataatttacgtttatatacatgcataggaaggaattgcaaaaatttacctgtcccgcgatggtcccgcagctccaaaatacgggaccgacagtcccgcgggacagtcgcgtggctccgcgatagtcccgtagctccaaaatacaggaccgtgatagtgagcaattttacattgtttttagtactgtttgacattgttcacgcatcggtcccgctgttccattgtgcggaacgaatcgtggatagtgtcgaacagtgccaaaacagtgacccaaatagtggtgaacagtaccaacacagtaaaaaatcgctagctacgtcagtgctgcgttctggagccgtgggaccacgacgatcccgcgttttagagtggagctacggactggcacggtcccgcgtttccacccctcggaccattgtgtaagttcttggagtcgtatgggttgatgtgatggagaagaatatttagtccgatgtgtgataaactgagccacgtcactgacagtaacgactgccacctgcgtattcatgtggtgaatgactgcacactactcgtggccaaaatgtgatgtagttggcaaggtgtaaatagcttgactataaaatccgatggctcttccgcttccctagcctgaagtgataaattatgcatagttgattccctttctcaattttacctgcgtggatggtgtatggggctttttgggcttgggaggcagaaggattagaactatcagatattgagggaaatgccgttcttggtcctgagcatgtgtactaggtgacatagctgagacgtgtactgagaagaaactgtggcggtttatgtgtacgtggctgttagttctatggttttgagattacagcgacgaagcgcgacacgtattgaagttggtggtggaaaaacagtgtaaggtggtgtttggatacaggtgtccactaatttaaaagtattaaatataaactatttacaaaactaattatataaatgaaagctaatttacgagacaaactttttaagcctaattagtttactgtaacatcacataggctaattatggattaattaggctcactagattcatctcgcgaattagtccaaaattatgaatagattttattatagtctacgtttaatatttataaaagttttagtcccatataaatagggtctactatagaattagagatcagatgaattgttcaaaatgaactgttgcagagagcagacccgaaagcccgatcctctgcatattagtgcagaggttcactatccatgtgagtattacagtagaccaacgcaatgaacaatgttaatttactgtagatacagaaccattaacactctgtcgcactatttttttgatcgggtggctgccaactcacctaatgtatggtactcctaacatatatactagtgttatctgactaatatcttagtctttaatcatgaatgcctaatatacttcttagtacgatgaaaaatcgtatgattcagttatgtaatgaagcaaaattatttttttatcgacattctccaaaatgtacggtgtccttgtgcctttagctcggtgactaaaattcttggatacaaccctatgattatagtacttgcgtaattaaagacaagctagtttgatatatttgttcttattatgatattaatatcatcagatatattttctctactagcataatgcacatacgttacaacggattttttaaattaaaaatagcccattatatataattttattaaagtcttaaaaatatgttatctacttagggtttgtttgtttgagatgtggcttttggaaaagtagctatgagttgtgggcctgtggctttataaaagcaacggtggaatatggtccctgccttttgaaaaagctcgtttggtttaacaactgtagcttttgaaataactagtcctgctgacaaacgggcctcacatgtcatacacacgttgaaaaaaacgagaagaggaagagatggagatggccatcgccatcgccgttggcctcggcggcagcagcggggaggcagacgtgcgcggtggagtcggtgcggctggagcagcggcggccaccatgcctgacgggcgaagggggcggtggccccgggagaaggaggcagtggtgttgccaccgccgttgaccacctcacctctctcgtctcccacctccacggccgacgggcgaaggggcggcggcaccgggagaggagggcatcagccggagatggcggtggcggattggagggggaaacgcggcagtggcggcagaccgacgagcggcctcggtgagatcgtctcgctacgcgtggcctcggcgggatcctctccccatgggtagcgtcagcgggagaggagggggcatcggccggtgacggcggtggcaaattagaggggggaaacgcggcgatagcagcaggctgggaagatcctctccccgtgggtggcggcggtgggggaggaactcgccgccttgccgggagctcgcctcgcctagtgaggccacagccgcgtgtgttggaggagctacccaaaagcagctcaaagcaggagatagaggtgctttcaatttgtactagagcaaaagcagtttttgggtagaagcagctatggcttttgagctttttggttggtttttgcttttgtaaaagcaaaaatgggttcaaaagcccgccctaaagcacccttatattaccatgctgctaattttgttgtaaacaaagttttatccttttttatgatttcaacatgatagttgggtagtgatggtccactagcatcttttttttttttggcaattgtaaatttaccacggttttgaatcgttattgcgaaactaccactaaaaaattgcaaaaataccactggaactatcattcgagtagcatccttacaaaattaaaaaaaaacagtggtaaatttgtaaatgccctttttttattgatagtataggtaagacacgttcaaatatgatactaatgtaatatgtagttactgctggtactgtcttacaatatcttaattttattgatagagagagatttacggatgtgtgttcttttgatcacttttctaactcctataactcgttttctataggcacattttctaaattgttaaacaatatatttttctttaaaaaaatatagaaaagttgcttttaacattcatgttaatattttaaactttttagttaatacttattaataattaacatgtgttaattcattgcttcgtttaacgcagctttgtgaatttccatgaaacaaaagccaagaatggaacactgaaaataaaatttcccacgaaaaaaagaaaaagcccaaaacccctttttcctcctatcctgtctctcatctcaaaccccacacattccccacaatccgctcgccatggcgaccaccgcctcctcctcctcctccctctccttcctctcgccgcaacccatccacccccgccgcgtccgcctccccaatcccccgccctccaccgccgcgccgcccactccgacggccgtacgctgcacgcccgcgcccgcggcggcgccgtcggcggcgtctgcggcgtccgcgaggtcaatcccgccgccgaagctggtgcggtgcccggcgctggaccgccaggcggcgcgcgccaaccgcctccgcttcgcccgcaagctcctcgtcctgctcctctccaagccgcgccgcttcctcccgctccgcgtgctccgccgctgccaccgctacctcggcctcccgccgcaccgccgccgccgcccgctggtcccgttcgtgctccggtacccggcgctgttccgcctcttccaggcgcccacgtcgcacccgctctcgcccaacctctccaccctcgccgtcgcgctcacccccgccgcggaggcgctcgccgccgacctcgccgcgctccgtggctcctccgagctcgcgccacgcctcgccgccaagatgcaccgcctcctccttctggcacccgggcggagcctcctcgtgtccaagattgctcacctcgcacccgatctcggcctcgccatggacttccgcgccacgctctgcccgcagcaccccgacctcttcaccttcgtgaacacctcccacggccacgcactccagctagtcgatcccccgccgccaccgcctccgccgctcccgcctttccgccccgcggcgccatccgaccgcctcattgaccggccacgaaggttcccccacctcaagctccggcgagggctcaacctccgccgcgcgcaccgggattacctcttgcggttccatagcctgcccgaggtgtcgccattcgagccactcgatgagggcgcaagcttggagatgatggagcgacgggcgtgcgcggttgtccgggaggtcctggccatgactgtggagaagagaacactggtggatcatctcacacatttcaggcgtgatttcgggctaccgaaccggctgcgcgcaatgctagttcggcacccagagttgttctatgttagtgtcaaggggttgcggcactcggtgttccttgtcgaggcgttcgacgatgacggtaggctacttgtggaggatgatatgcttgttgcgagggatcggcttgaggagcttgtccgcgaggggaagcggatgaggcgggctaagaagaagggccttcttgctcttgcggatgacagtgatgaagatgatgaagaggaggatggggaagaacaggattcggtacaggtcgatggtgaatcttgggacttgttagaggatggtggcattggcgaggactgggaggaggtgggtgatcttggtgaggggagcgatgacgatgctgatgctgaattggatgcgttggaggagttttgggtgaagaaagctgtggccgaggggttggttgacactgggagcgagcttgatgcttggtgaagcggacaatggcaatctgatgatctggtttatgagcattcagccctgcacgtttctgaagattttgctgactaagaattgctcaagtgcattcttcctagcgatgtacagaagctagaaaccattagcacataaccttttcttatctgctgtaattctctctcttacaaaataaaggtgtgttcttcctaaccttggttccagtggagttatgcaatatgcatttacaatttctatttgtctatttgcatgaaaatggatacgcctgtaaattataggatgaattgaaagactaattctgtgatctgaaacataattacatagctctgatgcttgaacacggaatagtcgatgaatcgaactgaccttgctaattgctgtactgaagtagttaatattattactagctgccatatgtggagattctagatgctgaactcagatgattactacctgcaatcttacactggtcatggttgtaacttgcgattttcaacctttatctgtgctatgtataaaagccttatctagttgtttttactggtaacctggacacctggtaggaaagctgtttttctcaagaagaataatgagcgtgtgaactaatttgttgagttctttccatcctagtataatcctagctttaactgtcaattgttgtatgtcgagatttctgcgacatactttactaaaattaatttaattattatggtgaacacgagatattttgttgaaaagaacagatcatcaaatgtgtcatcatgttggttctttagaccattccgtatccaataaaccaatgtactgcaattatttgcatatgttctatgttatggtgccatttatttcaaaagtacgagtgttgtgtttatttacatgttttaaactgcttgaaccgattggtcatgttggttgcatctgatataatatgtaaatgtagatagagagggtttacacataccctttttttgtatcattcttttgctgcacctgttgtgattttgcagaatttctgttcatcgagatcgtgctggatcaggctcaaaccagggatttctacgttttctataatcaccaagttcatccgctcttaaatttctgtaagttcgtagttttaggagtggtgctatacacttgcacaacacagtaggtcgtccatttttctgctcgaaatgaagggttggttttctgcagttcatccagtggcattcctgtttcgtgtcaggttgttcactcacttgccggggcttatgttcttaaactagttgataccccgcatattgcagcgggtattgctaaaataactttgtatatatgcaaggcagaaaattgtgtgcttcaataaaataatttggtatcggtttcaggtgagcaaagacaacaaaatatgagctacagaaggtcagagaatgttttgtaatataacatatgtgattactgcagctatatttcgtccaacagtatgcattactgcacacactcaattctcatcaaatatgtagctattggaagcacatgcttatgtttttccaaatattcacagatggatcatacggttaccattaaatcagcgaaaaagaaccatatccttctcatggtgctatctgcaagggagtaactttagtagctagttttcttttcatgcggaatccatgctgtaagttgtgaataatagcgggaaaataaaattaccatgctaaacctgacacttaaatctgaactgctgttgtaaacaatagttgtggtcatttttttttatttgcctagcaaagatgtaatgatataaacaaagcacggtcaaatgtagtattttatccaaaggctccaagcccacaggtaccaacatatatatatttaagcaactcgattccgcaatgcatcgatcatttgacaaattacagattgcaaatattgcaaaatcccatacatatataaacttgtaaagcaagtggcaactacagattgcagcaactcatgatgctgcattgtagtattggcaacattattattatagtattggacatggaactagtacacatagcaggcatgatcagcttacacgaagaacggctcgatacatgaagataaaagagcatgagaaattgcagaacaggaaacaaccgtaattggctctacataggaagaagcacatcggaagacacctcacttggttgttccagtaaaagggtaattaaccacaaaatagatgaaatactggaaggagtgctgtggcctgtggatgctgccgccgcatgatgaagaaaatccatcggaaagttactcgcccaaagaagagaatccatcggaagtatttacgagttaataatcaatcagcctcagtcgaagaaaattatggagttctttctcctcctttgtcagcaggtccctttcaaagggctgttgtacttggtgaagaagctccgggcactccgatatgctcacgtaacgaaacgatgaaagagcgtgcgctcctccgatggatgatagcttcaaacatttcttgagatgcaggtattggacctgaaagtttgtgccgatcggaatggactccatgttattacatccaaccaaatgcagggcggtgagagatgttagagcccgtaggcaggttggaaatgacctatcaagctcaccgcaattcacaatagaaagtcattggagtgaggatggcaaaaccatttcttgtgggcacacctcgttgcaatacgagattctcaggtcttgtaggcgatcaaatcccacgaaactaggtaatactagacgaaggcatcgcccgatcgcaatgaacttgatggatggtagataatccggagacaagaactgatcaagattccgcagcccgttacagttgataaggcgtacactagtgaggcctctaaagcatacaatgccattactgctgcttggatgctgcatcctgtcacaatcagttgaaccagatggcgtatcgtcagcaaaaactgttagttcttcaatcggtactcgtgccagtaatagatgttccagagaaggtaatgacggaatcgatagacttttcaagcagtgacacctgacaagctccagggaccttatagtcggtaggctttctggtttaaactaactagaacaaaagctgtcacccctaaagttttcgactttaaggcattcaattcttcgtggaggacacaagccttcgagcactccattctcactgctcatcacattgtatccgtcactatctcgccaccatagatctagtgtcttgagatattgcttgtcaacaagtctagcctcagaagcctcttccttgctcttaacattacaaatagatttgatagttagcgttccactgagcttatccatgtccttcagctcaccaattttccgcccattccttggtgcaactgtaaaatattttaagtttcgtagacgagagagatttccaagcctagtcaatactgataatttcagagcgcaatttgttggcagtgctaaacgacgcaagttgattagctttgtgacatccggactaattgctctcaaactcgaacgccttgcatcaaccacttgtaagctgtaaaggcgccagaatttctccggcaattcctttacacagctatgagatatatcgagataacggaggctgtgcaactcacctatgctctcaggtagcttgacaagtttgcaaccctgtaggctcataaataggatgttggagagctgattaaaccaggtaatctcgaccttgaggttgatccctaacctaagtgaatgaagtttattcaaatactgaatgtctcttagttcactcttcaaggattcatctgcaacctgaaccgacatatggcgaactgcatgtagctttctgccctcgttccgagagctcaaatcttgcagcaagaggcattcgttcacagaaacagactgcgccatatcatggatcaagtcatgcatgacatatctactttcatccgggtacttgggatcgatttgcaaaagaaacctgctcctcaaatcatccaaatacctaatcccaatatcttcaggacgcgtcctctctccggatacaagtttcacaaggctctctgccacccaaatgtcaacgatctcatctcattcaaagctataatcttttggaaacatggagcagaatgcaaagcatctcttaagttctcgtgggagatataagtagctcagttgaagggccggcaatatctcattctcttgatgtggcagctcccacaattcacttttctgaatagtctcccaatgtcgcacggttagctccatattcaacaagcgtccgagagttttggcagccaaaggagatccgcataaccgagaagcaatgctctgaccaattttatgcaaattattacattccgaatcagctgggcgcttctgcccaaatgcacagtccttgaagaaattccaaaatttatcttcatccaatcctttgagttcaaaaggttcaaagttgttggtgcaaacaagattagcaacattttgtaatcttgtagttactaagatcatactgcctttaagtccgtccttcaagagtgcattaagttcttcccattcacgattagtaatggaccaaatatcatccaacaccaaaaggaacttttgactctttagcttcttcttcaattcctcctgaagatcatttgaactatgttgtgatgagtctttcttggtgatggacttgaagatctcttctattatccttttcttgtcaaagaggtctgaaacacagacccatgtcctcatgcgaaagtgagatctcaccctctcgtcattatagatgtactgagccaaggtagtcttccccaccccaccaataccaaatataggcaagatagaaacattgccgatgcatttggattgagaaattctgggtccagccctgctactctctcctttcagtcgcttcggtgtggatgctgatttggcgacagtgccccctgctgctctctttcctttagctcgtgctgcaacaaacctggtgagtggcacacccatcttctcaatcactaaatctcgttcattgtcacgtccaatcatcacacctagcttctcaatcactagatctcgttcttcatcatgaccaaacacttgaggcacgccaatgactgaacttgtcactggcatgtgttgaactatctcaaaattaagacccactgaattaagctctccctctaaatcagccacagccttgttgagcttatcttggacctcctttatccttgtcttgctaccaccgatcaaagtttgtacaacatttagagaggaagagaaaaattgacctgccaagctccggtcagcatcctccatcttctgccatagcacctgatcattggactcgcggagaagatcctccgcgtcataggtggcgtccttgagatgccagagaagtgccgccagatccttgttcttgaacctgccccactcgccccgatagatgacagcgcgagccttgtccaaagagaccgggaggcaggatagatccttctccagcttgctcgcttccccaaagttgatcatggttgagaccgcttcgcggatgttgatcacgctttgcagcatctccataactgccgcgcgcagcagtccttgctccctctggatcttggcctagacttgtgatctgattgagcgatcgacagtactgcagggagactatgcggtgggtggaaactggaaagtgagcacgatacagaagctgagatgttaagtcttgactatagtcccctctagttcaggactcaagagagagagagagatgctccttcccaaattccaataagccttcacatgactcatacgtcttttgatcaacgttctgtttatctaatacttcagcccactgtctttttctgtcttcaaataagaaaaactctactttgcacttgaagattccatctgtccgatctcctagttcagtgctttattagttgtaatgtaaaaagctgctacatctgtttttattagttgtactagttcagtgctttggctcttactctgtacaccttttgtaaaaaaaaaatcttctattgatgaatatagacaaatgcctatttatgtccatcctcagaagttgatattttataagacggagggagtaaaacacttaggagtatctttctccatccccctttgttaattgatttgctagaactctcgtcttcctatagaaaagaagaaagatttcatttgcccgtgtaaatataagtgcacaacccacgagagaagaatatcttcctgtaatcctaactggaaccatttgttcaagtattttttaaaaacaatttaagtcttaacgcattcttaattctaaatcccaagttttagagtttacaaaaaacaacaaacaaaaataatcatataaccaatatatatctctacgccatccaattctcaatgcattacacatatatacaaaatagtatgtggtatttttacggcgctgctatacatacgattcttttttacgattgttgtacggtaaaacgcttctttccagcggttgttaacgatgaaatggattcctcttccactattgagcccatatccaaagctcaagttcatgatgatgtcttggcctgctatatcataaccctttttttttgataaatttgtccttttcaaaaacttatttcgaaagtagtcccaacaaaaaacttcaaccaaaaataagccatcggctcagcgccagagaagttggcaccgagttcctacatgaccgtgccacacgtgttggcgctgaacccctgctaacgtggcggccgagccaatccccttcgacgtggcagggttctcagcgccaaggcggttggcactgagacggctaacctcgccaaacgcatttgcgttgagcctgcagcctatagatcgcggccgagccgcccaggcccggcactcccttctttttatcctcgcggctagggttcatccacgtcgccctctctgctcccctccgaatatctcctcaaatatccctcaaatcgaaggctattttgtacgcattgcgttggagattgatttgtaaggtaaattccctccaaaaaccctaatttccccaatgttttcatcatttttgtagagtattttggttgaaaccgtacgttattgaatgtggctcgggttgtggtgtgaattagggaatatgggtaagaatgcaatgttgtagttgtatattgatgttcgtatagaggatacatattgtttttgcaagttatacactattttgctaagggtgaacttgggagggatgtatagtgccgttgtattgtgaatattttggggattcatactgatttatgatgatgttgataggtatagatcctaggaacattgtcaccggggggaacggctcagccgccacgctggcagggtgttagcgccaaggtggttggcgctgagtcggctaaccttagcgccttcggcccgtgcaccagatctgagagagggagaggggtggtggcggcgggggaaggggaggagggaggagcgggggagaaagacctggatccgccgcctctcaccttcccgtcgcccgagtggtcgcgccactggatccgccgcccgtcacccgagccgccgcgccactagattcggctaccgcccgtcgcccgagccaccgcgccacctgatccgaccaccgcccgtcgcccgagccgccgcagctcccgatcgaggcctaggcggcggatgagcgagagaggaggcggtgggagaggagtcggagagaggaggctgtaggagagagtcagagagagagaggagggaggcggtgggagagagacgcgtgaactttaatggcgagaggtgggccgtgggcggtggactttaaaagcagcggtactctgtaccatccgccagtaaaaatgtgattttcgttggcagtgtattgagtgggctgctagcaaaaatggctacatctttactggcggcccgcttagctcggctgccagcgaagatttgttttcgctggcaatccgtagccctccacccctcgttacatttttgctgacagttttcgtatttttctcgccagtaaaaatcatagggcaacgccatgaaaaatcttttttctattagtgtgtgctcccgttaggtacccagtgccttctccgtcatttacgtttgctcgtatcaagatcgtaagcgaaagtcgtacgtgtagcactttccatagacaaaaaaagccgtgtgttatgcaagagtaactctgggtctagtgaaacatgctgtctcaaaatcaagggctccccgaaccaaagaagagacgcnggaatcaaaggcgacccgaccaaacaagaaaactcaggntcggggtcgaaggcgcccganaaaaacaaacnacccagncaacgcttatatggtccgcctggaagatcaatcttcgcaggcgacgcttatatggtccgcctggaagatcaatcttcgcaggcgccgcttatatggcctgcctgaaaagatgcccctatatagtcttcttcctccccgagccctgttcattctccccgaagtttctctctcctaaagtgacctaaatataggggggaggttttgaacttcaattcttcgggggatttttctacggtacttagatctactcattttcacactaggtatgcaattttttaagcttttataccttaatttgtgatggatttatgcatgcaaaattgtgaaggaagagctccatgttttttaattttatttcttttgatatgttgatgttagatgtatgtacaatacttgatgcctcttgttgtagtggtttaatgtggtaacataaattctcaattttttttatttttgctatcacatccacctcctagttctagatctagatctagatcttgtcatatatagagagagaataaaattttaaatgtctatttattcggtgaaatcaaaaaatagttatagtattttgtaatatggcgatgatatgattttgttagattttcctaatgtactaatttggcatgtctgtgtaaaaaaaattgaaataaactttgattttttattaatttacacttaacttttagttaattagttgggaatagctgataagttttttcaataaaccctacaaatttggtattaattgtgcaaatattttacgtgtattcttttagagatacggaaagtcgggaatggatgtatcattggccgagatttttgtctccatatagaaacgaagtgtctaaatttattggtattgccaaggcacacgctgagaagaacaatatgaggaagataattggtccatgtgctgactgtaagaatgaaatagcctgggactttgacgatgcttttaaagtgaaggagcacttagtaactcgtagatttatggacaagtacgaaatatggacacgtcatggcgaagaacaagtggacgggcctgaaaatgtagttccgacacaagttgaagacatggtgcatgacgatggttctgttgaggacaaaatcgacctagaggaaatgttacgtcatgcagaacccgaggtgctgatggggtcggctagagggttaaataactttgaagctttacagaaggcagcaaaggaagttttgtacgatgagtcgaagggctgtgacagtgagatcacaacactccggtcagttcttgaacttatgaggttaaaggcgagacatggatggtctgataccagtttcgacagtctgttagaacttctgcagaaaatgctcccgaggcctaactctctaccatccagcacatatcaagcaaagaaactcatatgccccctttcacttggtgtggaaaagattcatgcgtgcgtaaatcactgcatactgtacaggaaagattacgcttctttagatgaatgtccaacatgcggtgcaagccggtacaagtcgaatagcaatactggcctagaaccctctgaagcaactgagggacgacagagaaaaatcccgcagcttgtgatgtggtaccttcctgtcaaagactgcattaaacggatatactcaaacccgcgagatgcggaactaatgtgctggcatgaagaagggcgcaagaaggatgggatgattcgacacccggcaaatgctcgtaagtggataaactttgatgctcagtatagaaagtttgctaaagacccacggaacattagatttgccctgagtactgatggagttaatcctttttgagacatgagcagctcacatagtacttggccagtgcttttcaccatgtataatcttcctacctggctttgtcaaaagcgaaaatacgtactactatgtatcctcatacagggaccccgttagcctggtattgatattgacataattcttgaaccattgttggaagatatggctgatttatggaaagagggattgaaagtgtgggacgagtacttaagggaatacttcacagtgaaggccatcatcttcgtgaccattaacgattatccagcaatgttttcagtttcaggtcaaattaaaggtaaaataggatgtgtgatctgcttgaatggaacgtactataggtatctcccgggttccaacaagcttgtgtacatgcggcaccggtggttcctacgcacaaatcacaagtaccgcaagatgaaggcggagttcgatggtactgaagagactgatcctgcaccaaaacctacatcgggagaaaaggtgtgtgcaatgacagagaaaattgtttgcgagtttggaaaaatgactaagaaaccatcaaaggggacaaagcgcaagaaacccgagaagaatacgaagggaggggatagtaagaagcaagatgatagttcgaagccagatgataaactccctcccccattcaagaagcattccatattttttaagtacctcccgtactggaaagatctggtggttcggcatgccatagacgtcatgcatctagagaagaatgtgtttgacaacatagttggaacattgttggacatgccgaagaagactaaatatggtctgcaatcaaggatggacctagtcgagatgagaatcagggaagagttacaccctcaagaaggagaaaagaatggcaaagtatatcttccaccagcatgtttcacactgacacctgaggagaagaagtcattttgcaactcactccgtgatgtcagagtgcccataggtttctcatcaaacatcagtcgactagtttcaatgaaagatttgtcggtatctggttataattcacacgactgccatgtcttgctcaccgtgtttcttgcaattgcaataagggccataaaaccggagcatttaaaggttgctatcacaaggttgtgctactttttcaacacagtgtcacagaaggtcattagtctcgaagagttaggaaatctacgtacattcgcacatgagacacggtgccaacttgagatgtgtttccctccgtcattttttgatatgatggagcacctcattgttcacatagtgccgcagatggttgcgcttggcccattgtacctccatcaaatgtggtcatacgagcgttacatggcggttctgaagagttacgtctgaaatcgtgcaaatccagagggatcaatggttgagggttatagtactgaagaggttgtcgagtgctgtatcgattacctcaaagatgaatatgcaattggagtacctgtgccccgacacgagggcaggttgagtggcaggggaacgataggaaagaagagattcgtcacccatgatcacaaatcattccaagaagctcacttcagcgtgcttcatcagtttgctatcgttgagccgtacatcgatcaacatatcgaactaatacaagctaacaataaaggtcgcaccaccgagtggataatgaaagaacacaagcgtctcttcatagattggttgcgagacctagacttacctgagggacaaactaccaatgaaataactatgaagcagttggcttgtggtccatcaactacagtaaattcttggcagggatatgacattaatggatactagtttagcacaagagcccgagataataagacttgtacgcaaaacagcggtgtccgtgtggaggcaattgatgaagccggggagaaacaatcatatttcgggtttattgaagaaatatgggaaatcgactatgggcacacaatgcaattccccatatttaagtgccaatgggtaaaatacccgaacggggtcaatgttgataaattcggtcttactgttgttgacctgacgagtgtgggtcacaaggatgacccttggggactcgccaattgcgtggcacaagtgttttatgtgaaagacccttcaaatttgaagatatagtgctaccagggaaacaaaagatattgggagtggatggggttgaagatgtcgaagattacaaccaatacgatagtatgccactttatatgtcagtttgtacagaagattaagaatgtcgagacatctactcagaagaccgtgaagccttacatgcgcacgaacggtgtgggcaaaaatgttaaagggtaatgattgttgagtggcatgtaagaatctaagaagttagtagttatgtaatgatggtatgtaaggtgatgtgtgatcatatcgcaaattgacgaacaattgtactcaacattttgcatattaattagtttgtactaatttttatgtgtaattaccatttgtagtgtaaaaaatttgttaaaaaatttaaattagtaatatttgaaaagtgtaattatttttatgtgcaattaccatttttaccatttgtagtgtaaaaaatttgttaaaaaatttaaattagtaatatgtttatgtgcaattaccatttatacatttgaaaagtaataatactaaggtttgtatattttgtaataatattaaggtttgtatattttggaataaatatattcaactctgtaccaattttcgcaggcgggcggtccgcctgcgaaaattgttatatagagtagggtttacatcttcgcagtcagacggcccgcgtgcgaagatgatcttcgcaggcagaccgcccgcctgcgaagatcgttgccctatataagggcaagcccgcggcgccaaaatttctaaatccaggcgggaaccctagaaattttggcgccatcaggctactgaattttttcgccgccgcacacctccgccgtcctccgccgccgcccacctgcgaccttcactctccgaccgtcgtcctccatcgccgccgaccgtcgtcgtccacgcgctgttaccgagaccgccgcccctagccgccgctccaccgcgcgcgagctccaccactctgccgccgccgccgcggacccctccaccgcgcgcccgctccaccaccgccggctcctccaccaccaccggcccctccaccacgcacgcggctgctgctggcccctcaaccaccgccggccccttcaccgcgccgtcagccgcccctccaccgccgccggccgccacctctctctctatctcgctcgcgaccgaacggcttcatcggccgatcgtcgtccacgagcgaagacgtcctcggccgaacgacgtcttcggccggtcgtcgtccacggccaaacctcgtcgccggcccttccttcgtcgtccacgaccgaagctcgtcatcggctgttcgtcgaacacggacgtgtgtgcatgtgggtgtttctttttatatgtgtgtgcatgtgggtgtgagggggtatatatgtgtgtgcatgtgggtgtgaatgggcatgaggggtgggtgatatttgaatgaggggttatatgttgattgtgaatgtgaatttgggaatgtgggtgatatgtgaatgaaattgggagggtatgttcaattttgcaggatatgtgaatttgtcaaattttttaaataacatgttggagggtatgttaacatttttttaaaaaaatgtggaggatatgtttgccttttcaattttttataatcaacatgtcgatgaaatataactgtcaattagtgcactacttgataatagtaagtagtcattagtttcacaatttaaatttgtttgtattaattaatttagcataatagtaagtactaattaataatattttgcaatttaaatttgtttgtactaattaattttgtataatagttaaatttgggaatatcagagaatttaaatttgttcatacgatatattgttaatatacagtttatttttgtacaaagttgtttgtactaatttgagtaatttaaaatgtggctgataactctttttttttatattagaggtttgaaacgatgaccgatagtactaaagggactgaagagaagggtttaggggagcaagagcagtcccttgctgttgtggttgctccggaaccaacagtcccaccggaaggtagttccgacagcgacgtagctgacaaagacgaggagtactcgtcgccaagcgatccttgtccaagcccaagcccgaagagaaggaaaaagggcgacggtgaagaaggcgacaaggactacattccccctaaagaaggggtaagtaaacttaatatgtaaaatgttcaccgtgataactattagcccgagctaattcgaaacttccatgtataccttctcataggaaacggcgccacggcgatcaaaacggcagccgaagaaaaaagttccgtcgaaagacgacgacgtaccagctaacacaaacggcacaaagaaaagcgaacggtcagcaaaggcgaagaaaatgaagggcgagagaagcgtgaatagaaaggatgaagggttccatgttgttacccatgtttcgcctaaaggagagccgctcacccctaagacggcacatgcgaaattcagttcacagtgtggcataattgtaagggaaaagatccccatcacggtcaaggactgggatcatgtatcgaatggggataaggaagtcctatggaaaaagttgaagaaaatcttccagttctcagatggatcggaggcagcagtgaggaattgtgcattgcaaacaatggccaagtcttggcgtggttggaaaaccaccttgaacaagaaatttgtgaagacaggatgcacaccattttcgacgtatgccaacataacccccaatcagtgggacgactttctgaccttgaagaacttcccagaagaaattcaaaggagccaaatgtttgcagagttggccaagaagaacaaatttcctcatcacttaggctccgcgggatatgcaccaaaggtggagcagtggacaaaagaggaggaggaaatgaggaagaaggggcaaccggtaccaatggaggagtggacacaaagatcaaggaactaggtaagagctagaactccgaagatcacggatgaaggaaaagtatcttttgaaaatccggagctgtaaagcgttgccgataaaatagaaaatttatctagttcacaaaagaaatgatctttcaagcctaaaagggagaaagatgtgctaagtacggcgctaggtactcctgagcatgggggaagggttcgaggtgtgtcgagcaagatgagttggaaggaagggttcaaaaatgacccccacaagaagcgtgaagcgtacaaggataaacttagagacgaaggggctgcggagtttgaaaggcaaatgatggatttctgcatcaagcacatgcttttgccttgccccgaaaccaaagaacctgagccagattaccccttcgatgacctcaaggagaatacaccctacagattgcacgttcccattggatgctccgggaaaactcttgaggccgctacagccagtgctatccctgggagaacatacaatgaagagttcatacccgatgcgtatgccaaggtgcagccgcaagtggtccacgaagggtttgagtcctacgacattgacttcctgactgcatatggtgtatccgtacttggggatgcggttgatcttgtaattctttggcacaagaatgatatatcctttggattgggcaccgacgccacgcaaaaacctgtggtgcctaaaccggggttgggaaaacctccgagacctcctaagaggaaggtgattgataaggcggaggaacccgagatgcaaaaggaaaatccagtgccggaagtgccaccggagattgcattgccagaggcagctatggagattgcaccgccggaggcagccatggagattccagtgccggatgtgcccatggagattacagtggcagaaccagaggtgcaatttgtggcatcagtcgggtcagaaatagaagaagtaccaggattggaatgggacggtacagagccagaaatatttgaagacccttctcctgcgaaagaccccgaggtgcaagagaccacggtccctgagaaggccactaccagttctgaggtgccacgagtgcttaggagccacgactccaactccaaagatgagaacaaggagaagttcatggtaaccgtcttcagagggggtaaggaacatgctaagttcagagatgacgacccccagaaggctgctgaactagccgggtgttgacagaaaacacgtggcctgagagatctgcttaactccagtgcatgtccaaaactcgccttcggatgtattaacgtgccagttgatttgatcctataatcaacaagaaatagaagcaaagaaaccgtggttaaatctataaatgatagccgatcggctaaatgccgatgacatatcatttatctttgggccgatgtcatcgatgtatcgatcggcagtcatgaataagtaaggaagaactaaatctactcgatcggctatagatattaacgatatatactccttatatcgatatatacttaaatcaagtgactgggatagatcggtcatcatgccgagacagtataaatcacttagatcgaaatatatgtcaataacaggactgtatatgtttatagcgtagccgatcaaatagatctagcgtgtatcggctaatacttcgataccactctatatcaggatattaaagcagatataacatatcaaacaaaaccctaacatatttagatgcagcaatatcttgatataaagggcagatttagcatatcaatgagacatgtagaataaatatggctaaatcagatacgatcggctgaaactccgatgctattctaatcggcaactggaaggcaggctagagattgatattctaaacacgacttaatagatcaaactcaactgatgcagcattaagtatgaaaagaagagcaacatctagacaatcaagccgctagaagtttcatagaatggtagatatcttatataatccagatcaacgtcaagatctaacctaatcggctgccttctgcatacagatattggccgatagtagttcagatggcgatattgctagagattatgtaagatatatgataacttgacgaattacataaacaagattagagtatcatgaagatggaagcactaatcctaagaacgcaatctgtcataacgaatgttacctcttgttgaagttcgaaatcgatgcagctcaacccgaaagcaagaactcgtcgaaacaaaactaaagcaaaaggatggtgatgcgccgagattgtattgaacgtgtgttaaaaattacatagggctcagggtctatttatacccgaggattacaagatatgcccataccggacacgaccattatctctaacaaactctaagatctaataagtctttgcggcagacttttgcccacacttatctataaggaatttacataaaatatcctaattaatagatacaattgccttcccaggactctatccatgcgtggcaatcatcttgaagtacattaacttgaacccgatgtcgcgtacaagtcatattgtcggaatcggctatatcggcttatttagctcgactcagactcagccgatcctaaccgtagccgatacgaaccccagccgattcctgctctatttccgaactcgatcttcgcttccgactttgcttcgatctaatcttctctccgacgctgatgttaccaaatttggttgttaacaccgggccaacatacttcgcaactgatgattgcccgaaaaagtacgaacatgggaaaccactcttgccggaatgggcactgaaagaaggaccatgggagatgagaaggttacataacttctacatgaaggccagcaagaaaggcttgggcaatataacagctcgatcaccggcagattgcttcggcgaagaaggttacgtatggctagatttctcagatctccacgccatatatcgtcgggataagatggacgtcaactacgttggtgtttggtgcatgtgagtatgagttttaaataattagatgaaaaatatgtacaatacaaatccatgtgattgttactaacaaacttcttctgtacgatgcaatacatggatgctaagaataaaaaagaacccatcgacttcttggatccaactcagatctgccaaacacagcataccgtgaggctagcaccagggtctgaccagctgaagggcaagaatccaaaagagatagcagaatacaagaagggcatgcacaaggaaaaattgattgctgtcgcacagtacattggatgagccttcttgcactttcaaaataagaaagtcgtcatggccgcttataattttaagtaagtccggtatatttatcttgtacacatatctcttattttagctggtactaactaactatattgttgttaatatgtagcgatcattatatctgtttactcatccaccctaaagacggaaccgtggtagtcttggaccctctcgattacagtcacaagcaatacaaagaatttctaacaatcttacagtagtaagttattatgactcttgcatttgtatatgaatgtattataaataaatatcctccttactgtgaaatggtacgacatccatacagtgcataccaatactacaagttcaagggtggagaacagacccgaacacggttgaagctgctagtacgtacctattggctggtaatactccactcacttaatgtattccaattgtttcactaattaaaaattttaactacttttttctatgatatgtcctgaagtgtcacaagtaaccgcgaggaacggtcctttgcgggtattatgcgtgcgaattccttagggttaatggacggtacaggactaacgcggaggatataagtctctatactatgtactagacagctccacatatttatgatactaatatattgattaatttcaatgcatgtagttgctaagattagaatgtcgaacaagctttgacgatacaggtatcacaaatgtccagcgtgatctgtgtcacttcatccgccatgagtgttgtcatgtgaaaggagatttcttcggcccagagggtgccctagcggcaagtgacgaattcaaggatcttcgggagtggaacactgctatgccataatgtaactagatgacgttatttgaagtgacaatgtaaaaaaatattgtaatatatatatatattggcaacacttttgagttatgcaatatatgtagatttctcagtaccaaatgcttgataatcttccaatatatgtacataataatctacctgcaagaatttctactaaataatttaaaagtaatttacgggcaaattattattaaatttcaatattttctacctatcttcgcaggcggaagttttttttttttttgcaagcggccgattcctattttcgcaggcagaccggactagccaacgtcttcctgcaaaaattatcttcgcaggcggacggccgccccgcctgcaaagatcggcgatcttcacagtcgttggcttacaggcggacggtcgccccgcctgcgaagtctcttttcggccgcttgtgataatgcttttctagtagtgtaagaagacagaatgtcgcatgcatatgctatgctactttttttgtctgccagaagcaagcgagtgagcacatggattctcattggatactcaagaaagggggtggaactgtggtgaatgcacgtgccccatgaagccatgagcatgagagcgtctttacactagtacttaaaaaaatatttttctatacggccaaaaccagggctgtcccatcaaattcaggggcatgtgcaaaaagtcgtaacgaaagataaaaacataattaataataatataatattacaataatttatactccgtaatacgtttcatagcaatgtaaaatggtctaaaatgatatacaataatattcacttgaaaagcgacacgagggttaccggattaaaaattaccaggaagtaaggcaatcatctgcaagcaaccaagcaccaagcagtgaagcggacatgcagtccggcggccgcggtgggcacgcgctgcgcggcaccacggctggccggtcagggacgcggcaaggccggcagccagcaggcgtcgatgtgtcactcgtcacttcatcagggactcaggagattctctctcggccgggcagcgacggcgtcaggcgcaggcggcgcgattgctcgagagccgaagcggcacaattcgcgatcggaattgctaaaaaactgtcacaattttttttttggtaaaaaactttcaaatgtaagtatagttgaagtgtaactctaatgtagttacaccactattgttacattctaactactccctccgttccgtttcacgttttaactttgatcaaaatttatattatagtaatatttataataccaaattagcttcattgaattaataattgaatatatttttatagtaaatttgtcttgggttgcaaatgttattatttttttctaaaaacttagttaaacttgaaagaaacagtttgattttaaccaaagtcaaaacgtcttataccctgaaagaaagggagtacattgtaaatacagtgtaactgcactgtaactacattgtagtctctatataaattagatataaagttacatatattattttagtacttatatataagttatattatagttataataaagttatagtggaattttattatatttatactatagttagatttgaaagttttttccttaaagaacttgtggcagtattttagatagtcccttggcaaggatgcatgaccgaaattgaaacaacgtgaaaaagaaaataatagattttcaggactagttgggctatatatctagtgttagagttttaagtctaggggccctcgaagactggggtcctgtgagggtgctccggccgcgcgccctcatggacagccatggcaaaaacctattttttcatacggttggggtgctcgtcggtacggaaaggtctgcgtacgggtggcacgcccgcatacgaaaattagtacttatgtcgaccaaatttaaaaaataaaaagccaaaatataataaaaaactcagaaaaaagagaaagcgaaaccctagctctcgattgcgccgacagcgcaggtccggccgtcgtggcgccggcaccggcagatccggccgtcgctgggccagcgatggcggatcaggctattgtggcgccagcggtggctgatccggccatcgcgactggccgcctcttcctcatcggcgacgacagcgacgtcaggcagggatcgggatttagtcgcctgctcctagtcgcttccttgtcatcggcggcggtgccgctcctggccgcctcctcctcttcatcggctgtggcggcaccgggtggggatgagaatgacaccactcctagccgcctcctcgtcgttggcggcggcgccaccctttcccggctgcctccttgtcgagcggcagcacagccgcccactgccaccagctcccgctcatatgagaggagaggagaggaagagagagaggagagaaaaaataataccaggagagaaaaagggcgagagaggataggaggagaaaattttttgaagtgatgaggagggaaagagagagaaaggaagaaataaaattgtggagaagaggaggtatttttgcatgcggaccatttaagaggctcgcatgcgaaattaggcttatttttgtaggtgatccttaagagcctcgtctgtgaaaatagatctttatatgagggcctcataatgagtcgtatgcgaaaatataggtcgatttttgccgacgtgatcagctacggtccacctgcaacctatatgagtccgcgtaaaaaaatcgttttttagttgtgttacacgaataaccatgcatgggatcgccacctaaactctacattattgtatctaaaatgttgataaaaaaaactagactgatagagcaagattgaggcttgaatgcaatgcaagagtcttccgtcacattgcaacaaccctaaccaatattgcagcaaagatttaagaataggcaattacttgggggtgaaagcaggcaccggcttccctgccacgggagcgtatctatatatgacctcacgtgtacacaccatatacaccaactaaaaaatattataaataattttacaaaaattcatacatatacttctaatagtattacatatacgcacaaagtcgaatttttaaattcattctacatagagagtaaaaaaagataaaattctaacagaattacaaccttaaaactgtcggattttttttacgactaaaatataatgtatttgatgttaagattttatcctagctagatataatactttcaataatttttttagatattttagtagtatttgttagttgatgtactccctccgtttcaaaatgtttgacaccgttaaatttttagttgaatttttagtacgtgtttgaccgttcgtcttattcaaaaaatttaagtaattattaattctttttatatcatttgatttattattaaatatactttcatgtacacatatagttttacatatttcacaaatttttttaataagacgaacggttaaacatgtgctaaaaagtcaacggtatcaaatattttaaaatggagcgagtatatgatatatagacgtgagtctatgggatactttccctccctgccacatggacatagcaactctcttccctcccacgtgctgagctgcatcggcccaatcagcggtctagtaatccggttttaaccggtttctatgaaaaaaactggccgttcaatggtttccgccagtctgattatttcacacccatcttttttaggctggaccggaccggccaatgttccagttttcttcggtcggaacccggtccgatctggttctaataattagagaatctcttatatgccacttcaaattaaccggtttccttatgccatttcaaattggcttctctctgcgatgccaccggttcaagtatgttatcccttttatgccattgccgtcactccaccatcagttgaccgttaacttcagagtaaaaagacgtatttgctcttgagagttggtatacaaccaatcataggtattttaatactaatatagctactggatacaacatatgaaaattgattctttttttgcattatatgcaattttagccatcaccatcacaaataaattttcaatataagtatgaaacatacagttttccaacaatatttttaatacaaagagcatttttcattggttatgacaaaattttgttcactcaaaacggatttaaaataaaatagttatgattttttaaagtttacacattttttagttgagaaggcatattggtcatttaaaaaaaataacatgtgactaacaatcaactaatgctacagtgctaagggtggtataaaatgtgaaaaaacttaaccagtggtatataaaggagaagccaatttaaattggcatgtgtaagagaactggctggcatataagggattctattatgtcttttcctatcttcaaacaagaaaacggtactttacatttcaagattccctctgtccaagctcctacagctagctttgtagtgtaaagagctgctagatttgtttttatcagatgtacttatcttcggcacttcctctgtaaaacacttattcctccgtaaaaattttaaataatcataattttacgaagaaagaatataccatcatagaggtaactaaattagctctataatgtttgaaaataaatttgaaccattatatatttacccgttaaattaataatgtgagataatttccacttaaatcggtatactcattactttgtactattatttttaaataatgcactattttaaaataaagtttacaccattattatattgtgtacctatcaaattataatttaagatctatattaactaatttatatttgcacttaaaccggcggacttgttatttaaatgatcagatctatcttttattacttactttggactattaattttaaacaatgaaactgttttaaaataaagtttacatcattatactgtgtactcattaaattaacaatttaaaatctatattaactaatttaattacatctattatttgaatcatcggatctatctattgttaataaataaagcatccgaagttttctttttggcccgctgtagaagcacaatgcacgtctgtagctttgccttccgcacgcatgatgaaacatcatatctgaggcagctaagttgatcacgaccgctgcagcgctatccctttgccacatatcaaatcatatatggttaacaattaattttgttaataacattaaaacaaattaaaggtatgaggcagggagagaagaattaagcatcgtgggttgagtttttccaacaattagctctgtgtaagctgaaataaagagttgaatacaaaataattataatgtactagccgtcaacccgtgctttgcacaggctaattattgtttttataaataagtattacaattttaatcatatgctgaattatcagttatttatttttcaaaatatctcttaaaggcaattagtggattcccccctacaactttgtgtggatctggattttagaagaatcttgattttccgacataattgttacattttatttccatagatataaaatttataaatcgatttaaatgtagaattatatttttttaatagataaatagattagtaaaaaccaagtaatttacttttcctattgaaaataattgtggattttgacaataacaatatatacaaaatcttactccatactgacgctcgcctttgtcatccaatgttgcacagcaagatacactggactcatgcatcgtggcctaggcatcgtcccctcaaactcaaaaatgtcaacaatacgaaatcgctttagaaaacaatcactactaggaatcattttcgcagacggccaaaagtagttttttcaggcggggaaagggccgccagtaaacaaaggcctacgaaaattattttcgcaggcagcatctccaccctcatacaaaaataatttcagtgaacaaaaacaaatttgctgccaccacccctacccccgccgccacctcctctcctcgtcgccaagccgctgctggccctcctcgtcgccgggctggtagagggaggagctgagccaccgcctcacctcctcgtcgcggccaatgcctcccctcctcgtcgttcagccaccgtcgttgccgagagagggaggagccaagccgccgtatcccattccctccccctcactttctcatcgccaccacctcccctcccctccccgagaccggccggtagcggatccgcgcgcccgcggccagccggcggtggatccgcactcccggggcgagccagcagcggatccaagaggcgtcatgtcgtcgttgcgacctcctcatcgctgagccgctgccgtcgccgggagagggaggagccgagccgccgcatcccctccccttccctgacctcctcatcgccaccacctccactcccctcaacgagaccagccgacggcggctccgcgtgccggtggccggccagtggtggatccacgcacccggtgcgagccagcggcacatctagaagtcgtcgtcgccacctcctcgtcgctaagccgctgccatcgccgggagagggaggagccgagccgctgcatcccctcccctcacctcctcgtcgccaccacctcccctcccctccctgagactggtcggtggcggatctgctcgccacggccggccaggggtggatcctcatgcttaggctgagatggcggcggatccaggaggcatcatcatcgtcgtcgtgacctccatgttgctgagccgctgccgtcgccgggagagggaggagccgagtcgctgcatcccctcccgtcccctcacctcctcatcgccaccacctcccctccctaagacctgccagcgatggatcggcgtactcatggccggctggcgatggatctgcgcgcccagggcgagccggtggcagatccaggaggaatcgttgttgtcgtcacgacctcttcatcgctgagccgccgctgttgccgggagagggaggagttgaaccgccaacctcccctctcctcctcgttgcggccaacgcctcccctcctcgtcactgagccaccaccatcaccaggagagggaggccatcacgtgacctgccgtctaatgggaaggaaatgagagagaaagagagaaggggaagggaaatgagtggccaacagggtaaggatggtgaaggagaagataatgatgggacttagatattttttctgcaggcataatttttgcagacggacaacataaggttctgcctgcaaaaatcatttttttccaagcggacgccttaagaggcccgtctatgaaaataaaggtattttcgtaggcggacctcttaagtgatccgcataaaagaactgatcttcgcaggcgaacgacaagctccaccccagtttaaattttcgtaggtggccatatttggctccgagggccatatcctcttaggaaaaaaaactcacatcgctttttctagtatttactttacattacattatctattattttattcatatttctaaagattaagattaatagtaaatttttttattaattcatagttttactgataaaaaatatgaattaataatacaaatttattaattctattttgtttgttcatagttttttcacgtcataaagttttactgttgtcttaattttaatttttttaaatagttttaaattgtagaatagctcaatgcaaagtactcgagtatcaaatgcgttctttgtgcttgtctatagtttcgatttagttttttttgctaatttaatagttctcaaaataaaaaaaaatattagcgagccatatctaatgtggactcatagttaataaatacgaaatttttttagtttgataataccgaaaatttaaattgaaaatactagattgtcctcctcttagggctctgatttttagtatttcaattctttattaatctaaatttaagaattaggaacctgcgatgatgtgtcttgactcttcttttatttcactcctaatttgatgataccacctagataggtgattttgatttattcactacaataaagcgagcaataagcataggtatgaaacttgcgtgcaaacacccacaatcatgatatagaaatataatgtgattatgtatgctggccaaggagaataagtattaatttggtcaacaattaatgaactgtatttgtgcagatgatattcgaccctaatccaggcatgaatattgttggccattgtattacaaaactaatagtagatctgcaacgggaaaaaggattggatatgttaggacaacgtacagatcagttgatgcatatctgatgcgttttcttctgccgtttaaagatccaaatgaacttgctgtgctctactcacaatgagactgattcccccgccgccgccgattcatcaaaatataattgaacttatctacttcgatcttctttccatttgcgcaggttggtgcacatgcatgcgggatatgcaatctcaacagcaggtcgatccgtccatgcatatatgctgttcgaattggcggctggagcgactcctttgctgaagttttcaatcgtgttaatggacaccccggcaaggtgaagtctctcgtattatgctcacggttctgctcgtggcctcatgcttccatctgctagactgttacctagctctctccatcagatatagttgtgcagaaaagctaacgcgcgccggcgattccagaggaatcaacgtaactaaccgagttagtttcgagttagtttaggataatgacggtaattaaggaaagattttcctttttttgaagatttttttactaacatattgaaaagaaatctatatgtgaaagaaacttccacgtgaaattttaaactttcaactcaaaatttgacactcaaaactcaattttttaatttttttcaactcgaaatttgaactttcaagttagatttcaaaactttcgacttaagatttaaactttgaagtcaaattttgaaaactttcaactcaaacattgaaaattttcaacttgaaattcaaatttgtaaaacaaattttaaaaactttcaactcagatttgaaaactttcgactcagattagaaacttccaactggagatttaagaaatttcaactcgagatttgaaaatttttaagtccatatttgaaaatttttacgttgagatttaaaaactttcaaattaaaatttaaaaacttttaactcaaacatttgaaaacatgtgtgctgaagattaaaaaaattagaaaaagcgcaaaatgaaaaatgaaaaaaaaaaaccgcgaaaaaaagaaaacgaaaaaaatcatgcttaggagagggtgccaggctgccagctggcgcgtgtcgccccctgcctctcccggatacaattgactagagataagaacatatgggctatggaaagagcccataaagttgacggtagacaggcctatggcgttaaatcactattgcatctatgattctgattaaattaattaattatattcaatggttagacttttcttattaacgtgagagctcataaaaagtgtccaattaatataggtatagatagatagattgtgttatatcgtatttagattttttattatttgttcatgaggtgaaagaaatcattatgttataaatgtgagcataatatgaaccaatatcaatagaactcttagtaggacgtaagtgttataagcgagtttaagggcctatttttttcctgattctatactttcaatttttattttcatgcattccaagtttctaaatggtgcttttttgaaaaaaaaaatcttggaatacttttctaaaataaaattttaactttttaaaagttaatttattcgtttataccctcagatagcaatcgtataaattagataattcatcaatttcagttgtcgtaaaccctaagtagtattttttttttcatacgagtcattgttctgtaagagctactctaaaaaattgtaaattgatgtcaacattaattcttattaattagacatctaatgacttgctagcaatataattaatttctttctacatgtatataaacaaaggaagtaattttaataattgaaaacaaattatcggaattattaacttcaaaaccattttcttttctttttcagccgataggctgtttccggcccaatttcccgccgccggcctgctctagcccgagcgcgcgcacaactgccctcgctgccgctaggccggccgaaggctcagcaagctgggccccgcgagcgcccactcctccacgggtcgccgatgggtggggcacacctgtcaggcccgtcccttcctctcgccggtgaaatcggagggggagaacaacatccgcccgtgcccggcgccccagtaaccccactgtccgcgcctcgcccacgtgtgcgcgccccactccacgcatcccgcgcccgcaacggccgcacgcggccccagttcctcccggcttcacgccccgacatcgcccctcaccgccgccgttgccgcctaccacgggagagaggtccatccggcccacggctctataaaaccccctcgcgagctctcctccatttctttccgcaaccaccgctgcttccccgctcgctcgttccctctcgtgccgtgcgaagctagcgccgccgccttccaccatctccggccactgctagggctgctgcctagccgcgccgtcgccaccgccgcgctcaccgagcccgcctgctcctcgccaccggaacacgtctcgcctcagtcgccggtgagcacctccttttccgctgcctcccggccgacagtgccgcttgccgtgaaccctcttttcccctcaaacccctctcgttctctctcttaggtcccgcagctgcccgtccgcgccctctgccgccaggttgtcgccttcctcaccgccgccgtcgtccccttccgcgccggccggtgaggaaccccctcccttgccctctccttcccgtgcgcgccgctgcccctttgggtgcgccgccgttccctgtgcgaaccgccgtctcccgcgccgcgcgccgccactccccgcgtcgccgccggtgaccgcgcgacgccgctcggctgagcccgtgccagctcaccgccgcatctcagctgcctgatctgccacgcggcagatcagggccgttcgttcgaccgcccacgtgacttggtgcccccgtctccgtcttcgtggacttgtccacggtggatcggacacttgcgccgctgaccgatggggcccacatgtcagccccggccccctccctcagtgacgtcagccgttggctttaatgcgtaatattttatttaagggcttttctaaaagcacggtcaatcttttaaaattcataaaaaattcatccgagctccgtttgagcccactcaaattacagtaaattcataaataaacttaaaatccattaaaaatagttttgtttatgtctcgatagacttatagcctgttttgtatgtgtgcttcgcttagattccggtgaatccgaagctctactttactttgaagtggtcccagaagttcctgcagcaccgggggcaaggcaagtgatacatgttaattaatcatattgtacctatttcgcaaacgtctcattttctattaaatattgcattaggacactcaaaaggtatgtaattagctgtgtgacatcacaaaaacgtgaatttgcccgagaacactccaaaagtatggtaatttgctgcaggacaccgaacgcattaaaatataatatccacccaattgatgagagagaaaccatacaaaatgacatatttgcccttcttctcccttctttcggtctttttccaacgctcacttgcaacgagctccaatggcttgccactgtcatcggcctcatccctaccccccaagtccccagctgatcgtgcgcgccacaagctctgctggtctccttgacacgctgcacaagcttaggaacgtggccgctgagagcaagcgtaataggaagctcctcgcagccatccccggcatggtggggtactggagtgatggattgacaaatagcaaagattcacatttaggaattatccattttctgctggtggaatgatggctacttttgcttggcttgctgcttgctgagttgctgctgcacctgcactgctattgcgccatgcgcctcctgcccagcttgccagtgcctgctcgccacctaccgtgccactgcccacgaacccggcgaccacacccctcctagcctccgcctgccctctcgtgtgcggcgccggctctaggctccacatcagccatcgtccatcgatggggtgatggggtgatggggatttgggtcggccggtctgcgatggattggggaatcgatggaggattgggagaagaagaagggcaaaacggtcattttgtatgggttccctctcatcaattgggtggatattatattttaatgtgttcggtatcctacagcaaattaccacactgagtgttctcaggcaaattcatatttttgttatgtctcgcaactaattacatattttttgagttgtagcaaattttgccattttacaatgtcatgtgggatggttacctatacttgtccatagattgtttaccttaacccattgataaaatgggtattaatatgactagatcaactaggaaacatacttagccatgcttagatcaactagcttactatatgggggatctcacatgtaacttaaatcttggtttaatgatgatgatattggacgtgtaccaccagggtattcaaacaactaaaatatgcttaatggtgggctattggcgcatggttttgatagacacgcctatgtcatttaatgcacatgcagctcggaattttgtttcgtaaatttcttggcgtgacaagttggtattagagctgaccttgaccataggacaagccaactggaaaccttaagagctcactgaaactctttcatacgcatatgttcttttgcatttggatttgtttcagggaaaatttgagaattttcttccttggtttacagggaaaaatcttgatcgcttattcgaatgagatatttaaaatttaggtcagtctagggtattagtaactttgggtaaatagatttggggtcaattggaatttcatttgatagttagtcgagaatttatttaatgggaggtatgcattaagtcatgtcttggttcgatgggatgcaatctttatgcttattactattatctatttattttacgcattactttattgtttaatcagtgtcattagtatgtttatttggttcatgtaaaatgttctgtgcataaaaagttgctcttgcttgcttatttacttgagtcatttattgctttatttaatttggatttgagcatgcatagattcctaccctttgtcttctatagatgtcaaaccttccccctacacacggtcagggcatggatggcttcgtggcagagctgggtcgtatggcgatcgcagtgggctaccctcataacccggagtacacacagcttcgcctcctcaatggcgagttcccgcaccaagtccgcttggaggtgcacgacattcccactgtcttgcccaacatggtagttactgctacaggaggcacctttgagcatgcttgccaggaggctgctttaaggatgatggccaggatgagggagctacacgaccacgacctccgcaacactgcttaccgctatcaccctcgccgtagcagtgacgccaacattagtaccttcaggtcagcgtcaggggagaatgacaccacctttggacgcatgtgcgctgtgatgaagggtgtcggtgacatgggaccgggagtatcatgactagaggcttgaggcagacgccatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtctgacgcccgcttcgccccatcccgtcaagacgagagcttctaggcactcgtccccggctggaactagcgtgttacatcccagagatgacacgttagccccgatcgatatatgccaggcttcatcctaaccattacaagcaagatgttgtttgaagaagggcaaacatgcacgttgctaagccgacgcgtggtggacaagaatgaccgatttgtgaccggtctgacactgctcatgtcgtcagcacacagccaccttcccacgacgtgcccgcctcaggcagaagtggaggtaggtgtgtgccgtcccgtcaggaggatgttcggaggacgaccgtgcaaatctccgtccatttatgaagagaagaaaagtccagtttggaaagggaggggtgcatgtggtatccccttgaagtataaaaggaggacctggcccatagagaaaggggatgatcttttccagattcagaacctagaacgagggagaggttggctcacactttgtagctccttcatacgcagatccaccaaaacacaggagtagggtattacgcttctcagcggcctgaacctgtatacatcgcttgtgtttcatgctcttttgagaggccgcgatcttcccacatacacggagagcttgagatctcaccctgagcccccggccgaaccggcaaaggggggcctgtgcggtctcccggtgaggagcaccgcgctccgtcatctggcgcgccaggtagggggctcagcgtgtgttttctgagctctcgcgcttttccgtgtgcgtcaagtttttcttgatcagcctcatggctgagcaagcaaaggcgcccgacctctctcccagtgtgagtggcgacgacggggagccgaacccacgtcgtcgagctcgtactccaccgccccctccacgccaaagtcctaagcagggggaggcgctcgaaagggtcgaaagatccgcggcttcaccgatcgcgggcgatggaggagaacggcgagatggggaccgtcgcctcctcgtctacggcgacggcagcacgccccagggcgcgctccaagctgcgggcgcgctcttacgccacccgcctgtcgtccctgacccggagtctccagcccaacgatggctggacgatgtggccaaattggtcatgacggcacggcggcgcctagatgctggtggccggtcctccgccaccaaggcctctggtgctgctaccaccggctccgcgtcgtcaagacggagggcacgacgagcggcagccgctgttcgccgttcggctgccactccttcgtcgactccttcgacccgggaagatctgcatggggagcaggacgcccgcgccagcatcgagcgccggcgtaatgaccgaagtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaatcccgccgagtttctccaggtctacacgaccgggattgaggccgccgggggtgacgacagggtcatggcgaatttctttcccatggccctgaaggggcaagcgcggggttggctaatgaacttgccacccgcgtctgtccactcctgggaggatttgtgccagtagttcaccatgaacttccaaggcacgtatccgcgccccggtgaggaagcggacttgcacgccgtacagcgaagggacgatgagtcgcttcgatcgtacattcagcggttctgtcaggtccgcaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggcagcttcggccgcccccggatccgccgctcaggcagggcggcgagacaggaggaggaaaaagaggtcagtccgttccgacggcgagggtcatgtcctcgccgtcgagggcgcttcgcgggccacccgaaaggggaggcctgcgagcgacaaaaagaaggaggccagcgttcccagcagggagcgccctaccggcaagtggtgcaccgtccacaacacctccctccatgaccttgcggactgtcgcgcagtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32089 - DNA, 828 bp, Oryza sativa
taattagtagtaaagcctggagcagcatttgctctaggcaagtatgtaaaccatgaatggaactccatcctttccaagaggccaaagcggcttaactggcaatcatgtggacactgttgctcttatgatctaccgcgatcgcgctccacctagatagagtttgcgaaactaaactcgcagctgttcctggtgcctcccattcctagaactcgtcatcaagtgaaggcttgtattggagatgaattaaatttgagagctgacccaatagtacgtagttggagtcttccactgtttctctccacatatatggcctagacttcgaacaaacagaggtttttgtgctagtatttatacagagctttgctttctactgtccatgtcaaaacaagttcactattctacacttatgctgtatatagcacgtcacgtgtctgcacaagttgatcttttctgcaacaagatagctggtacggcacagtacaacaacataagtacattagtttatatgcaaaggtaaatagatgttgtgcattgcttattggacttagtgtatgacaggcacggagtaaattaagtggtatatgttcaggcacaaagtaaaattaagtggtacattattctggtgttcgatagtgtcaaatagacacaatacaatttccgatgcttcccacccaaaacatgacttgctgaggtgagaatatataatgaagggcttctggacatatagactatgagcgtgatccggccatccattgctccctaagttaattatatggtctgagctggtatagaagcacatgcaagagcatgtactgcaggtgaaaacta

SEQ ID NO: 32090 - DNA, 4080 bp, Oryza sativa
gctgcatgttgcattgccccactagctatgccgatgaagctggaatcccttaccatagttggcctcggagaacttgctcgggtgacggagtccaagaagcgcaagagctggagactggttcagccccgttcttcacacaggggcctggaccgggttaacacgcaagatagcaggagtgagcagtttcgttcctgtccgcactgcacccttgcaaaccctagattttacaaacattgtttttttcttggtgtatgtggagctaggacaaatactgcacaacaagcgtactagtattcctaaagcttcccactcctgaatggcggtgagaaatctaaggtgactacagtgcatgatatggcctcttgtcttgggagcttcacattttctttttgcgtgctgcagcaaaaactgaaacaggactgcctttttatagtgatcatgtatgcatgaggtatataattatactgtaagtaaagcagggctgccttttttttatagttatgtatatctcatctttttatttataactaattattataagtaaaacatcttattaatgacaaaaaataatttaatagaaaataatttgcatgtaaaacttttatatgtgtgtcctttagtaatttttttaaaaaaatatgggaaaacaaactacaacgatgaaaacctgaaatcaactccaaaattatgtttcaaaactcgaattatcacttatccttataagctgaaggctaagtgaagaaaacctgaaatcaactctaaaaattatgttttaaaactcgaattttcagttatccttataagctgaaggttacacgttgcgagccgcatatgaaaactacactgtacagatttcactgttgcaactttaagctacgacacaagataaaataaaaccattgtggctacacatatgcaaggacttgccgttagtaaagtcttgaagggaaaacccttatgtgggagctgatgatctttggtatgaatggcaacgaaaactgatgcccacaatgttcacaatcatatgctccgtatgccggaatgtttgttagttgaaatacaaatttgttcattgttataaggagatgtgtcacattcatcatacgagcaatcctataaaataaatcatttccataactaatatttagcatatattcctccaaaatacagaccaggcataatcattagcctttccaaaacttgttttctcgcttttcactagaagtctagaaacttttatacaccaaaatgtctacgaatagaattctgtgcaataaatttggacttgtaaacaaaccttcaatgctccacacatgccatgcgtacaagaaaaacgggtgatgcaagtctttcagttatcaaaaaaccaaactatccaggatgcaacagttgatacattgttataatgaatcataatgaacggactaactcacaggcccttggagagtagaacacagctcgttctacagaaaactatcctacatacaagaatcgtaaagaagcaaacatcataagttgtgattcacagtcacagcatgcacagacgaacagattagctaagagttggcttgcttttttttttcagggtaagagttagcttgctaactcagggcctgtttagatccatttgaaatggcaaatggcaaatggcaaaagttttggtggcaaaagttttggtattgaaaaagtactagttggtgtttagatgcatcctaaacttttgccattctagcactaaagtgagagagagaaagagagagggagtggtcccaaagcactttttggcacaatttgctactatggactagcaaatgtcaaatgccaaattgccaaattttgctactagtgtttagatccaaaatggcaaaaagtgcttcagaatgacaaaacttttgccattttggaggatctaaacagggcctcagactacattgtaaacaatcgtaacaactaacgctaccctaatcgcccatgttatagtctccaccagctaaaccagcaaaatcgcttgtgtcccatagcggaataaactattcggtatctctaagattcccaatgtctcccaatcctgaacagaatctagtgcaattatctataagtatcacgaagtatttctttccccattcattttgcacatatcgaaatgaataagttctagcgttgccaaatttcttgcctcaaatgtgttgtgagccttgcgacattgtttcgtttgaacacaagcatgacacttaaaacctttgatgaaagtgaatttcgacataaaacttatgtcagctaagcgcatcgtacaaccaaaattcaccactctctcatcccaaagacccgaaatggcatggctatcctcctgtcttaatttcagccccgaggtgttgcggtttggctaaacctataacaacattttgaaactaaactcattgcagttcctagtgcctcaaattcccgaaattcttgaaattacatatagcgtaatcaacgatagttgaggtcatattttatctccatatgctgatcgactcagagaaaccaaaatgtaggggtaattctactacaaagatttgtatttatagcagtttgctatactcgggagtagtttcgacatatctcaagttcagttatagctctctactacataaatggggtcttttgtctggccactccccctctcattttccatacgtgaaaacctctcccaacttataaaaaccgtccaactaaaaaaacaatttcccaaaaaaaaaatctacgactgtatagagtaaaccaaataacctacttcgcccaaatctttcgcatccacgaaactacagaattaaaaaaaaagaaaaaaataaatccttcccgtctataaaaatactgttgcaatacacgggtcaataactatttaaaaataaaaatataagttatttagtgctaattgggattaaacggtaaggtaacaaaatcaaacccttgtaccacattactttacactgggaagcaacacctcggaatccatttggggagccaaatctcccacgcaacacttctataaaaacgatttcgcaggtcgtgaaagatctattggagttcttgaaaagctcttaaatgaaatgaaagtgcactgaggaccatggatatggcccataggatgatgaacaggcgtttcctgcaattacataaacatgcaatggaaattagaacaaccggacaatccggtaccactgcagacagtccaacaacacacagaagcggacaacccggcagctactggacaatccgatcaacacagagaaaaacatgaactcgcctagtggaaatataggctcgtactgtccacctcggtgctggacagtccgacaacactaagtgtttgacactctaacaatgataggacaatccgaccctgcatagaaaaaataaaacctatagatagagtactttgcacactacttatatactagagctagaaggtgatcaacaagatataagcatgtacaaatagatcaccaagttactcaatatgacagcatcaatgcaaagtacaaaaagcaagagaggaggcactgatttagagcgctaaatatgaaatttgtagttaatgacgtttttatttgatgtcatttagagcaccaaatatgtatgtagagatgaagtcaaaagaatagcatgcgtgccaaagtaatgaagtatttcatagataagatgccaagaagaccacgcatggagtaacaatattagggtcccaatcctatataccgcttgcatacatatttcgcatgacttgtgattatcagaaacaaattaacactggaattcattttgacaagtatttccttaagagagatgtctgtgaaaatgtgattgtcacatgcggttccttctaaacgcataagaaaattgttgattaatttttacaggcctaggtcacaggtggttcactaaagacgtctataaattggtaatcatcagtctacaaaattatagtaatgtattaaaaaaccattgctgctatcatagtaatttgtcatatgttctgtgcatgacaaggttgcctctgttgtttgagtgtatcgccctcaactattttacacaggctgt

SEQ ID NO: 32091 - DNA, 2066 bp, Oryza sativa
  unsure (1)..(2066): unsure at all n locations
ctcccactcctgcctcatagagatgatactgatctagatggggccgtcgatatgccctatctcattctaggtggcagattttgaagagtgctactaagttcaccccaaatctgtactatgcatctctagagctcgcaataatcctctgctatcttacatttctgcttcctgcgtagcgagcagatgttcctgatgcctatcaaacctatgataaataataaaaccttatatatatatatatatatatatacacacacagacacacacatattatgtacagcagagctaccattttctattcaataactcagacaagtctgaccaaatggtggcaagggtggcatattcaagttttctgggacagcagagctaccgttttctattgaattggaagaaaaaatattggtactgtaactgttgaagtatagtctgaatattttaatttgttcaacctagctagacagaacgctggaactcacccctgcagatcgatgtgttggactggtggtatatatactggtataaggctttgatatgctagacatgtgtcagatgttggtattgggtactgcaaccgactacaactatcggtatatgcaccaatgtagtcacactcacacatattcattgtcatgctatttagtgttgtatactccctctttccacaaatataacggattttcatttcttttaagagcttaaggctagaaaaaacatgatgtccctgatgaatgatatataattgaggatagggagatatatatgatttgatgaaaactaaagttatatattcacggtatactactcaaaagggcgtacgatctatctagagtcaaagacaataaaaggttacatttatcatttagcactaggtgaaaccccgcacattgctgcgggagtttagcatgataacaataagtaaaaataatatgtaatacagctagacaacataagattatgtaaagttaacgtggtttatgataatttaaatttaaatagtatatagaatgatgattcaaatgtaaaagtaaggtgatatgactttatgaaagaagaaaagtatcgagatagtttggaccgtagattaatcatctaaaggttaaaaataattgaggtgatatggattaattagagaagaaaaggagagagataatttggaccatagattaatcatttaagcactaaaatattgatgtgatatgtcttaacgagagaagtgagaaatagcattaactagctaagactactaagtgaggatgaactaggtacatagcatattataaaaataatgaagatatatattgaaatattttgtgaattatgtgggatgatgatttaacatgcttgcattttaaaagctctaaaatttaataaattataaaattatagataatatagcatgtttacatgatgtttaaatttaatggttgttagtggatgatgatggtgcatcttgttaatacatgatgatgggacatcttgttagtacatgatgatttggcatgtttgcatgttaagccttagtaacataggatttgacacagacaactgcggattgctaaagaaatttgtttatcataattaattctctcttgctataaagttatagcccactaattcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32092 - DNA, 6146 bp, Oryza sativa
gctttgctagcttagagagcatgtacaatctgaaagaggctaagtttctaatattaacaatgcaagtagaaattgattcttaaaaacttatgagatatttagcccatcagagatagacacatctcatatcaagaaaacaataaacaatacttgttttcatgataagctaatgttcctctaaaagttaatatggtggtttctaagtgttggccgcattggtagcaaacgttataaacaagttattatattatcaatataatatagccaaaagagtactgaacagacatcaaatcatacatgttgttgagaatagaaataaaaagtacattccaaagcctccgatgccttactaattaaagaactgtataatatataaccaagttgagatattaacaagtggcattttctgaaggccaaacttttgcactgttataataacaaacgattcttaatttcattgaaatacatactaaaagaaatcgaggccatgtatatatataaatgctcacaaacgggattcccttcattcacggttcatgaacttctctctgacccttttgaagcatctaccaaaggtttactacgaacgatacgaagtacgtacagtagtttaccaagggatttgctttaattctcttctagcaggatcacttgtacacaggatcactcctagcagtgcagtggttggcctgtagacgtgcgcatctcaaactagttttcttccagcaacaacccgcgatgttgttgggaatagtccaacattgctaatctagggggagttgaaccaacttaaaagtaaaagtgggggaagcccttcacctcttgagctagcttttggggtgtagcgaggctttctaccagttggttttgggccaacaaaagatagtgttgttgtggagaaattgtttagtgcagttcccgacaagtttcttcacattgttggcaccatcgagcaatggggtgatgtgtcgaagatgtccgtggcggaggcaatcgggcgcttgagggcgttcgaggaatccttgaagggtcggcgccgcgaaccggaggttgagtatttgttgctcacacgtgcacaatgggagaatctctatatcaaggagaagaaaggagaagacggcagcgactccaacagtagcgagcgcaaggttgataggaagaaggtaaagtgctacaactatggcatacatggtcattatgctaacgaatgtcgcaaaccgaagaaagaagaagcgctgctcgctaccgcggacgacgagccaacgctcctgtgaagattgtttactaggtattccaaaataaagacaacaagattagtgctaacagatgtagcaccagaaatcctgacacctcccaatccaaagcgattagttttatagtgttgcatagataaacggtgtatataattcactaataattcagtatgcctcaacaacatgtagatgaagttcttccaactgctgtgccatgtatatatataacatgtagatgaaggcacatgctagtgtttaagaactagtatatatatgcatgatgctctgtatgctactattatacaaatttgcacatgcctgcagattgctggttttttatattttagcccttttcaaaaacttattcggtagatagacccatataaaagcttattactggaatatacccttttctggatgctaaggttcatggcgcctacgtccaatgtctcggtgccaataccctcgacactgtagcagccaatatgtggaggagtcgacaaccaaggaccaatttgtaaaagtaattctaaaaagggttgaaatgtaaatatcttttcatacaaataggtcctcaacacatgctggtgtcaagggcctatttgatagaaagcatttacgtttgacctttttaagaaattaatttacaattatgttatctacgccagtctctttaataatgaccccgttacaccagtgcctaagctataaacatgggcaagggctgtcaacgttagtatcgttggctctgagacattgaacctttgtgccaataacttggctctgagaaaaaaaaaggttcattcttataatatatttgtaaataaatgtttaaaactaactaaaatgtaaaaatttcagctgcagattgcatgtctgtttgtagacttaaggttgtaaaacactgaacttttggtaaacagaatacgcacatgagtctagacgaccgtctccttttttgctcatcaccaatggttgactgattttgaaatggaaaattggtttagatgtcagaaaaacacaatgtactacgctgtacaagctataaaaaacactatatacaatgttaataatagtattctctgcaccataaaccactataataaaacaaattttacagacacccccaattcgatcacggatgagcgtaaagaacatccatttgtaaaaaatatatttggatggtgtttagtacagatccactaacgcaaatcaattttcgcacgcggatctcttaataagcttaccctcctctccttatcccctcaactcctccgcttcacatcctcatcctctttcccatttactccctctccctctctcttccagtctcatttattcactttcctctctcttactctctcatgcgctcctcatcccctttacttctctctcacttgtaggccggtagaggtgcatgaggaggttggtgcactgcggcgacggttagtctagcggcgctcgaggaggctagcagaggaggctcgcgttgacgctggtaacagcatcacctcctcaggagctgccagccacctcgcagatccggcgatgctggccttctccctcgcagacccgatggcaacggccttcttccatgcaaaccagcacagccagccttctccctcgcagatctggtggcggcggcctcaggagcggtggatccaccgccactggcctctcttgtagatctggctatgacaatgatgggtggccctggccctaggaggggcggattcacatgcgttagcgtcaagtgtggcagtggcgttgacgacgatgccggcaagcttagcagtggtggatctagtggccacagccccgggaaaggcggattcgccgttgttggccttgggtgcggccagtggcggagccacgttgagtttgggtggtgcacaggaaccccctaaacttacaatgtctcacttaaaaacactagaatatgcagctttgcatcgaaatttttatagattttcaatggttagtgcaccacccttactttgatgttagctctgcccgtgggagtggcggggtctcaacaaagatgatagtggtagcggactgcatagacgatggtggcggcaagggcggatttgagctagggttttgcctatttgaatttttatttttgttgtgattttcgttcttgcaaacggatggcataactgaccttatgtgaaaattaccatctgcatggggttttgctactcgtatgggaaaatgttgatttttacatttttatagataaactcggggggcaagcgcttgcattgcccgcttgcaaaaatccgttgtagccttttgcagaaatgtaggctgtagcatcatttggtttaggcaaagaaagtacaaggaatagaactctataacttttcccaaggatcctccatctgaatttctttccctgcttgggtaccccaggaggcgcaggcagccctttcaaaaaaatcaaagaggccaagccggctcggcaatcatgtggacagtgttgcagttatggtctaccgtgatcggccataacgtcgatagaatttgcaaaactaaacttgaaccagttcctggcacctccgattcccaaaactcatcatcaactgatggctggtaggagatgaaagttgagagctgaaccaatagaagttggagccttccactgtttctatccaagataaccgactcagagttggaacaaacagaggttgagcaagtatttatataggcatccatgtacgtatatagctttgacatgtctgtataagttgatatcttctgcaacaatttgggatacatatagtacggtacggtacagcaacatcagtatatattaatttatatgcaaacataaataagagttgcgtacatcaatttatatgcaaacatagatataagttgcgtattactgcttattgggcatagtgtaggtctggcatgaagtgaattaagtgatatatggtgaggtacgaagtaaattaagtggcactttattcagggtgttagaatatacaccaacagaccaaatttggtttgctgcagaccgggatacagctaccttgtttgaggcttagagcctatttatgaggcccaattcaagaggagaacttgtgggccaatggccttaattttcatgaaattgatttaactagcaattttggagaataaccccaaaaaagattgggctccctagagattgaaaaactattcgcagtttctgctattgataatgcattaatatttctttcttgatgtgtttatagcctttaattcgtcaaaactccagatcccttcttttcaggacacggtgaccattgtgaagctcgtagcgctaagaaatcatcttgatactagcacatatcagctcaccacagctagcttcgcccatttcgagctgtgtccacttcgatacagggacatggttatttgaatctaccctacgggatcatctctagatgatcaccctaataaggtattactactctttgatcagtgcttgctgttaacctgtaaacatgcccatctcgaactaacgagtgctacaggagagcaagaaatcgtatcactacaactcctgagtcctcccaagccaaaaccgtaaggctatggatatatgcagtgcaggacacaccggcctaaaaaactatatatagaagttcatctatcagttgtgtctcctagcatgaatggacaaaacagcagctctgattgctattttatgctatagcaacgacatttgttatgatcctccatgggatggtatatgtaaacaatagtgtgtagtagtcatgccagcttgtaatttcctcctcctgtccacaaataccaaataatattgtttgtcttttattgagatatatagtgaggatatatgaccgtaattttaaatattaaacgaggagtggttagggagtgcaagcgtggtcgttgaaattaagattacgtaaaactaaattacagatggttgctgggagatctatactctcttttatttaagtatacgacgttggttaaaaatggagggagtagtactttggaagtaaccactgtagttttggtacagcattgttcaagttgatttccgttatgatatttattttatatagtcggaccatataaaaaaatatcttcataattatgctcaaaatattaaagaaagttttctacgaattttaaaattttcgccattctaaaagaaggaaggcaaagaaacttttccacatacagacttctaaaaaaccgcatacacttttacaatgaactaggaagatagcccgcacatttgcgggggcatgcgcattagtatgtttcaaaaatagttctaacaaaacaaattaaaattaaagtaacttattttcaattttgaattgagtgttctttatatctctctttcgtgaagaaatctcaacaaactttcattggtttttttaccatcctgcaagccctctctttaattacttctcatatatgtgcaattagttatgcatgtgaatcaatatagatagaaacaatattttaaaaaatatttattgtagtacttataattattgggttcacctatttgaaggaaaacgaatggtttgtttttttatcataatttttaggatttttaatttatttgagcgctatatagcatctaggagtgtttgtagcacaccacgcatacgacaggttgagagtgtttgtagggagttatttgatttttactatataatagatagttaatatagcattgcttattgtttatgtactgagttgctagctagaaaatttggatataaaagtgagccggtgagataataggagataaaatgatgggtccaccatattaagtgaaaatcaatgatatgatgttttccttttttttctcagaattttttagatttctctaatttattagagggccac

SEQ ID NO: 32093 - DNA, 3190 bp, Oryza sativa
gaggtgaaaagttgaaatataaattctacctaggatagactgaagcaaagaaaaaaaaaggcaaacaaacaaacaacctgctggatgtatgggatggacatgttttaatgcaaccatattcaaaatcgaaccacaatgttgtgtacaaccatgcctattaaatgtgatcaaatgtgtggcttccacggttcttgcacttgaggtgtttgtttcatcagtacatcctactgtgaagtatacatgtatcaaagttgtctaaccttatagttttggattgggatgtctcaggagatctagccctacatagcagataatgcatactagggtaatatttgtagtcctagatgggcacatttgcataggtactggcaaaagatggtgattatctgtcaattactccgtagctttcaagtacagagtcagcatatgttcttgtgtgaagtgtagaaggagctgatgtcctaattgatgtatacagaacacatgtgaatctacgtatctgaagaggatgctatcagcgtcgaacatttgtgtcattcttcatagatcacactttcaatgtcaagtcgaatatgtttcctgttagcatatttctgttgtgaagtgcatgtgcattttatctcttaattagtagcggactttgttatatcctctgcgattctttcgtttttgcatcgtatactctaagacgtgttcagtccacgtaggttggcattgttggaggtaggatcgatcatgcccgtgtgtgtagaatctgcgtgtttatttctgctatataatgagaagagaaaacccaaaagctgcagaagttagggcagcaccaaacttgttgtttgtgttcctgcgctctgagtttccatgaaatcgtgtgcgtgtgtatttaggattagacaccaacgtttcctgcaatcttgaattgcctttgctccattgcccatatgcggcgatgagttttctgcttgcaatattttcaataccttgtttgtctgcacttccattatttcctagcaacccaatatttcagaaaaaaaaagacgtttgaaatttcaaaatggattgaaatatttttgaattttcttgtcgttgccgtgatatttgctgaaattgaaaacgcatcgtggaacttttactggatcgagtggaaatttaaagggtgaatagctaatatggtccctgaagtttcacttcgggctcagtttagttcttgagatttcaaatcgttcaaataagtcctccaaattaatactttgggtcaatatacccttatataccgtataaaaagaaaacaaatgtttcacacatgtatgatcgttttagaattgtcacttacgattgctgcagccaagcactgatcgcataaattcctttgtcggccacccttcacaacaatgttgagcctgggttggtctttttttttgtattttcttttctatatggtatataagggtagaatgatcattttattcataccgctgcatgcgagacgactttggcatgtttacgtggtattttttgtgggtccaaagactatattagcccaaatgattaatttggaggacttgtttggacgatttaaaacctcaaggactaaactaagcccgcaacgaaacttcagggaccatattagctattcacccgaaacaatacatcatctgatgattttctcttaagaaatgcatcaaactgtgtaagagagaaaactgaagtgatgccagttacaaccgttcagtaccattggacacgatgcaactgtcactggtagctcgagaaatggcctttaccatgttgctatgttggcaccaaattgtattaccacaccttgattatgttatatgtgaccagtggcggcactcggagacacgccgtaacaagacaagatctcactgaacgatgacctaggagggacccatcactccatcagggtgaacgttcatcggttaattctagattcgacaggttaagtagaacatcctcaaatgcagaaatggcctttaccatgttgccgtgttggcaccaaattgtattaccacaccttgattatgttatatgtgactagtggcggcactcggagacacgccataacaaggcaagatctcactgaacgatgaactaggagggacccatcactctatcagggtgaacgttcatcggttaattctagattcgacaggtcaagtaggacatcctcaaataccttagagaccagagagatcgagcattgaagggtgaataaacatgggatacatcggaacaaataggaggaagatgtagaatattgaggaagtcgaggcatctcacgtatgccaacctaaaaaggcaaagagattttgtttagagaagggtattttttacctagcttctacatccaaccggatatatgcggccatttaaattaggaacttagccccgcaaataagccaatctaaaattcaatcatacggagatttgaactcagaaccttgggtactacttaggtcaatacaatcactaagctacgtaccttttcataagtcaaatggcgtattgcatcttgttatatatgacctgtgtacggttcatacgattgctatgacatgttgcatattacttcctccgtttcataatataagtcattctagcatttcccacattcatattgatgtatgtctaaattcattaacatcaatatgaatgtaagaaatgttaaaatgaattagcttgtgaaacggagggagtacctcatatttatgggtcattccctgcatctacatattcatgggctcctttatgagctattacagatgacccatcttatatgtctttatgtggcagtggtggaatctgtactatcatgaacctgggctcatgggctcatagatgtctacctattgctggaaaaagccagtaaatggggcaaacatattattttgggaagacagttgtatttgttggggggaggagggggggggggggaacctttgtcacaaaaatgtccacacttatatagaatcacagacacacacagcagataacactggccaggtaaaacgaaaaggatgaggaaggatgggggagcataactttcaggagaattttgtcaggtaacaagttgttggactggaataacataaaaaaaatattatgacaatataaaggatgaaataatttggggcttgaccaaaaatggagtttttagtatcaaatctttcta

SEQ ID NO: 32094 - DNA, 13004 bp, Oryza sativa
acaaggtgtgctttgaacagattctaccacaggatcctactgacattttatatagggctcgctcatggatgaatgactaggctgttttgcagaaaccggtggaaaaacaagaacgactacggtggggaatccagccgctaaagcaagtcacaagtgagatgttcaagtcacaatatggatggcgagcaagtatcagaagactcccctggcaactgaaaatggaatggcgccttttcttcctggaagtagccgatggatgttttttatttttattttttgttaactgccactctttagatgtgttttgcggcaagatgtcttttgttatactatgaacttggagtgcaagaacgtactccctgtgttctttatcttgtaatccctgtcatttctcttaatggaaatggagggattttgccctttgctaaaaaaataattatttattatcatcaattttcatctgctcgttgtcacaaatgtacgacttgagaagtctcagccacagaatgaatccaacaggtccatcataaaaacaaaagaaatcctgccagccataatatatatatatatactatgtgagtacatgggtatacatctatatgttgtgtatgtaccaactcttggctacaaaagggaaccaagtggtgatcggttcaaccagccaataccatctgatacacggccttgccaatcgttgtatccagcttgtacaaaagaaagttcagatcaaaccaatatcctttggtttgaatagaaaaggatcgaatagaaaaggatcgcattgctgtgtaagaaatactgttgaatgggtcacatccagtttcccatttgtcagaactacatgcaaaccgattgtttgtttatttttaggtttggtaggcaacagggaacaaatatgcaagtaagcagggcattactgcgagctttggagatccaaagaacagatttgagatgagttcaggagcattgtgcaaagcgtctcgccacctacatctacgtacgtagctcataccgcgaggcgcagcaggtaagcatgagtcatttgactatgaagaaaggtgatacgaaactatctagttgttcatgcaagtcagcttgggcaagctgctaatcataaacatacatcaaggctggtatatgtactactaagcacgtggatacgaacggttgcctgaactttcttatgtgttcatgatgataaagtattggcattatctgttgctagggtgactacctttgataaaatgacaccttaaatgatacgggtggcagcagtggggaatttcggacaaccagaggtttctgaacccgtggaactcttgttttgaggacggttgaaataagtaaagtgattcactaattaatccccaatggtttggaaaatcaagttctccagcaagcaaagaatcgtataaatgtataaaaggggggaaatatatgtggtaaacaccgtcgagtaagtaaaaatttgtgaaaatcatatttaaaaggtttatatataaattaatgaaaaaatacactagagtttggtatagccacaggggcggagctatagtaatagggccggtgtcaggtgacaccgacgactttcgacaaaacgtatagcaaaactgcttatccataagttataacaccatgatctaaccataattagtatactatgacaccgatagacacgttatgacaccaacgaatcaattttctagatccgccactgtatagccatgaaatatatttccatccaatcttaagcctaaaatcaaattcaattttagaaggaactaaagtgacagcctgtacttttcacctaaaatctacgcttttttcagaatttgtaattttttaattcatgttttcatgggttttcatttcattgaaggttataaatgtcatgttcagattgtagccaaaataaccttatcaaagtttggacgagattgacaagattttttatgtttttaccagagttttggtaaaaaaaactaaatagatgtatgtatttagcaattttactaaaaaaaatagtatagtttgaaatgaaatcaatctaacaatcctaaaagcccttcctcacatgattaggcagtcaccagctagctaccgctgcttgcagtaggtcgtcttgcgttgctactgtactgattacatcatttgactaggtcgttgcacgcgtcagccggtagtccggacagaatttcagtagcatcattggtgcatatgccaaccgtcgagaatgtcagggatgatcagccaacgtggcaaatatgctaatttgtgttagtaaactaataaaaagtacatggacaactaaccggacttcatactactagcaagtagtgtatatatcagtcttttgctaatacaatattctcggtcaacatgctgcatatcgacatcgtacagtctttacatacataatatccatggcaccagtttggcactctagaagaggccatattaaagcatatgcatccatgtacagctagaaaacaacatagattcacatggcaccattccaattccttgctaatagatacactgacaaagtggctttatccaaagcaaaaatccgttcaaaaccatggattatcctgatacaaccattaattcatgccttaatatataaggttttgtacatgtttcatttgagtaggacaacaatttggaaatgtttataccggaaaagaaccattcaaatgtgaattatttcacatgctactcatgctgagggtggtatatatatgtattggcagtgtgcactgaaatactcatccatgcatgcaaagaaagcctgaaactcccaagaaatatggaaggagaagaagagagtgaaagctggccgccgcagctcgcaccgccgtcgtcgccggcgagcgccgtgctctccgacgaggacctcctcggcgagatcctcctccgcctcgagtcccacgaccacctcgtcgccgtcgcgatcgtctgcaagcactggctccgcgtcgcctccggcgagctcttcctccgccgcttccgtgtcatccacccgccgcgcctcctcggcttctgcgtcgacgacggcggcggcggcgacgctgggcggcggccgcagttcaaggcactcccgcagcatccgggcgtcgccgctgccgccgcgcaccggacgcggcaccggttcttcggcgcgttcggccacctcgccggctaccaccgtccgtccatcgccgactgccgcgacggccgtgtcctcgtcgagtcccccgacagagcgccgcggcggctcggcatcaacacgccgtaccgctacaccgtgctccggccgccccacccgcgtgaatccgtgcaactcctccctccgctgccgccgccgccaggccgcggcgccgggaagcacgtcgtcgaacgcgtgttcctgcccgaggacggcggcggcggcggcggcgaccatggtatcacgctggtgtacgtgttgctggtcgagcggagagtgaccgcgcgagtgcacgttcttgactccggcggagcgtggggagcgccaaccaccgcggagacggagctcccggcgccgtcgtgcgacgacgccgtggacaccgttctgccgccgatcaacggcgatgtctacgtcgtgacgacctccggctacacgctaggtttgcgtctgggcaccacgcgcttcaccgtcgtcgagctcccggacgcggcgaggtcctccgccaacttcaggatggcatggtcacacgccgccgccgccgccgacgacgacgacgtcgctcgcggccggctctgcctcgtccacggcgacgggacgcggctcagcgtctggcaccggaaaacgacgaccacggaggacgacggcggcgcggccggagttgggtggcggctggccgacacgttctgcgtgcgcgaggcgtgcgagcggatcgagtggcttcccgacggctggtggaccggccgtgtcgcggtgatcgccgtcggcgacaacgccgagttcgcgctgctggacttggagaacgtcggcgtcgtgatctacgtgcacctgcagtggaggacggtgaagaaggtctacgagaggaaactcgccgacgccgacgatggcggcggcggcggcggtgaccgccagccgccggtgagggtgttcccgctgacgacagtctggccgccaacgttcccggagttggacaaaccacgacagaattgctgcgtcagaagcccggacggtctcgtcggaggcgtggtgatgacgtgccacgccggctggtcggcgacgtcgccgtcgtgctcccgccgggatggggacgacgacgacgacgacgacgaggacgtcggagcagtgctcccgggctgttcgtgggccggatggttcgatgacatggctgcaatggtggcccagctcgctgaatgggccgcgcagcccagaagcccaagaagatggcgttggtcttgtctctgatacgacccacacatgacacaccagatactgtggcagctagccgagcgcgaactagacactgcgaccctgtagatcaggtgcaagctggatgccactgggtgtactccacttgtgaaaatcaatttctaagagaaggtgaacttaattacgacaactgtctcattttattggacaatcaacttaagaatctatctataattattggacaatcaacttaagaatctatctataaaaaccgtttattatagtcaggtgtttgacgcatttgtatctgaaaattgattttaaaaaactggcacccgtaaaaaccgagctgagccgaccggtagtctcaaacggataaggcctagaggaggactcggactctccggtttcctcattctttcacgctcccccctccctctctctctcctgcgtgcgcttctctctctctattgtcctagtggtggctccgcggcggcggtgccctcccctgcccgtcgacggtggtgaattttttgtgttagtgttgatatttttgagttcttggatgcctactaattctatgaattaaatgttccatggaatcgggatgaaggggaacagcttgagctgtttttttcccttgattcttgggacctcaaaggttctcttatctatgctgccttctaggtgccggttaggaaatccggcacctacgcagggttccaaccagcaccaatctatgtttatgtaatcgtgtctttttgctgcacgaatttgtttaattcatatgagcttggacgataatggcaaggttaattttacacagtttgtgttgatcagtatgagacatgtgtagtgagtacacataggacatgctatatttacaaacatggtctctactttgcttcatcatagcttggtttttaatttctttctgtacaatcagtattgcttcatttatatcttttgaagaaaaaaaaaatctaaaaaatgccattaacaaacgccaaattctaataaatatcatcgataaatgtgagttccataaaatgctatcgtgcgaacgacttatcacataaatgccattaccgttagggttctatccaacccaccccatcaaatgcacagttcatcttgtatcacttaatgaaaggctactaacggaaccctaatagcaatggcacttctgagataaaattacttatacgatggtattgcatagaactcgatgcttgttaatggcatttcttcgatttttttttctcatgttttcattgaacacatgtatgtctaaatagcatctttatgatatatatatatacttatgtaatatcctagttggcacctaaatcaataagattaagcatgtagtcaaatttgtgcttcaaaacaagtgttttaaattcgtgcactatattgcacccatctaacaagtttgtgtatcaccagtgcaatttacccttgaatcaactttacttttattggattgtttacccaagtagactttattggattaattgtgtgcccatggatatatgattatggtgggaggtttggggcttcccctactaagttccggtaaaaaaattgatattaagaggacattcctcatatatacacggtgaattcaacagactttctagggccaaatacaccacggatcatcaagataactctagggccaaaatatgctaccaaattgaggctatcattccacagaacgaaacaaaaattggaaaaaaatagcacaatttcttgagtaatgtaaccactgaaaagtactagcttgctgcaacaatggggggagtgcagtaaggttttgttctccgatgcttcctgccgatttcccttcaaaatcagacccaaatagcatttatgaatcaagatatattcgtgaatgagcacaaatgaaagaaattgaaattagaatgcaattgtttgactaaaagaacattacgagctaagttcaattaacagttacctggatctgtcatatatacaaccatgtgtttgttctgcatcaaaattaccagacaacatgcatgctgcggcgcatacattggaggtgtaggggatgcgaccatttgctgttcgccagctgccggagcttgcacttgggacacaagctaagaaaagaaagagagtggggaagaactaatgaaacgagaaacatggatctggacaatggacacatgattatgtggagaaaaaggtgttgtggcaccgacggtagctccatcgtctacagctcggcggccactccggaagctatcgctggatttgcagcacttggacatgttaatacgcacatttagctcttaaagtatgaaatagaaaactatagttaaatttaaaaagaacccaccctaggccgatctgaccacagctatcgggctgatctgatcggcggcatgtggtcagtcagactagcagagtccgattccaagttcgatttattggttcttggggcttcttgctaagacatgagattttagatttctaattggatatgaaatatatacgggaaagcaagtccaccactcctataaatataagggagcaaagaccgattgaaacaacaaccaatcaatcatcaaaatcaatttaatatcccaaccctctatatcctatatctctctccttttgtttacctatgccaagtctattctcctcaaaccatccaattgtttgtcgtctttcatctctatggtgttagacgacgtcctagccggcatgccgagtctaggacaaaccggtgtgtgttcactttgaagggatccctcccaagtgtttgttcagcagtatctacccgctccctatagcagtgcgcctctaggcgccacgccgcaggttgcacataacatgtgtagcaacacgattctacgtcaattaaatactcgttggtagctggtgtatggagctcgagcttggctaatgcttggtagttacgagagggcaagcactggccacccatggaagaagaaggggaggacgtagacaaaatgggtccaaaaactactgagcagtgaatttatatttgcaaggcaaggaattcttggcagggagagaaaaaaaaaaaaggaaagctaatctggccacgctgatgctgatgtggcactcctttgtatcctcctcgtcagaagttccctaggaacatggacaaactcctgtaccaagttctggtaaaaactataattggattaattgcgtagccatggatatttgatgatgatgggggctgtgggtcctcccgaaccaagttctgttataaaaatgatatgataaggacattcttcatacatggtgctaatgacattcaagaaaaatcaaatagaagtggaaatgtttcttagaattaatattatttcaattaataataatttgcattctatgtgaaatacaacataaacttttatgttggtggtattgcagtatatgcacaagatgacaacactcaaccgaatgtcttgaaatggagatgggtggtttagttactgcctggaagctattatagtaaagagggaagcacaacaccatggccaaggatgatggttcaaatctatgggatttcagaaaaaaaaaaagcaaaggcatattgactatccatggtacatccggaaaataaaaaactttgcctggtatatgagatctatttttttcaaaaaaaaaaaaacagagcagacaaaggagaatgttaatcggaaggaatcaatataatgtagcccaagctgcatggaattcaaggattaagtgtcttgggggattctttcattcttaggtattattattagaattatataaattgtgtaacatgacaccaaatgaacatgtgcaatgacaaaaatgacccaaaaccctatcactgcaaaccacctcgaaaaaagcctaaacccccaaatgggcaaaaggtggggcaaacccattctcatcctctccacactaccaccgtttccttcctcaagctcccgcctcctccctataggtcttcaaggttgagctctctccttctctcccatggagggacacttgccatgttcgctgagaaaatattttgtcccaacaaactgtatgttctttcataataaacacaaaatgtatcagcaatatgtagcacttgtaccacataaatgctttaattaggtccgttatgggtggttgcattccaaatatagcgcacatgtgattggtcacttaaaaccagcacgatgcaaagaaagataggaaaaacgtgtctgcctcattaggtcaacaaatattgtgggaaaagattcatcttttggcatgagaacctatgggacaattaaataagtttcttgcttcaaatatttcatatggtacagcatgctgaattgacaaaaaaaataattttccttgcatttaagatttttcttgtgttgaacatagatcttttttaatttatccactcatatattgtttttctagtagctcattttctagataggaatttcattgtttattagcattaagctggtaatcagatgcaacaaatacatgaaccaagactagtttgtagggatctagaaaagggaaaagggataatatgattaaaaaaggaaatcggatgatgggatacaaaatagaaagcaatgatatattggaatgtaaataaaggagcgacaccctccaaaattgatagttgaccatggtttctctggcaaaatatcatctaagaaaaagtccacctttgccatgttggccaagtaggcaaatgataatgagtctcgcattacttgggtgggactgaaaattcctaattggcctatgagaatgctgcaacactgttgaaaggctaagccatgtcaccattggatccagcagtgccgcttacactgctaccttcgaactgattgtaccccattgagccagtgccccttgcaacatccatcagccatccctccctctggattggtacctccgtgctcgacaatgagacagatgcaggtatgaggccttgctcacggagcttcttgaggcggtcgttgacaatcttgaggcgtgaatttgccatccttccgaggctgataatctgctcgatggtgagaccatcgaggcttgggtggcggccattgatggcttcaatgaggagtagcttggtctcgctttcatcagcttcgcgtcccagcttgtgcaacttctccttgagcttgtcgatctgcttgttgaggatgccctctaggtctatcatcttcttgtatctgcccagctgcggcatggccttgaagtgctcgagaactctggtcgcctcccacaccgacggccaaaccttcgttgcttgcacctcaacctcaccgtacaccatgaggaacagtgttgcgaactcactaaccttcttcatcaagcccttcagatgcttcctaaatgtcacccgccgcttcacatcaatgacgatccgcagaagcttcatcttcttgcgagccatggcctttgcagttcaccactttctagcaagaatgcacctgtaaattgatgagagatggttagattgatgtgaaatcaaagaaaggggaatatggtggatttatagtgggagatcatattgcaacaatcgccatgatgtggaaagaaattattttgcaaatccaaaaatatcaaatgaatcaatgtaagttaatgctttcctgaaaaaaatgatcggttaatgtgtagctggcgagcatatcttcaacctttaatcgtgtccgtctttagaaacttccttgcaggcatgagctagcaatagccaatagatattactcgctagatgataatgagttcacaccaaagatacgttcatccccagttcatcatatatgtttgagttaatcctctttcatatgcgcaataggaattcaatttacaactacagaaatgattttcgctacattcaaagagttccaaggattgatcctgtcacgatagctgccatcggatgggccatatctgccacagaatggatgatttcccccatcactcataaacttgtgaacaagggagccgccttcatgctcgctcgctgtcccagcttgcatctgttaaaaagcatacatagttatcttgttaagaaagagaacactagataactcgcaaaccgtatttttatcaactctactattattggattatttatccatttattgcagttgagtggagagaacagtgaagctagctatgtaatttgaggctcctattaaagccccattggtctaaaatctcaacatatttgttgcaagtcatcaattatattattaaaatttagtaaagccacaatgctcagcaaaaagaactagcaaaacagtactatattccaagggaaaaaagaatttacatctttgatcatgtagaatttagattgtatcaatttagactattctaccacctccacaacatcaattggagaaaaacaagaaagattaacaccgctatgttcgatgggtccagattttctcactatactgcagtaaattggtctgcctcaaccgtgtaagaaatatactagtataactctattttacagcgaagatagcgtgaagacctcggctagttcgtaaaattttatcttatatctgttcatggttttcaggaaacacaaaagcacatatgaagttggcttgcaatttgcacaagaattacatttggcagtttccatgccgtaatcatttccttcagttcttggacagaagttgactttttatctaaccagatcaactttgcttgcatttgtaggatgttgttccaagtgtaattatgtccaaaaatagcttgaagaaaccgttggagaaaatagaaactaccaacgctgaagcgcataagattgttgacctgccaaacttgataagcaagaaaaaaaatgacaaccatagaccaaatgttttgccatatatacatccattccgttgcagatccaccacgctaggtaatcggatgaaatatggaatgtcggtagagaaaaaatgtgctcaatgacgatgacaacccaagtcctggtgttattatgaactggcatccatggtatccgtggatctagaaagataactctcgcacaacatgtttgtgtcggatgcagaaaaagtccgctatttcgaacttgttacgtgggttaatgtttccaagaattttcatatagataccattttcacttagatgattgagcaagctacagggcaatcatgtcgtcggttgccctcagtatacgagactaactgccctaaaaaggatattgaagaaagccctggatcataacttgctaaattctactttccaaattaaattaatacaacactaaattaaaaattgacgataattacggcatcatagtattaactttgaattctacaaatattaatttttggtaaatgacaattaaagggtccatgctatttttattttgcatgttttatttaacacaaacttgaaatacaatttacgatcatcataatacgattttagcagccatactttttttagttattataagatcatcaagataatgtccagttaatattggtatgggtacttagctgacacaaaataagttgtgaatcaacataatgtaagcatctccaaccattaatgtgtaggatagaacacaagtaaccaaggcatattgactatccatggtacatccggaaaataaaaaactttgcccggtatatgagatctattttttaaaaaataaaaacagagaagacaatggagaatgctaattggaaggaatcaatataatatggcccaagcagcatggaattcaaggattaagtgtgttggggattatttcattcctaggtaatatttttagaattatataaattgtgtaacatgacaccaaatgtacatgtgcaatgactaaaattccccaaaactatatggctgcaaagcacctcaaaaaaagcctaaacccccaaatgggcaaaaggtggggcaaacccattctcaaccgctccacactaccacattttccttcctcaagctcccgcctcgtccctacaggtcttcgatcaaggttgagctctctccttgtctcccatggagggagcacttgccatgttcgctgagataatattttgtcccaacaaactgtatgttctttcattaaaaacacaaaaatgtatcggcaatatgaggcacttgcaccacataaatgctttaatcatgtctgttatgggtggttgcattccaaatatagcttacatgtggttggtcacctaaaaccagcacgatgcaaaaaaagataggaaaaacgtgtctgcctcgttaggacaacaaatatcacgggaaaagattcatcttctggcataagatcctgtgggaaaattaaagttttactaagtttcatatttcaactatttcatatggtattgtaggctgaatcgacaaaaaaatcattttcctcgcacttaagatttttcttgtgttgaacatagatctttttttcatttatccactcagatcttgtttttctagtagctcattttctagataggaatttcatcgtttataagcattaagctggtaatcagatgcaacaaatacatgaaccaagactagcttgtagggatctaaaaaagggaaaagcgaaattattattaaaaagggaaatgggatgatgggatacaaa

SEQ ID NO: 32095 - DNA, 702 bp, Oryza sativa
attcctgcagcccaacatgatttttggacatattggagtgtattgggagcgttcttggcaaaaattcacttcgtaattcgcgcggcgaacttttgtcaattaatgccaatgttggcacacgagggtgcgatgtttttgaccggaatgaaaatgttcaaaaagcagcaaaacaagattttttgatagattggagtgtaaagggtccgttcgtgccaaaaactcacttcttaattcgcgcggcgaacttttgtcaattaatggcaacattggcacacgagggtgcgatgtttttgaccggaattagaaagttcaaagaaagccaaaacatgatttttggacatattggagtgtattgggtgcgttcgtggcaaaaactcacttcgtgattcgcacggtgaacttttctcaataaatgcgaatattggcacacgagggtgcgatgtttttgaccggaatcaaaaagttcaaaaaacgccaaaacatgatttttggacatattggagttattgggtgcgttcgtggcaaaaactcacttcgtgattcgcacggcgaacttttttcaattaatgcgaatattggcacacgagggtgcgatggttttgaccggaatcaaaaagctcaaaaaatgccaaaacatgatttttggacatattggagtatgttgcgtgcgttcgtggcaaaagctcacttcgtgattcgcgc

SEQ ID NO: 32096 - DNA, 678 bp, Oryza sativa
attcctgcagcccctagcggtaaaacgaacctaccatgtcctctacaagtgctccctagaagaagacgtggccgctcgcgccactggaaatcttcgcagtgtgcgtactctcgctagtacagaatatctctgttatgtgtttcatcgtccctgttgcttcgagctaattaatctactacgtatcctcgtctgcttcagcttctgcttgctctagtgagcacctacaggtacgacggggacgaggtgaacgatgcattggctaaatcggaggcaaagattctccatgagactgtaacgaatggtgacacagatcacggcgaactcattcggatagtcggtacaagaagcagagcgcagctcaacgccacattcagctggttcagagatgagcgcggcactagtatcaccaaggtttacttgagcttcctctgtccaaatatataatatgcctgatggttaacgcagctgcatgctccgcgttttgatcaccaggcactgcagcatggagctgatccaacaggctactcgcacgcgctgcgaaccgcgttaaggtgcatctctgatgcgaacaagtacttcgtgaaggtgaggatgagctagctagctggagtagtagcgaagcatcgagatagataaactgaagctgaactgaatttcgcgtctgcaaattgtgcacgt

SEQ ID NO: 32097 - DNA, 511 bp, Oryza sativa
cttgcaagattatgatcatgtaccttatttgcgtcatgttggtcacttgccatgtgttgtcgaaggtgaaaatgtccacattgagcacgaacagctccaaactctttgtgtaaccctgccatagttagtagcaaacaagaaacatatacaagaatatatacgttcctatcaactactaggtagtggaagctcacaaatcacacacactcaagctttttatcgagctcttacaagttcttaccaatgcaaactagaatatggtgtccacaccgactcaaccaaacactcgatggagttggatgtatcgacactttggcacacatgttcacaatctgtatagctgcagtcaaatctgtggagctctgggtaggcttaaatatgtagcaagtatggcaaatggttaaatcagagaatgcaaagttgaataatcgttcaaagtcaagtatcgtgctggtcctaggctagaacgaactagagacgcgagcctagaaacaaacaataccacaagata

SEQ ID NO: 32098 - DNA, 666 bp, Oryza sativa
cctgcagcccctggcatgggcaggatcacaagaagagaaaccgtggaaaactacttaggacagagaattaacttttctactaacttaacttttattgatcttaactgagtttcattattacagaactgaagactctcacaccactaaactcaccaactacctaacactcgaaagcaaacaaacgcatgcacttacatcccaccactgatgtaaaccacatgcaggacccacacacacaaccaaacttaaaacaagcaaacgaacacaacgatctaggacaacggcttgacaaggcactctaggtcttccgggcatcggagttgattgaaggctcgttcggctcgtctcaatcatcttgagtagctccccactcgacctttgaatgggtgcgcttcgattcttctccttcatcatcacttacattgacgaccggaggatccgctagggctggggtaacttctttctccaccacacggacctttggtgccaattggtagcgagggacgaatagagctctcttcgttgcggtaagacgaatcctggccttctgcggtggtgcttctcccatcaacgcggctagttccttctccaaacgatccaccttgtcctctaacctgcaaatcttaccacgattccgatcgtcacgatcttgagctgctagcacaa

SEQ ID NO: 32099 - DNA, 697 bp, Oryza sativa
attcctgcagccctctcgtgtttcttcctggcacgcgatctttccacacacagcgagagcttgagatctcaccctaagcgcccggccgaaccggcaaagggggcctgcgcggtctcccggtgaggagccacgagctccgtcatctggcgcgccaggtaggggtctcagcgtgtgctttctgagctctcagactcttccgtgtgccccaagtttttcttgttcagcctaatggccgagcaaggaaaaacgcacgacatctcgccgagtgtgagcggcgacgacggggagccgaatccacgccgtcgagctcgtactcctccacctcctccgcgccaaagtcctaagcagggggaggcgcttgagagggtcgacaaatccgcggcgtcaccagccgcaggtgatgcaggagaacggcgagatggggagcgtcgcctcctcgtctacggcgacggcagcacgcctcagggcgcgcttcaggctgctggcgcgctcctacgacacccgcctgtcgtccatgacccggagtctccagcccaacgatggctggaagacgtggccaacttggtcatgacggctcagcagcgcttgggtgctggtggacggtccgccaccaccaagacctccggcgccgctaccaccggctccatgtcgtcaaggcggaaggcgcggcgagcggcggcggctgcacctcattcgg

SEQ ID NO: 32100 - DNA, 681 bp, Oryza sativa
ttcctgcagcccttgtcccctggatgttggtgttccagccggataacatgggctccgacgtgatgttcatcaggacgagcggcgcgacgccaactgcggccgaggtgttgacacggccgaaggcgtccatgttgaggatgtcctcgtcggagaagcggagggcgcactcgtcgtagaagacggcggcgtccttgctgagcgggcagagccgcgccgtcgcggccgcgtacgcggcgtcgacgcagccgctgcaggcagaggcgttcgcgtcgccgcggcagagcgcgacggcgtagacggtgtccggggcggcgccgcgggagcccttggcgaatagggcgccgctgctggagtcgccgcttacgacaaggaatgatgaggagagaaggctgtcgaggttggattggtagatgctgttcgccgtgtatttgctgctgccgcagatcatccagggctgggcggcgaccataggcatcggcaagaagaagaagcagcagccaaggatgagcaggacggtgagaatcatggctagctatgctgcctcacgcgtaagcgtaaggtttctctgaatctcttgcattccaaagacagggtcgcatgttaagcagatcgaggcagcgacgacctgtgtggacaagtcactgctatcactttcatggagcgggtgcaatgtatagtaca

SEQ ID NO: 32101 - DNA, 473 bp, Oryza sativa
gttcactgtatcgaataacgcctaactcctatgtggatgatttcgagaagaaaagagaggctccataccaggagctcgatttgtagttttctacgatggatctctcaagtttctccattaatcctcctgcagatgggctcgcgactcgccaacgacgtcttcccgttgttcaccaggggcccttggcccttttgacgatatttagtttttgttgcaattttaggtgctcatttttcaacacccccccaaacaactaatatattaacgtgcaattcatttgtgcgttaaaaaaaatttcacccccaaatccgtagatctagattatattttttgcatgtgttttgtctctttagagaaatccgaggtcatgttcctgcacaacacaccattgtgtttgcaccgctagttgtggtagatctatcggctggaggaagaagatgatagatagtggtctgactagtgcatttacacgg

SEQ ID NO: 32102 - DNA, 1710 bp, Oryza sativa
taggctagaacgtactagagacgcgagcctaaacacaaacgataccacaggatagcactagaaacaactcaagcacactctgatatatgaagttcagctcaaagataacaatattttctcttttctttctttcttctttcttttttttctttcttttctttttcttttcttttcttttttggtgctgcttttctttgctttttttatgcacctttctgccttttttttattttttttaaaaaaacaaactcaaggacctcaatgcaagattacagggactcaaatgcgaatctaaaaattacagggactcaagtgtaaaagttcaatcccaaaattagaactatacaaaaatggaatgctctcgtccctcataggttccgttgtttcaaacggatttccaatccgacacttgaaaaattttcaccatggtgttgagctactcacggtattgggggaaacaactgtagatggtggggaggtgcgggtacagtgggtggatggatcggccggccagattaaatgaatgagataaatcagaaactgatttgccgatccaatgtattattattttcctttccttccaccgaaccgaatccaaacagatatgctatattcctttcccattttttcttcctcacggcaaaacataaccacggcacaaacacaagcccgtctaaacagcataccctagacgcaacttcaaaactaaccgacagaaacttctgaaaactacaaatatggaactctggcggaaagacgattccaatttcgtaggtcccgatgacaaccaagacacagcggctgcgacgacagtggtacaaaacgtgactagaattcgaaactctaaacgaactagacgctaagaccagcaacacgacgtgacgatgcaacacaaaattcaacaacgcaaaaactgaaaagaacaatacaatggcacaaagatggctaggtacaggatgcaattttttttgtaggaaaattttcaggttatagctagataaaaactcaccgagcaacgaaagctctgataccacctgatgaaccctgagttccactcgacactcaaggttgttgtttggcccgatctttcagtgagttgagacaactacgatttgggagaaacattgacgacccgactacaaccgtacatgacgttattgtgttgcgccctagcgatcgatacacctctctgtgggttgttaatcttgccggtgcaaatcaaccatattcctgcaagcaaatcgaagaacatgcaagaacaagataaaagcaatctgatattgcaaataagaatgaatacacaagataagttggggttccgaagaacaagcagacggacagtctagccgatacacgcgctgcaagcaagtagcaatggctaaactttaatctaacaaaacccgagaaaccctgaaggggtacctaactatttaaggaggtgggaggaccctaggtcgtcctccacctggttggggcgcaccccacatgggccccacttggccggggtcccaaacaaagttacaagcccataggcccatgacaggtgacgcagcaccttgtttcttcatttgtggatgacttggatggaatttggtgatgaggccgaatccaatggaaagaggactccgagtgctttccattaagtactcacggtccaaaacggaggtcgtatgcagattcggcggccgtttgaagtcagcagcgtagcag

SEQ ID NO: 32103 - DNA, 751 bp, Oryza sativa
agaagaggatattgagaagaccgcattttccacgaggtatgggcattatgagtgtagagttatgtcttttggggtgaccaatgctctggcctattttatggaggcgatgaatagcatgttgcatagctttctagataagtttgtggtggtgtttattgatgatattctgatttactcgaaagatgtagaggagcatgagtgtcatttgaggatggtgctagggagtttacaggaaaacaagttctatgctaaattaaagaagtgtgaattttgacttcctgaagtgactttcctagggcatgtaatcgatcagcagggtatctcagttgatactagcaaagtttcaagtgttgtcgggtaggaaaggccgactaatgttaaggatgtgaggagctttttgggtatggcagggtactaacgacgcttcgtgaaggatttctcaattatcgctaaaccaatgacgatgctcgcacataaggatgtgtgaagtttcaatggacggaccaatgtgagcatagtttccagcaattgaagtagaggctggtaactgctccggtgcttactttgccccaaccttggtaagcgtttcactgtctattccgatgcttcacgagtaggccttggttgtgttcttatgcaagagggcaatgttatatcttatgcgtctaggcagttacagaagcatgagcagaattaccccactcatgatcttgagcttgcagcagtggtctctgctcttaagatttggagg

SEQ ID NO: 32104 - DNA, 670 bp, Oryza sativa
cttattttgttttgttcaggcttggtattccttccaaaaacacgtaaaatttcttaagtcgaatgaagcccacttattaagatggaagaccataccagaaagctacaaaataaggccgacatagctagcgcagaagtccacaaatcggggggtaacaaacagaagcccaaacccgttcaaattgctcaataagtttgtgcagaaaacatggattatctaccaccataggttataaaatcaaacgggtacaaatgtgactgaaatttactggaaaactaggttcaaatatttggtgacaaaagttcattatttgcatataaaagggtcttcaaattgtgcccacatgtcgtagatacacgagaacccatatgttatagacaacgagtgataaattcttaactgccacatcttaaaaatggcaaaaaattaaatgccctttttgtctcgattgtaaagactgaacaagttattagttccagccttccagaaacgaaaagttattcaacactagcactgttttctctttgcattgttccatcggaaaaactttgttgatccagtgaactatttttatggtgcaggctggggcactgatgagcaggcagtaataggcgtattagctcaccgggacgcaactcagaggaagcagatcagactgacctatgaagag

SEQ ID NO: 32105 - DNA, 19959 bp, Oryza sativa
  unsure (1)..(19959): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccctagctccgcgttgcgatccctaatctctatgttctctttgtggattttcttcacttgtgcgcgagcatatggatcgagggctccggcgacttcacctcatcttcttgatattggccgggagccctcacaattggagggggcgtcaagtgatgcttaaccttcataggtggaggtctacgggattctgctgccccctccttctcctatgtcgttaaaggccggagtaaacccttgccatacccaccgccgggagttcgcactccctgaatgcagaatcgctcctccttcggagtggatggagtagcggtgggtgtgacatacttatggaacacctcattccctgccttggtgaacagggtgcccacatagcgctcggcgggaggcggcgcggccttcccgtcatcttgaaaaaggcaacgtgcctttaaaagaccgagctctcccgttgtcggccgacgcgcaggcgaatccccccgaaattttgtctttgtgacatggcgaggggagagggatcttgctactgaacggggagccgaacggggctgagaagggttcggccgaaccagggagctcgccgacgggctccagaatcgcaggggagcccgacactgttgcgaggggctgcgcccacagtgcattcaccccttccatggtgtattgctctacagggatcaattgattcgccggtgtcggctctccgtcaaggttgtgtgtggagttggaggaagagccaatgaatgggatcaaagatttgccagccattggtgaattagaggtgatggagaacggaattgagatgagaagaagaggaggtttgcaaaagtgggagagaggaagaagaacagggttctgggtctgatacgactgatctacctccgaatgcgcatcacaacatactatagacaagcgggggagactgaggttcaaaattggggctgatcgggcgcctgtcacaccctgaaaatcgctaagttataaatcgttgtgaaaaaaggaatttttagaaattatttaataattaaagtaattgtgtgaataaaatctatgaaatttttgaaagttaaattgatatagataaaattttattaaatactttgtgtgcccaagtattttcaggatttttcttggatttatttgagcattggaagtatttttaataaatgaaagatcatttcagtaattatttaaattaaaaagttgattaaaatttctcttctgtccactcctctcctgtctctcttccttagcccgcagcagcccactcttcctttttgtcttacttagataaagtccattttgggtccctcttgcaatcaggcctagtaaagaaaaggaagcccgaaaagaagtctatttgacagagccagttcatcccgataccgcgccaatctccaccgaatccgtcgcatcccgtgctctgtttccaaaattggttgcaaaaacggattcccctcgatctcctctaccttgtccctaagaaacccctttgaataccgttgtatatcgcgtgaattcgatgcggttttgagctccgtttttccggcgaaccctaactaatccgtcgccgattcttcccgtaaccgagccgatctctccctcttccggctataaatagcagtcccaagacctcctcttccgtttgctcctttttcccgaatttttccctaaccctagagccgccgccacgctcggctttgctctcctatgctggccgccgctccagccacgtcgcgccgcctcctcggtcgaccccgacctgcgccgtcgcctcccttggcttcgcaagggtgagagctacctcggccactggttgttttgcgccaaatcccaccagaaggttgccgtcgccgtgaaccagtgggttattgccgtggtttggtctccagccgtgtcgttcgtcgtcgtccatcgtcgctttcggacgccgttgcttccactggattcgcagctgtgaggagaagcccgtccacccctccgttgccgccgcttgtcgccggaaagccgtcgccatcgtcaaccaaggtcgccgccctttggagctcatcgccggccatctccctcgccgtctgtcgtcgcgtaagtggtggtaagggccgtgcttagaaatattagctcattaatgggataaattatgcttcactattacttatggttctattaaatggtagctcacgatgggcaatcgtgttatgataattaattgataattaaaatatgattaatggtgggttgtgagcacatggttttgaaggttgtgctcataacaattaaggaccggttcgcgagctactgttgtgaaacattaaccgtgccaaccacaagccagcgtgggcaacggctttaccttttgtatagtatggttcattacggggtgccagactgagaagtggtggagataagcccacgggggtcgctggggagtccatgcctctggtttttgagggggtgactacgatccaggaaagatgcactgctttgagttgagctatgcgagaggtcttgtcacaactacacaaatggtgacatgttcagcatgggcacatgatgatatggtgacatattgtggagttgtgtcttgtgggtacagtggtacacctctggcttgagtaaaactattcgaatagccgtgcccgcggtcatgggcgggtctaacaatgtctttcgtgattagtctcatacttcttaccataataaatgatgctataactggtaataatttgattagctcctggtttggaatggtgcattcctggtttggagatagatctttacagccgggtatggttgttcaggttggttgggcctgtgcagcatgggtgtgctgttcagtgttgattaatattgatgattaattactctattcttttacaattcttaaatgtttgctaaatgctgcttttgcaaatgagccatatattttgccattgtttggtatccttgtgcacctgcatatttgctgtgtggcttgtcgagtattccatgtactcaccttgcaataatcaatcaaacctcggttgaagacaagttgcgaaggagaagacgtttggcttataccctagttgagctgcctgtgggagtagagtcggagcttcgctagaccgtaattccgctgttgttttctcttttcttttgtaagtatgtaacgttattattatgatgaatctgtatattaaattatcggtttgtgtacctcggctgattcctggacgaggatttcatgcacaaattagttcagaaattactagtgaatttatgggcgtgacaagttggtatcagagccatctcgactgtaggataagtcaaatggtcaaactttaaggaggaattttccgaaaacatgatttgtgaaaattttcctttcttccttctccagaattctctgtaaatcattttatcatcctctcccctcccgctttcaacttgagtagttctgaaactagttgtttaaacttgaagacatcgatgtggtcttcttatggagattgagtcaagtggatcgaggaaaatgaagttgatggtcaatctgaagtgcccaaatgtcaagatgggatcgtgcattagaacctaaaccaccaaagtgactctaaagaatagttagtagggtagaacgtttgttgcttgcttctttgtaggtattgttgcatttcccatcattggtgttgttcagcgatgagcatgtaacgatactaggttgcttgtttaatcaacttaaacaatataatggtctacatacaccagattagtattaacctggttaaggtctgtctttagtgtaacccctctctttctatcttctctaatctgcaacaaatggtgaacattcgcgccagtggaagtgggaacaataacaatgaagggaacccaactcttactcaagttcttgctcaacagactcagttaatgaacatgatgatgcagcagatgcataaccagctcaaccaagggtacaacaatgctccactaccccggagcaagctagctgatttccttcgtgtgaggccacctaccttttctaagaagcaggtgattggctgcacactattgagaagaagttgaaattgctccagtgcactgatcaggagaaagttgtattcgcttcacatcagttgcaaggatctgcttcagaatggtgggatcactttcggatgaacagagcggaaggacaaccaatcacttgggaagagtttaccgaaggattcaagaagacacacatacctgcaggagtggttgctttgaagaagcatgagttcagggcattgaagcaaaaggatcgtaccgtgatagagtatcttcatgagttcaaccgtctagcacgttatgctctagaagatgtgcgtactgacgagaaaaggcaggagatgttcttggaaggcctgaaggatgaactgtcagttacgttgatctctcatgactatgctgattttcagcagctagttgacaaagcaattcgattggaagataagaagactaggatggacaaccgtaagagaagaatgactgttttccaggaggcacagggtagtagccagaggcagcgtatcaagccactccaagttggtgaatcaggtctgacatctcaagaacaatcgcaacagatgaacatcggtggtgagatcaattcagagactaatgcaagcaatgaagttaatatcgagcaagctactcagtcggagccagttcagcaggatcagtctcaagaaggtaatagtagtgcaagggagcagcgggtatgttttaattgttatgagccaggtcacttcgcaagaaagtgtccgaagccaaagcatcagtagccgcaaggtcaagtcaacaacattgtcgtcacaggagccaatgcagtgccagttgcgtcttcaagtgttacagttcagccaccagtctcaaatcagcagtagttttctttaaagccttagaataattatcggagttatggaataggatagactgtagtttagccgttccgaatcacgggacgagattctttgtaaggggggtagatttgttacagcctaaatttccatttcaggatttataaattgttaatagaaattatattaaatgttcattaatttacaagtgaagttaaatgtgggaaataaaatttcctaagtataaagcatggctggatttaatttttattaaattctctatgattaattatactctctggaattttctcgaattttccagtgctcaattcctaaattctaataatacaaaaaatatttcagtaattcgttaatcattaaattaatcaattaatgatctaattataattatgttaaatgattttcttgtttaaaaatccttaaattataaattgttgtttaaaaggaattattagaaatgatcttaaaagcctaaaagagaatttctaattttaattctctaaatatcaaaataaaagtgggctagataaaattttattaaatacttctctcatttctatagttcctagatttttctgggatttatttgagcaaaggaagtatttttaataaacggaatatcatttcatgaataatttaaatagaaaaaggttttaaatctctctattggctttgggccgaaagtcggtccaagtctctctctccccggcctgcgtgtgctcggcccagccggccaagtccgccacgccctcccttctctctctcagccgctgataggtggggcccacctgtcagtcgtcttcaacctccggccgctcctagccgcgttgcaagccgccgcctccttccaaaatccggccgccaccttccttccccggccaaatcaattgaggggaaataatctcctcgatctcctcttccttttctcttttggaaacttcggctaatttcgtttggaaaccgacggatttgagctcgattcggatcgatttttcttcctccaaccatagctttccttctcggcgccgatcgccgtgggcctccatcgacacacctagacccctatagaaggacctccgggacctcctctctgcatcaccatctccaccttcgactgccgccttctctagcgtcgcctccgcgtggttctttgtatcgccgccgccggcgggtctccagtcggtcccgctgtcgcttcggtcatcgccgtcggtcgccgtctccttcatcagcatcgcgatgtcgtcgccgtcctcgtcccgtcctccgtttccgccgcagatcatcggagcgccgccggcaccgtcgactcgaagctctccaccatcatcgtcgatccagccacaccgcgccgccgtctcagccgccgccttcggtcgctgtcgccaccgtcgagatcgcaaggaggagccgcaccttgtccaccccttcgttgccgccgtttcccgccggagcactgccgtcaccactgactcgaagaccgccgccgtctcagccgccgcctttgtttgccgtcgcccaagtgctcggtgagttcactgtgccgatccctacctgttggtgccctccgtttgtgctgacgagcatagtgtgccgagccgctgtcggcgatgacatcatcgctgatgtcagcgctttgtcagccgtagacccgtggtagaccggatcgatctcggccgtccgattcggtcaagtttaggtcaattagatcttggccgttggttccgtggaccgcttctgtgaacccggtttaccgtggaccgtccttgatgacgcaataaatctcttttccttttcaaaaataattctttattgcgccataattcaattaaaatccatataaatgctttaatgcggtttattctttagaaattcataactaatacattgtaactcggtttaatgcggttcaagttgcaaaagttgtataaaataaagatctatatattaaaattatcaataaattgtgttaaatttattcaatcctttttaaataggctttaattatatttaatcttgtaaaattggtaattaattcttatgaagtcagaatgaggccgttcaagtctcataattgatcaaaaattttgatctacatgtttgtttactttatatgtattgtttatttggtttttattagtcttttttctcgttttgcgtgttagcttgtcgtttccgtcgttttgaaggatcgtgagtgcgtcggaagtattcaagaagattaattgaagaccctttattgcaaggcaagtcacacagatcccaaacacaattcctttgagcatgttgatcctatatttaaattctctatttatttcaactgtacatttattttcgaatgtcaccggctggtgtgaaactattcctttgttatggccactttgcattgattactctatcctttgataccttggattacaatttgactagttgtacttatataatggttcaactagatgtattagatgtaattgcttagccatgcttagaaacattagcacacaattgggataactaatgtttcactattacttaatgatggatatttaattgtatctcacgatggttaatagtgattggttaattaattaatttgccaactaaaacttgataatggtgggatgtgagcacatggttttgatagtagtgctcatgacaattaaggaccggttcacgagtttcggttgtaaaacattagccgtgccaaccacaagccagaatgcgcaacggttggacactttgtatagcaaggctcattgtggtgtgccagactgagaagtggcggagataagcccacgggtgtcgctggggagtccatgcctctggtttttgagggggtgactacgatcctggaaaggtgcgctgctttcagttgagctatgcgaggggtcttttcacaactacacaaatggtgacatgttcagcatgggcacatgatgatatggtgacatattgtggagttgtgtcctgtgggtacagtggtacacctctggccagagtaaaactattcgaatagccgtgcccgcggtcatgggcgggtctaataatgtctttcgtgattagtctcatacttctcaccataataaatgatgctataactggtaataatttgattagctcctggtttggaatggtgcattcctggtttggagatagatctgtacagccgggtatggttgttcaggttggttgggcctgtgcagcatgggtgtgctgttcagtgttgattaatattgatgattaattactctattgttttacaattcttaaatgtttgctaaatgctgcttttgcaaatgagccatatattatgccattgtttggtatccttgtacacttgcatatttgttgtgcggcttgcggagtattccatgtactcaccttgcaataatcaatcaaacctcggttgaagacaagttgcgaaggagaagacgtttggcttataccctagttgagctgcctgtgggagtggagccggagcttcgctagaccgtaattccgctgttgttttctcttttcttttgtaagtatgtaacattattattatgatgaatctgtatattaaattgtcagtttgtgtacctcggctgattcctggacgaggatttcatgcacaaattagttcggaaattactagtgaatttctgggcacgaagattctattgtctacaacgaacaagatcgcataagttaaaaatgcatcggcttgtagttgataaaattaacagaaggtgagaattttaccagtgggacatcgtcagggaaaaggtttgtcaaatacatggacggtgattgatggaacaggtgttttttccattctatccaccatcggtcaaaggccatgctcctgaatgtccttagtttgatgttgtcaatattgccaagaggtggtcctggtagattcagcagccaatccatcatatggaatgatgaaatctctcctctactttgaatcctgtcggcaaagaataggctaattggcagttgacccatgccgaattgccttgcagcgcttgttggatgatagaattcgtaggtcatctggatattcttatcttgatagatgccaacagggatgatacaggggctgatagctgttgagaatacttctctggatttatcatatttttcagagttgatttcatcgaatcgaaaatcacatgttagttcaaagctagcagatccttcatatgcaaaccagatcctatcattcttggggaacccatcatagaaattgttgaaccactccttgaaaggttcggtcgatagcttggacacggcgctaaccgatgctgcttctccgaaggacatacatcatcagcatgtggtgcttgtttctccatcgtccctgacgatcggctcaaatcttgggaattctacattggctagtgctggctgattggcaacttttctggtatgaagattcagccaaatttggagtaaccacgatggaccccctgtgccgattgtttttccagaggctatcttgtcaattgcagtattgagggtctgatacaagtagcccagcagatacttgccaaggggaaaatgcttcttttctaccagattttcatctacccgttaccagtttgcggtcggaccataggttggaccacagaataagaacttttccagccacatcataagaaaagctgtgttcatggcaaccggcccagtcacatcactcttggggtaaccggcctagttcccatcttcttggcaacataacctgaccaaccacctatgcttctggttttgaactcatgggtaagttaggtgttcaggctggacaagttagctgatgaagtgatatctagaccagtgatcatgatgatatctaatagtattggggtcatcggtccttgagagaaaaggaacgtgttcatggctgtggaccaaaaataggtggatgctatcatcatgggttcattccttgccatacttgctgcagttaaggccaaagcttgcgatatgtcgatttcgtcccagtgggctaatttgctagccaacatcctcttgtaccaggcaagccagctgacttcggttgatggccaggatttgaaggtgcctttccaagggctaagatctggattggcaaatctaaaggggattcggttggtttctccattgatgaactctatggggtctaagttgccgattgggccaaggaaaaactggaattcatcggctacgctaggaattgcaacctggtgggtgagatgctacagaggaggaaaatcgaggattgagcgaaagaagaaccaaatctatgaggaaaagaagggatttagctgatgggtacttacttcgacgtattcggtggccgatgagctcggtggactagcgaaggttgacattgtcgttggcagagattggaatcgtcggaatcgtctgcggatcgccagaaagcttgaagggtgtcgccggagaactcaaaggagaatattggggaaagtttttggctagagcggttaaaacggaagtgacgccgtgaaacgagaagagcggtggttactatttaaaagggagcgctgtaacggccaaaacggaatcggtttttgaaaccctagatcggctcggaaaagaaatttgagaaaatccgccacattacaaataattacaaatatagcggacttggggggcatgtgttgacgaccaaatttggtaagatatgaaccaggttcgacattggaatcgaggcggattcggtaaagagatagattcgaagaacagagtatgcatcggctgcaaaggcatcggctggagtctgcatcggctaagatggatcggacagaggacatccgatacagctgatagaggtgatgtagccgattctgatgacgatggtttcaaggatttttctagaaacgatcaaagtgcttcacgaggattgccacgatagagataaagctcttggataggaaattgtatctattaattaggatatttcatgtaatttccttagagatatgtttgggcaaaagtctgccgcaaagacttatggtattttagagtttgttagagataagtgtcgtgtccggcagggacatattttgtaatctcgggtataaatagaacccgaacccatgtaatcaattatcagacgatcaatacactttcggtgcatcgccaccctttttacttttgttctatttcgacgagttcttactttcgggttgagcttcatcgattcgatcttcaactagaggtaaacttgtcatgacggcttgcgttatcaggattagtgcttccatctttatgacactctaatcctgttcatgtaattcatcgagttatcataaatataatctttgtgagcgtgcgggccgacgaggcggagccggaggtggctggcgatgggtagaggcggcggcgctcctcgaggaggcgaagcggatggcgctccggcggccttccgcgagcgggaactcgcggacagcggccggaagaacctggagaagaagacagggagtttagggagcaaagaacaggcacggcgccgagggaaatgttagccggaagcggcaaggatcggcgaagctcaccttggacggagggaagcggtctctcacgatgattcgcgaggagggagggctggacgggctacgcacgatgactgcggtgccgaggaaggcgacgacacagcgcgaggtggtcgggaacggcgtcgagaggcgactagaggtggctgctatggtggcggttcgggtggtgtggtggagtgacggttccagcggcggaatggaggagcggaggggatgccggggtacgacatgacacagcgaagccgtcggtggcggttgcgcggagcggtggtggcgggagcaacggtggcgaccggctagagggcgtcgacgggcggcggagctcgggcgcgcgttgcggcagtgtttcggaggcggagacgggaaaaggagtaggggccagggtgtggcatggcacggcgatgcaaatggtggtggcggcgtggcgcgacggcgtctggagcggcagtggcgtgcggctggaagcacggcggcgagcggcggagctcgggctcgcgcggggagagcgggagaaggcccgatgggctcaggaaagttggggaaacgagcgaggggagtgtggggaggagttttatgggcgcgggagggcgacagtgggctggggcgatgcggattcggggcggcaaccaccggcggtgtggggtggcgacgtgggcgcgtggcggggcaaaccggtgccgttttcttggtggaaaattggtgaaatggtggaggaggtggtgggggtgcagttccaccacttgggcgtgagcgggaggggcggggtggtgcggattttgcgacggagtgggcgacaatggcggccacgggcggttgctggcgaggtggctggaggaagggggaggagctgacaggcggggcctcgggtccacctgtaggcgagggaaggagagaggaggtcggggggcttatgtggacttagggagagagggggagcgagcgggccgagcggcccaaagaggagaggggtgggaggcggccgggctggaggggaaagaaggagggagagggattgggccgagggcggcccaaaaggatggagagggaattttatttgttttttctttttatgtaattggttaaatgaactttgtgactttaaaatcatttcatgagctctgaaaattcgcggaaaaatccggagagtactttagggcacagagaatattgcaaaatatttccggccaatgatttttaagggaaaattttaattctcccattattccacttcattaaattgctttaacttttatttaatttatagaaaatgatttattaattgatttttaatcccgaacgaaaatcggggcgttacacctggccattcagaccgggatcagaccgccaggcccgctgccggctgtgcacagcccttgcacaagccggcaacccccacacaataaaatccaacaaaaaaaatttttttggagcaattttgaaatgtatgagttgaaatatttcttatcatccataataattgaaaattatgaagacttgcaactaaactcacttaagtgctaggaggtgacctattatggtctatagggtttttttggctaaactgattttcaaataacttttaaatgatttggtttttgaaatagatttgaataccaaaaacatttgaaaccttctcctctaccaactttgtttaacacttttctcaaattcctcctcaaactcattttgaagataaatcccattttggccaaaaataaaaatctagtttcttcaaaagaggaccaaaagggcattttcattgaaacttcatttttcttgcaatgtgaggcttggaaaacatatggggaaccttttgaaatatttttcaagagatagttttcaaattactttgattttgcaaaagttttgacttatgttgacttctagtttatttgctcacacacaaagagagttagagcacatgtaagagtgcaaaactcccccttaatgtgacatgctccattttcgcaaataagagccaaatgacaataaatccaaagcataagcacaaataagagcaaataggcaaaatgaacaagaagcaaccatcgtgcacaatctcaagccacattagagaaatcaatcacatttaactcattcctcaatttgcaaaagtgggtttcatcaagaggcttggtaaagatgtcagctagttgatcctcggttcttatgtggctaatgactatgtcactcttggcaacatgatctcttaggaagtgatggcgaatgtcaatatgcttggttctagaatattggaccggattgttggctatctttatggcactatcattgtcacataggagtggggttttggtgaaggatataccatagtccaacaaggtttgtttcatccaaagcaattgggcacaacaactacccatcgaaacatattccacatcggcagtagagagggctacggagttttgtttcttggatgaccatgacacaatggatctaccaagtatttggcaactaccggatgtgctctttctatccactttgcaaccggcataatccgaatcggaatagccaactagcttaaacttagtacctttttgctaccacaagccaatagttgaggaatgctttaaatatgttagaatccttttcatggccactaagtgacactcgttaggagcggcttgaaaccgtgcacacatgtaaacactaaacatgatatccggcctagatgcggtaaggtaaagcaagctaccaatcatagaacgataaagctttaaatctaccggtttacccccctcctcctcatcaaggtcgagatgcccgttggttgccataggtgtcttgatgggcttcgcatcctccaagccaaacctcttgagtagatccttgatgtacttggtttggctcatgaacgtcccgtccttgagttgtttgatttgaagttcaagaaagaagctcaactctccaatcatggacatctcaaattccctagacatcatatcaccagactccttgcaaaatacctcattagtagaaccgaatatgatatcatcaacataaatttggcaaccaaagaaatcatcaccaatgatttttgtgaaaagggtggtgtcaacttttccaattttgaaattctttgacaaaagaaaatctctcaatctttcataacaagctctaggagcttgttttaaaccataaagagcttttgagattttataaacatggttaggatttttagggtcttcaaaaccgggtgattgttcaacaaagacaagttcggcaatttcaccatttagaaaagcacttttcacatctatttgaaaaagttttatatcaaaatatgatgcaaatgcaagaaggatacgaatgggttcaagtcttgccatgggggcaaaagtttcaccgaaatccaagccttcaacttgtgtgaagcctggcgccaccaatcttgccttgtttctcaccaccaacccgttctctcttgcttgttcctaaagacccactttgtccctatgacattgtggtctctaggtctttcaaccaaagtccataccttgtttcttgcaaagttgttgagcttttcatgcatagcatttacccaatccggatcaccaagagcttcatctacatgttttggcttaagacaagaaacaaacaagtaatgttcacaaatcgaagcgacacgagatcgagtttggacacccttactaatgtcacccaaaacctcgtaaattgggtgatccttggaaagagcggtgtgtatccttgttagcataggtggatcttgtgccttctcctcctccacttcaacttgagcttttcttggcatagcggaagtagataactcatcttgagtggaggtagatggcttgttttccacttcaataggcttgacatctccaatagacatgttcttcatagctcttatcaagccttcatcacctacatcatccaaattcccgtgcccctcttaggagccaatagtctcatcaaattgaacatcggcggtttcttacacaataactttgttcttgttgtagaccaggtatgccttgctattggaggcatattctagaagaaaccctttttatcacaccgactttcaaatttggttagtctaacaccctttcggtgtgatgaaaagggtttggccccttgatgctggtgggggagtactcccacccaccaaaactagccgttgggggcgaaatcccccaactctatgtactgccggtctgaccggatgtgtgtggccggtcagaccatgctactctacaacggctagttttctagccgttgtaggctgtcattgggccccatcggcttggccggacagactggagttgggtggccggtcagactggcctcggctcggtcagaccgcccccagctcggtctgactgaatgcggctctagatcgccacgccgagagcaccacagggagaggtccccttggctggtctgaccggcattcacccgtcggtcaaatcggccgacctacgccggtcagaccaccactaggcggccggtcagaccggccttggtcacacagcaagcacaacaggaaaatgagacaaagccaaatctaaatgcataataatctaatgtggcaatttaaatcatctctttgctaggtcattacccctcttaatagtacagtaaagctataaataaactagcacaaattgattgaccaacacctcgatcgatttagaactcaactactagtttaccgtcatctatactttgctttgcgccatcaatttttagtccatcgataattatccatgcgcacacatgatgtgaacctaactcaaaacacataactcgatagaacggttagtccacaattagcgcttgtcattaattaccaaaactaacaacgggggcctagatgcttcaaagatcatgcacgatactaaaaggctagagaacaatggacgtggtgataaagaatctatatagtatactgttggcggatgttaaatgctgattctataccgccaacatctgcataaagtttagataataaaacatccaacatagtgataggtgcttaatctcacatattccacaagtgttggtgtgtacagttgtatgcagaagataaaccctgaagttgggaggcaaatcagactaaagtgaggaaaattatgtatccatacaaggaggggttgttaacttcatccaaacatcagtaaatcaacccaaaaactccgagaaatggatagaggaaggtccatggagtccaccgaccgaaggctaggccaggagggcccagcccaggttcggccgaacccccttgatcctggggtttggcgtggacgctctagatgttctcttgcagttaagggagttcttttgatgtgaactttgtttagcaagcatggtggaataaactcattcatagcacaacaataataatatcataaagaatatcacagagttccacaaatagcacataaatcatgatgcaatcgactgcataagtacgcagcccaaatagagttcatccaaaagctacatcgagctaatcatcaaactactcgtcaatctaggtggggggtgtgtctcgcgctatccaaaaaccatatgaagcgagagcgaagtcgcagtagacctccattctagtcgtccaaccatccgcaggatccttgcgcgggaagagggtatcgcatgctcatgcaaatctgagtccccacggctcagaggtggtggcctccggatctggcttgggcttcttgcccggggtcgtgtactcttgcgggcagtgctgagggtgcgagggcgtccaactcacagttgcggggcagttcggacatttccccttctcacaaccgtcataactgccctataaaaggacctcacttcattcactctcacacacacttccaagattgagctgaattataagaggctctattgtactatattgtatactagaataggaagagagtatagtagaagaagtcggaagaattccggagttatcggtaatcttctcctctgtttattactctgaattcaatataatattatcttgtgagaattatctcttggttagttcctaaatagcatacgggattattgttcactataatcaactaaaatatagtgattgctttggttagttataaacactaaagtagattctaactgcttagacgtggtgtttaggtaattattatccagtaattgctgcgtatcccacagtacgtttgaagtaggtgtagaggtggtgacagccctcgagatcacttaaatcctcccaatccgggtacgtagtagaacgacatctgggaacagcgggttgccagtgcctgaaatattgtgttaggattaaagttaagctttccctagacactgtttctcactagtaaatcctctctatcttggcctatcatttgcttggtgtccttggataaaccggaggaagatctgaccacacacgttccctaggattcgatacccttggaatacttcgtaggggaagtgctacatcggtatatccgtgcgcttgtggattttatctgtaaccgtattaaataccaacatatacaagagggattgtgtacgtatggaaagaggagtcaaatttaggatccgaattcgggaagattaatagagataaggaaaggaataagttggatacttgcaagagagtgtttcctacatggttaggagttctaagttgtgttagattcgtgggctttgcacagcctacctcatgtataaatagagggggagggtgtggcctcctggtatcggttttagagagacttgagttgagagaaaagttagggtttcgagtttagttcgagattttgtgagggctgctgttgatgcactttgtaaatactagttgatgcaacaaagttaaaagtttcaatgtacatctttgagtttattatctaccggtgttttctaggtcccgacggtctagctgcagtgtgcgcgcggtttgacaggtgggagtgtagcagtctgaccgcaggtgtttgggcggtctgaccggcaaggtttcggtggtttgaccggcggcaggtgggtgttttgaccggtggcgacgagcttcgtcatctactccattcgaggtaaatcttttattccgcaaaagattttaggtttttggtttatcctaccattcaacccccccccccaaatctggtaggttttttttggtcttattcgatcctaaacttacgatgtacaatttttttatttattggcttattgctttccttcacgtatacctttcactgtccatttgttatactccttcaattaaaaatataacaacatagcgcattataggtcgtattattaagataggtcattcaatactagattattatattatatcaaacaaataactaaaaattaaggagcaattgcattcttaaccttactttcaattgtaattacaattttacttttttttagggttcatgattttgccttttttttcaaatcgaggctacaatttgccgagaaaacggacgttatgccactccctaaactgggttcggatgaaatgctactcaatacaatgcaccggataaaatgccactcaatatattgcctaccgaatgaaataccactttggagatttttgtacccaaaatgtaactgtggagagagagagagagagggaggagagcatcgggagagccggtcgggcggcggcggaggcggccggcggtgacgacgggaggaggaggacggggcagtgacgacggagggaggaggataggcctcgccgggcggcggaaggcggtgacgggggggaagggagggaagatagggcggcgggcgagtcgcagtgaggacgatggggcggaggaaggaggaggcgacgacgtgtggaaggaggacggggcggtgagaacgcctgggtgccaccgtcgccgctcgctcgctcgctcctcaccgccccgtctgtcacgaccggaattgacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgagaaacagcggaagactagggcgacgaccgcaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttgtaatataaagggttaggttttgcagtaaacagcattaaaag

SEQ ID NO: 32106 - DNA, 777 bp, Oryza sativa
accatgcaccccgagcccagcctaaaaccattttgagggttttgaatagagggggaggtgtgaatccaattccacaatgatccaacaattccatagtgtccaggtgatgagaatattcccaaagtgtagagttgtaaaaccacctaatgttgcctaattaaccagcgaagcatctacctaaattcatactagtggtaccatgagtagagtgtccactagttggggttttgtttattctagggtgaacaaggaaataataacaataacaataataaggtcataacaaaggtaaataggcatggctagataaaacagtgataacgctggaatttaaataaagcgataatgcaataatttaaatcaaaataattttataaactgggattcaatatgttcaaggatgatgtgacttgccttgctcgctttcccaaccgtcggcttcaacttccacgaagagcggatcttccgaagctgcagcgtctacacgatcaatggaaaagaaaaggcttttactctaataaactccatataacaagcaggaacaaagcacaaaaatgggttcttgacttcttaaggaaaaattagagacttgaacggtccaattccgagttcaaacggccaagttatgaccatttgaagtttatatgctctttaaatgaatatttgcgaatttcttcatttaaattttaattttaaaagggtttattgcatcagccgaggggagggggcgagcggaccgggtccacgggagtgggacccacgcggcagcctcacgat

SEQ ID NO: 32107 - DNA, 18774 bp, Oryza sativa
aaaggggactttttagagtttttctttttataaaatcattttaactttgtttatttcttaataattattatttgtgttctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaaacctacccctcttaaacggaatctcgaccccgagattcggaagaactgccgaagagattgggatgggctgccttcagctcgtcttcacgctcccatgtagcttcttcctcggcgtggttgctccattggaccttgcaaaaacggattacccagttcctggtcctgcgctccatggtgtccaggattttcacgggcctctccacgtaggtcaagtcttcgcgaacttcaatttgctctgaatcggcctgctcggatggcactcgaagacatttcttgagttgcgacacatggaacacatcatgcacgttgcccaaggaggcgggcagctccaactggtaagcgacttccccgcgtcgagcaatgatacggaaaggacccacaaaccgaggtgcgagcttccctttcgtctgaaacatgtgtacacctcgcaatggcgtgacccgaaggtacacaaaatcgtccactgcgaattccaggttacggcgtcggttatctgcataactcttctgccgggactgtgccacctttagattatcccgaatggttctgactttagcttcagcctctctcaggatatcagtcccgaacacttggctttccccaacttggtcccacaatagcggtgtccggcatttgcgtccatacaacgcttcatagggtgccatttataagctggcttggtagctgttattgtaggagaactcggcataggggagactcttatcccaggtcttcccgaaatctaggacacatgagcgaagcatatcttctaggatctgatttagacgctcggtctgtccatctgtctgcgggtgatacgcggtgctgaaatttaatctggtacccagctcttcttggagcttcttccaaaagtgagaggtgaattggcttcccctatcagatacaattttcttaggaacgccatggagactcacgattctagcgaagtagagctcggctagtttgttccctccataggtggtcttcacaggaataaaccgagctaccttggttagtcggtccacaactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttccctttcaagtctaagtacatcttcgtactgccagggtgaatggaataaggactttcgtgagcttcctgaagtatcagctgtttaagttccctgtcgtctggaacgcatatccgatttccgttccatagggttccgtgttcatcctctgtgaaaccagcggctttaccctgtttcatattcttgaggagtccatgcatatccggatcattcttctgagcctcgcggatttgatcgagcaaggtgggcttggcttccagcgtagccaagaatccacgaccaactatgcttaggttcaaggcttccatctgttgattaagttcgggtggaatgccacggacgtcaagagtgttgcaatggctttttcgacttagagcgtcggcgaccacgttggccttaccaggatgatagtgaattcccacatcataatccttgatgagttctaaccatctcctctaccgaagattcagatccgactgggtgaagatgtatttcaaactcttatgatcagtatatatttcacagcgattcccaatgagatagtgccgccagatttttagagcatgaactaccgcggctaactccaaatcatgggtagggtagttgccttcatgaggccgtagctgccttgaggcataggccaccacatgaccttcctgcatgagcacgcaccccaatccttggcgcgaagcgtcacagtacaccatgaagtccttgcgagtatccggtcagactaaaactggcgaggaaaccaacctttccttgagagtttggaatgccttctcgcattgcgggctccacacaaatttctcttctttcttcaacaactgtgtcatgggtcgagcgattttggagaagttctcgatgaacctccggtagtatcctgccaaacccaagaagctgcgaatttgagtgactgtcttgggttgcttccaatcaatgacggcggtcactgtttcggggtccacagcgactcctttagcagatatcacgtgccctaagaatttgacttcggacaaccaaaactcacacttgctaagtttggcatacaattgatgttcccgcaactttcccaacaccagacggagatggtgctgatggtcttcctctgattgtgagtacaccagaatgtcgttaatgaaaaccacaacaaacttatccaggtattccatgaacactttgttcactaagttcatgaagaaggcaggagcattggttaaaccgaacgacatcaccgtgaattcatacagtccgtatcgcgtggtgaatgcggtcttcgggatatcttcttcacgaatacgtaattggtgatatccggaacgaagatcaatcttggagaatacagtggcccctttaagctgatcgaacagatcatcgatccggggaagagggtacttgtttttgatagtaacttcattgagagctctgtagtcaacgcacatcctctttgtcttgtctttcttctccacaaaaatcacaggagcaccccagggggaagtactcggccgtatataccccttttctttcaactcttccaactgtttcttgacttcggccagttcatttgctgccatacggtagggtcgcttgtacaggggagtggttcctggagcaagatctatccggaactcaatctctcgcttcggcagcataccgggtagtttttctggaaacacgtctccgaactctctgacgatggggatttctgacagtcctatctgatgaagttctgaactaccgacagaagttgggggtgcaaagaaaacaaccggttgttccggccctcggtacagagtgacagtgcgtcttgcgcaatccactactccttggaattgagccaaccaattcatcccaaggatcacatccaagttcttggtgtctagaagaatcagatccgagggaaaaggaattccctggatttctataggaatggcagggctataatactttgctgtcataacccctccaggggtggtgatgagcagagggttcctaagcctttctatccccaaccgatttctccccacgaatggcacagatataaacgagtgggaagctccagagtcgaacaaaatggtagcagggatggaatgaatgaggaacgtaccaacgatgatgtctggagttgtcagcacgtcctcggccgtcacgtggttcacacgtccccgaatgacatccttaccaccgttgttggagcggggaggcgcttggccttgctggcgcctcggctttgggcatttatccgcaaagtgcccatgctcgaagcagttgaagcacagacgctgctgaccttgaacgtccctgcggccttgaccaggctgcacggctggcgtagggggacggggcgcacgagtcccttgctgactctgctgttgctgcggctgtgggatgcgcaccacgaattgaggtcggggcgcggagcgaggttgctgctgctgttgctgctgcgaggatgatccccctggatagggattggtgtagcggaccctttggttagccccctgttgattgcggaaattcgccaagcgacgcttgtgcgactccagttccttgtgcttggcttccaagcggatgctcttgtccaccagacgttggaaatccgagtagtccccggagaccagacgcacggacagctcaggatccattcctgccaagaacttctcttacttctcctcatcttcacgaacatcctccggggcgtaccaggccaggttgttaaactcatgcaaatactccatcacggagcggttgccttgcttcaactctcggaattcccttttcttaagggccatgactccggcgggcacatgggttctctggaaagcggcggtgaagcgggcccaagtaataggttgcccctctagctgcgtagcctggaaatggttccaccatagagatgcgggcccctgcagttggtgggcggcgaagatgactttctcctcatcactgcactgcacggtgtctaactttttctccacggcatgcaaccaatccaatgcatccacggggttattagagctagagaaggtaggcggacagatgcggaggaactcggcgagtttagagtgttgtgggggtggtggtggagcattatgttgtggcggattttggatgtggtggaggaaagcagccatcatgttggcctactgggcgacgatttgggtgaggatggcgttggtgtctggtggtggtggtggaggcggagaaggaggtggaggtgggctgacatggttgttgtggttgctgccttcggggtgactgccttcaccggtagcagcacttctcctggttgtcaccatctgaaaatcccacacagaaccagcaaacagagagagctgacaattaaaactaaccacccacgactaccataattcttgaatttattactgctattaaattggttcattaaagttcaagttgcttaagcaaataaaataaagacaggctccgacacagttataccacacaccggcataaccatgccccatacgactctagcagaaaaacaaaaaacgagaagaacacacgcgcaagcctactaactgctcgtctactgctgcgacgggccagggcggaaggtgagcaacagcgcatcctccgtactgccaacgccggaggctccatcctcctgaggaaccacgggcgcgggctcggcacgaggggtctcgacgaagcaggtccacgccagggactgacgaacaagctcgggcctggaggtactcttgcgggcggtgatcttcaggctgcggcagacgcggcgacgcttggggcgacagacctctccctgggcgatcttgagctgacgcagctgcgcctccactgcgtctaagtccttcttcaactgcagattctcctgacgcagctccaggatcttcatgttgttcttgaccaacccgcgacgcaccatctgatggaagtcgatacgggccgcgtcgtatgcctccactgatgcagcaacgggggttcccgatctttcgatgagaggaggataaacttcgatttggggaaggatacgacgttggcggtccgactacaactaccacaggggtgctacgccttagcaaccggtacaccgactccacgttattgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaaacaaaacccaaagtgcaaaatggtggctgctaggagtttatataggtggaggaatgaccaggagaggaggtgggagcaaaccctaggttttgtggacccctaatgggctataatgatacaaggcccaagcccaagtttctgatgtaaagaactattttcgtcattctgagcagcctgggtcaaagttgatggtgaggccacacatagctgacagtagacgacgagatctttccaacaagtactcatttgccccgtttgccctccggagtgaagagcattgacttcatcaaatcagcgctgctagtgttgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgtaataggcgtggttgtatcgttggaagggatgtcctcatcatccaccatgtgcgccaggtgcatgatggtagcgtcatcctccgagctagcatcccggaaggtggcgtagtcgcgggctcctccgcgacgagggtggtagcggtagggcaagtgctgcaactcgtccgggtagcgctggtgaagagtgccgatggcgaggagtgcggcgttctggcaagcagcggagaaggaatctccacccgcggtgaccgccaacgaagtcctctcgggtgagccagtgaggatcactgcagtaacctcccaagcagcgtggggctctgcatcgtcaccctcctgctccgggagctgcttgccctggtagtccactccatgcggataccccagaacaacgcacatgccccgcagttccaaaacgaatccagtcaggtccagaccacgacggttgatgctgccggccatctacaaacaaaaacaaaagagaaaagcaacattttaaaggtcagattttgacggtaaatgaagcagcaggacagagagagactagaggattttcacaaataagaaaggatttttattttgaaaatattgctaaggcttgggatctacggctcgtcctagggtcaagggggctctgataccaacttgtcacgaccggaattgacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacaagaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttgtaatataaagggttaggttttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccgcataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatcttggctaccaggccgtagctcgtgtagccttcatttgtcctagagatgtccatcgacccccgacttcgtccatctccatccgtgtacttttgtttataaccagactgagccacaaactaagccttacccactagacatgtggaagtacggtagcgctttgcaacagaggcccgaagaccggtccttatatggccgaggtgctactatcaaaaccatgcaccccgagcccagcctaaaaccattttgagggttttgaatagagggggaggtgtgaatccaattccacaatgatccaacaattccatagtgtccaggtgatgagaatattcccaaagtctagagttgtaaaaccacctaatgttgcctaattaaccagcgaagcatctacctaaattcatactagtggtaccatgagtagagtgtccactagttggggttttgtttattctagagtgaacaaggaaataataacaataacaataataaggtcataacaaaggtaaataggcatgtctagataaaacagtgataacgcgggaatttaaataaagcgataatgcaataatttaaatcaaaataattttataaactgggattcaatatgttcaaggatgatgtgacttgccttgctcgctttcccaaccgtcggcttcaacttccacgaagagcggatctttcgaagctgcagcgtctacacgatcaacagaaaagaaaaggcttttaatctaataaactccatataacaagtaggaacaaagcacaaaaatgggttcttgacttcttaaggaaaaattagagacttgaacggtccaattccgagttcaaatggccaagttatgaccatttgaagtttatatgctctttaaatgaatatttgtgaatttcttcatttaaattttaattttaaaagggtttattgcgtcagccgaggggagggggcacgcggaccgggtccacgggagtggggcccacgcggcagcctcacggtccacggtggaccgggtgcacccgggctcacaccggccggcgccgtgggccccacgcgtcagccacacccgagggcgcgagcggctgacggccgggccccacgcggaagccgctcggtgcgcccgaaggcggccacggcggcgcggccggcgggaggcggcgcgcccgcgcccctatggtcgccggcggcggccataggcacggcggagcggcggccgagagaagggagggaaagggggaaatgaggcggcggtccacggctcaccctaggtcgacggcgacgacgaaaaggcggccggagcggaggaaggcggcggcgcggttcgggtcgacggggacggcggcgctccggcggtcgacgagcgaaacggaggggtggacgaggtcggcgaggatgcggcgaagccgaaggaggcggtgccgaggtgggaggtggtccggggcgacaacgacggtggaccggagctcggcggcgacggcggagagagagagcgacggcgcgagctcgattccggcgaggaggaagggcggcgagaggcggaaacggacggaggaggtgcagggagggtttatatagggttggaagggggagagagcggccggcggggaaggaataggtgcgggaggtccggccgccatcaatggcgccggcgagatttgcgggggcaaatccgcccgtttgaatgcgagggagagagggaaaaatggggggaaagggagagggaatcacggggaataattcccccctattgattgcacgcggggaggacggggacggcgggattcgcggcggccgcggcgctagggcgcgggcgaggcggcgggaggaaggggatgatgggtgggccccacccgtcagcgagggtggcgggcgggcccgcccgtcagcggcgcgcgcgcggggagaggccggatgggccgtggggagaggagagggagggggaaggagatgggccgagccggcccaagagggagagggagggaaaggggactttttagagtttttctttttataaaatcattttaactttgtttatttcttaataattattatttgtgttctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaccgtcctcctcctcccgtcaacggcaccgcgctcctttccctagtcggcgccctcacctggtcggcggcgcgtcctcccctcgtcggcactgtccaccccccttaagaggcgccgtcctccaccccttctcgccgcccacctccgcgcgctcgttgcccgccggccacgagcacggcccccatctggctcagccatccccggcgctcctctctcccttcctctctctccacgattgcgggtattttggtcttaaaactcctcaaagtggcaaagtatactgatgataatctatttagtggcattttatcctttgtattctaatggatggcatttttgcactcttgtggagtggcatattgtccgttttctccaatttgcccctgttctgttagatcggtttgacggtgttaattctgggataaaaagacatatataccctttgcatattgttgcagtttgtctgtacttctgtaaaaaaaaaagtcgtgcttttgcgatgtgtactcctactgtcctacatgcggcgatggctagaaacgtatcgagcatgtttgatgctccgttggtgttggtgccctgacacaagcgatcctccaaacagatcaatttaattcccggctttcatgaacaaaaacgttgcatacatcaggaagggaaaaggaaccgagaacacaagcaaaaattattccccaaatccatgaatctatcacaacctaaaaatgaattttcccagctgcttgcaaattgattcgatcaatagaacgaactgtgaaaacctactgctttgcacgatgtcaggatgtggcgtggctgcatcgccagcttcatgcggatggtggatacagcgaagtgaagcaacagataaaggccgggaatcggaggggagcttcccggcgccgacgttggtggacgacgcggactgcagcgtgtcgaggccactgggagtcagcgccgtcgccgtgctacacctccccctgctacacgtttgccgtgccgcgtcccgtacggccgtacctcacctcttccagctgaaactcaaccctgccgcccctccacatgcgcgcctagccgtggagctacgtcgactcacccctcccatggcttaccgtgtcgcctccctgatcgcgcaccgcttgcctgagcagcagtgctgcctccgccgtctgctcctccctagccagggcgttgggtttaaggggataagggatttttggtcgggagtagaacgattattttgcattttgtaaatcatttttcttttctttctacttttaattgattgaatcggagcacacctaacagccattcaaaataggggcaaaatgcaggttcagtctaaaaaagtaagggcacaaaccctaaaaataagaggtaaaattataattgcatagctaacagagaaaatgtgaaaatcgaaccaattgcattttaggatcgaataccatcctcaatctaatggcaaaaccaagaaggttaacctatgcttggagctctatttgcgttgctttgttcatgctatgccaactaagtggaattcatggttgtagcataattctgattcaatatctcatatcactcagttttgcttaagtctcctttcgaagatctttatgggtatccatctagtcagggtgtgtttaatttcacgccaaaattgaaagtttgactaaaattgaaagtttgaagaaaaaagttgaaagtttacgtgtgtagaaaagttttgatgtgatggaaaagttagaagtttgaagaaaaagttggaaactaaaccatgcctcagtttggaattggagatgatgcctgcagtgttccaaatttggataactggctaaaggaaaggaaactgctgactcaattgctcaaacaacacctcaatcgagcaaaacagtagatgaaaacttatgccggtaagaaaagaagttcaagagaatttgttgttggggaccttagtcttttgttgctaagagggcaaatcacaagctatcatttcgttattttggtcctttccgggtgattgccaagatgggtaaggtagcttatcgcttacatattcctgaggacagcaccatccatccggttttccatgtatcccaactcaagtcaactaccgtttgctggtgctgaatttcgttgttactactgcttagcatcacgcgtggggagacgtgggtagatggagatcggcgtcaggaaggggagcgtgcaatcgcgatcaccttgggaggacttgaaagaccgatttctgttgttagttttacaaagaacccatttttttaattttaggaagtctattttagacgttctcttggagagatacatctcaaattctgtttagaaaaccaaaaaaatatttttacatctcaaattctatgtagaaaaccaaaaacaaaattttggaaattgatttttgggtatcacttggtgatgctctaagagagtcatcgtgtccaattttacagttaaggattacgaataagatctaatatatatttaagagtcaaattggaccttttcctttgaagaaccgtactactgcagaccatagttcgtttattcaggtactacatttcggaactagtataaataaaacctggcctactgctgattactgattttttatagtatatgttcaaaacagaaattgttatagttacttcttttcttttttaaaaaaaaagctgtgattcatacatgttcttcaatacatatgtgggtaaggatggtttgtctagattaatagtaaaaaagaaaaggctgtcacattagttgtaatggaatgcactcaaatccaatccagtgagttgctgatatgcctcagaatagcaaggctcatcattggtttgataacatttgcatagtcacacaagctgtactacgagaatatagtcgtgtgtatgccaacctgcgacattatagaaaaagcctgtcaacctgtttagtcagtatcagaagaaaaattaaccctacggaataaaatctttaagcatcctctctgctcaacattgagcctgatatctgaacatatgacatctgagtgtagccattgaaaactgaggcatccaatctcgctagaccaattcgttgaaacatgccaaaacgaccatcttcgatgataggatcagatgcacgggctgggtcatatcttgtttggtgggttaaggatggaccagcaactggaggtagctcccaatacaaatccaacacggattcaacaagtctgctgttctggaaatgctctttgtatgagatggctttgttgctatggttgaaattgtcacgcatataacctctaactccccaccatgcatcatcctttccacaaagctcatctgtttccacagctttctcccaaaaactctttcgtctcgaccttaatcttgcttcgtcactatcccaaaagcagctatgtccaccacctgggtagaaaaaatacatgaaaattagtttttcagtgtggagggctgcctttttcagttttattgaggaatttcaaaaaggaagattataatccagctgaagaatatggtgttgcaatgtagtgttaatagaggaaaatggaacaagatagcattataggaaaaatgaaggagacccactgattagcatatctttaaaaaaaaactgcaatctggaatatcaccgactaaacttctggtatacattgatattaaatgggttcagaaaatgaaacatgatgcctgatgaacaaattaatgaagttgtggtaatcggtatcattaccaagacatcacaagttaagagcttcaagttcctcatatcagtttattgaattgtagtcataaatgtttctttcctaaaacccaacataagtaaacaaatatatgtcaagctgccagcagattatagttgcatacaaacaattataggatatataacatatcatttctagttggtctagtatgctccatcggagtaaaatattaagctgagaaaaaacataaatttcgacaataattgtatttggaagaaaatctgcacatgtttggacatgtcgagttaaaaaagaacagaaaagttcttagtaacatattggaaaccttggtagacatagtgtttagatcatgataataacaaaaaatgtaaggttatcttatatcttagaaatacaacaaaaaaaagcacaaacaaaaacatgataataacacccagaattcataatcgcatgattagaaagaaataaaataatctcaatatgcccaaaatttactttttaaggaagtcagtacaagagattgcagaagaaatataaagaaaataaggagaacattgaaaaaggaaaactgtgtcacattaagaacgttaaccattcaagaatgtcttatggtaacagaagacatcacctcatattataatgccttctacttcagaagataaacaaacctaactgcacttatactaggaagacaagctaatggaactactccaaagtaatgtgacacagctggctcaacatctatatgcaacatctgatgtatcttgattattgaaaacttagaatccaaggacaaggtgacacacctctgatgtgttcctgatcgcagatctgtcttaaggagtaatgatcgcctgtaccagtgtcataattgtcctcaaatatgatatgtcggaatccaactattgaagcctgttttaacctacataaaacaagacacatcaaaataaatttaagtttcgaaaacttagagataagagtgcactatttattagagtgaatgcttagcatgtgtcatgctgacagttaagaatttgatcataagaacagttcaatacaaaaacactacaaatatggcaatacccaacagaaaatagtttgtccacagttcaagagaaaggttgaacaatgatgatctacagaaagactttacctcttcaactcactttggtgatcatcaaagaaaacaagcactctgctgagatcagaaatgccatgattcctcaatagcttcccccaatcaacacttccgaagtcaataaaatccttcccagcaagataagtgcagttcccatcaacatatgcaggccccttcttcagatatttctcagggtgtctgggtgagagtgatataatcttagtatttggcatggcctgacgcaaaacccatgtagagtgccccttgaatgcaccactctcaatcatcagatctggcttaagccagcgagccacaaaccaaaggccaaaactgtggtcaaagcccattccatacatgttgttcttgataggtcgtgtttcatatattggtacaaattcttccagtccacgaagtagatcctttgaagtccactccactatctttccagtttttgatctgcctttagtgaagaaaaaggacaatgatattccatacagtcaaaagtgatatttcaaacaaattaccccagtatagaggttcttgtgaaataataacaaaatataccccaagaaaaactcagcactacgtagagaaacataatcatgtctaccaacagctacaaacataaatataagtacactggtggcaactaagatggtcaattgttacaggacttcaagaaacagaataatagattgccaccgcaatgttcgcactcctatctagcagcagtcattgttcaagaaacagaataatagattgccatggccatgttctcattcgtatctagcagcagtggaacaatgaccgaggaacaaatctgaacaagtataaaccaacagagatcagttaggagcaaataactataataaatttgcacatataatgtggtcatcactcatcgaacaagctatcaagctattctgtcaaatacaattcaagatttcaggtgaatatgcattgcgctcacataaagctagcctacaacctatggtgttaggtgtctaagacactaacgatgaggaatatctgcatgagcagaatcattttcaaacagggaggagattagttgcgaaagggtgattacttcgcagaaaagaaccggatgtccggatctatctcacaagaatcaacagcggcgtgagggcttacaccagggtaccccgagggcgccgaagtcggaggccgcggccgcgtccgggagagcgagaaagcgcgcgtcgagccgcggcggcgggcagtcggcgcgggggcgggcgcggccgatgaggaaggcggtggcggcgacggcgaggaggaggaggaaggaggcagcggctcggtgggaagagtggaggcgggcgtaggcggcggccacgaacgcggggttcgcctttcggatcttggactcgtcgtcgtcgtcgccgacggaggtggcggaggatgcgccagcgtagggagaggaggaggaggaggcgccggcggcgcgggctgagagaccggtgtcgtgcatggaggcgggacgggagcagagagagatcggagtagtagaaagtggcggcggtggtagaccggtggtatttggagagagatcgagggaccgaccgttccacacgaagggagggggtggggggcgtgttagggaagatgtcaacatggggaggatcttgcttgcacgggccacgcaaatgttccagtagcttttttaacgcgtgaatgataaacatgatctctactattatagtattataaaaattgaagatgtttttgccgatagttttgatacgtcatccgtgtttgaatcgttttttaagttcattcgtttttgaaagtacagatccgtttttgagtcggtttttaatttggttcgttttcagaaatacagaatgagtcgtataaaaagaattttatcttagctaacttgcatgctaacttgagatgatcggaaccctaattacagctcatgattttataaaaggaatattcaagcgaattcctacagtaaatttcaccttagttaacccgcacaacaataatcttcacccgttgcaacgcaagggcatttttctagtaataagaaaaggagaaaatccaaaaagaaaaaaacaatggacaagcatcccaatgttaaaaaaaccattgatgaacccaacttcctataaatgctactatataatcatcttatttccaaaattttatcgttgttatgtttccattaattagtagccctccattaagtactatcaaaagaccattttaccctacgaattgttaaaagctcattaaattttttcttttttagtcaacttataaataataatttagtataaagaacaacctacaaattagtgtaagcttatggaaagagcaaaaattttaattgccttttagcaattcctatgggtaaaataattttttatagcacttaacggagggctgctaacgaaaatctaaatgaaatggtgcgtttgtatgatgacatttcttggattcgtatgtttatcgatggtgtttcatggatttctctaagaaaaaacatagagtagggatatgataagaataaacatgtaaaacattaggaagcctataaaggttcgcacgctggggcgtgccacgttggattttacttttgcagaaaagcccttcggtttgtgtgtaattcaatcgagtacccagtgaaaagttcctctgaggtgtcaattcacgaataggcccttacataagttagatattgcatgcgaaggagagaaaattcacgaattaggaccgcgctctaaaacgtggaagccgagggggtttctagcaaacgacgccctaacccacccaccataatcctagccgccgccgccgctcacactctctcctccctctcgtcttctcctctccctctccagctcccgccgccgccgcctcatgccgcctccgcctccccctccccctcgtgctagagggatgaagaacgtgttttattatcaattctgacgagttaaagtaattatttccatgcttttaacatatcaatgctcgtacttagtgtgatgtgtggtgcactaaggatgtcaataatctaagttggaaatttcaaaccagttgttttatttaccaataggccacactttacacactacttgctcattgagcagtagcttatatgttggtatgttagctgaggatctcatcgttaggctggtaaatatattctctagatttgcgtcgcttgaaatgtttttgtggacaaatgctggtatttttcttctgtgcaaaccttggggccaaaacgtatactccctggttctcattatatttattgatccctttccttgcatgtttgcaaaattagcggtctattaccttccgtgctgctgaaataatgttctcatggtttgttaaaaatggtgatagtgatagggaccatgatcgtgacagggagcaccgtgatagaagcaaaagaagataacaccgtgattatgaatattctcttgatcatgatctccccttggaccaagattctgaaaggtattgcttctaaatttctaacctaagcaattacttgcaactgcacaaaatatgggtgtttttttcctttattaaatctacttatttgattgactaatgttttcctgatgcatttatttatttttatcaattagtgaattttcccctatgcgtgggaattcatggtgatgcctaataattatgaaaattaggttgtatcctttctgataataagatttaaagttaatgatatgttcgatctatctgctgcatactacactctgttgtgttcctctcttatatcgagcatcttattattagttttagaacatcttaatataactgacaattaattgctatagcaatcatgctgacaaaatcaggttagtcca

SEQ ID NO: 32108 - DNA, 2100 bp, Oryza sativa
ttttgtttccctatctattaggagggggagaaacctgaattaagagatgttagcgtgtatttccccctgaaacgtatgttaatctaatttttgtctaaatttactaaatgaattaaacgcctggcctccattacctatcacttatttggaaaattctgcagtaccctagagtgaaatgcaagcattgtgttcatatggggtttgttggcatatttcaactaaatccaatttttaaatgctacagtgctacaagaggctagaaaacaacagttgcgctattgttggtgactgacatgaatccatcgccgctcaattttaacaaagttgcaaagaagtttctaagacaataggggcttttttttggcgctgcaggctcttgcatcacccattcatctgtcattacggtttttgatgcacactgcctaattagttgtttttattatacttggattatttttctgacagaacaaatcacttcagttcccctcctgccaatgaggagtgtatgcttatacagtgaaagtattatgaggtttcatcaaggtattgtaatttgtaaaaccaatacaaatgctatgctcaataattgttttgaaattgcaatttttgatgaatcttatgctcaaaagatgattaaaattatctccataatgctcaagagaatacagatggttgtttttgtacagaacttagattttattataagctgttgtctatcgacaatatccatcattttatcagtctatcgacaatagtaggacgagctcttcagtctaaataacagttatatgtttgctgatgcgcctcttataacttttgctgccatgacactagccccatgtctcttgctcttgatcttcctttatgagtcactccatctaatttgtgtttgcttcctgatatttttgtagatgcaacaacatgaagattgaaaaggctgctgcctgcaaggtgtttgaaatcactgcctctggaatttaaatgtgtgaaagtgattgaatagttctgaaaatttatccttgctttgctagaagattgaatgggcggctattggaggaagaagaagcatgctacaggggtaatgacaaaggtagcagggtccctcttttgtgctcatggcatgtcaatttatcctttctgttgatttcgtgtctagaccagaaattttttaattcctacttgaaatcatgctaaaatggtttggtatcatatccaagaccaagcttaaatcatcttgtatatggtttcatcctacatttgttgctatgaagagtcaacacaaatgttgatattttccaaaaatcaactgaagcgtcgactctaaaatcaagttctagaaaagagtaagaaggatgtgctccgtcaaataatagaactgtaaactatagaaactagaagtcttaaggacactacactaaccctaaagtcactcgtcatcataagcaaagtgcaaatattgtctgtctggagtctggactcatcatttaggtgctctttggcagggcagcagctgtatgtttcagcttttgagttgtccttagaatccatctcattgagtaagcgcacttcaattgaaatctataactttctcgcattctgggaagttcattttcttattgcctgcaatttttgtagcaactacagatacaaccattgctcacatcatgaaagaacaagatgatatcaagatcaaatcctccaagtgctggaatcagattcggccacctgctacactgctgacttcaaacggccgccgaatctgcatacgacctccgttttcggcccatgagtacttgatggaaagccctcggagtcctctttccaacggatccagcctcatcgccaaacttcgtctgggaccccggcccaagtggggcccatgtggggtgcgccccaaccaggtggatcatgaccctagggtccctttggtcatcctcccacctccttaaatagctagctaccccttcagggtttctcgggttttgttagattaaagtttagccattactacttgcttgcagcacgcgtgtcggctagaccgtccgtctgcttgttcttcggaaccccaacttatcatttgtattaaattcctatttgcaa

SEQ ID NO: 32109 - DNA, 789 bp, Oryza sativa
tatttccactatcgagaatggaccaatatacctacggctgagtttgcctttcgttccaaatctcacaacacctttggtaggagatacctttagaagtacttggcacccacttcaaactctaattcccgtcttctgacatcagcgtagctcttctgcctactttgagctacgagcatgtgttttcgtatttctgctatccgttctgtggtttgttgaacccaatcgggttctaaaacagctctctcccctatggaatcccaacacaatggggatcgacactttcttccataaagtgtctcatagagtgccattcgaatgctagcatggtaaatgttgttgtaagcaaattctacaagcggcaaatgatcctcccaacatatcctctagagtttgaatagtccactcagattgaccatcagtataagggtgaaaaaccgtactgaatttcaattatcaaatgcctcttgcacagattcccagaacttagaagaaaatttaacatccctatcagaaacaatcgagcgaggcacaccatgtaacctcactacctcgcgtgtatagatcggtgccaagtcactcgcagaataagtggtgcggataggaatgaaatgtgccaccttactcagacgatctataaccacccagatggcgtcctttccttatgaagttcgaggtagcccaaccacgaaatccatagcaatatcatcccaaggccatacaggaacttccaatgattgtaactttccagcaggactcttatgttcagcctttactcgctgacatacccca

SEQ ID NO: 32110 - DNA, 650 bp, Oryza sativa
atattcctctatcattatatttgccaaagatatgaaaaatagcagtagttggacatggaaaatcagacttagcaaataatttctccttcaaattatcgagctcacaaaaatcatcaaactgaacatagccaaagtatttaaagaagatagcaatttacgttcctcaacttcattagcaatgtgaacagcatgcttaatatcaacacacaaacaaacactagaaatagcatgttcattcactagttgtggcatgaatataagtgaagcattatcacacaactcttctttatcacaaggaacggcgagtaaatcaacttgtgacaaaggaattccagcatttgattccactaacggttgctctactttagtatgaaaagtggacaaatttacttcgttaacaatgcactcaccatgattaattttattaccatttactttacctttgatgtcctcttcagatgatggaggtgcctcgactttgagtgtgaacaatgggattggcggctctttcatgtctctctcctctattttactttcagcattgcaagcaagttgtaacaaatgagaaagagatgtatatctttgacaatcaagcatgtcctgaatttctttgttaagcccacataaaaaccttaattctttagcttctt

SEQ ID NO: 32111 - DNA, 650 bp, Oryza sativa
ttgaaattgacatcattggaaaatgtttcgaaatatgaatctaatcataccataatgatttttattaaggacaaagaagttttgctttcagacttttgttaaattatttgaatgcaattcaggtttggagcgcgcggttgtgacttttttttaaaaaagtaacaagaaaagataaaaaaaattaaaaaaaggctaggcatggcattagaaatgcatgatgaagatgaatactgcgtacctggtaccaaaagggagactgatggcattagatcctacaagaaaccactggagaaagatgcagacaagaaccgggacaatcaggccaagaacatagccggtgtgcctgctgtccctgcagctcccggcggcgtaggcgccgccgagtcccaagatcgccgtgacggtgagcccgtacagcgggaacttgatgcgcttgaggtcaagcttctcgtagtacacgttgaacgtgatggcgagcagggacgcgatgaaggagatggcgttggagaagaagaagaacttgtaccggattggatggaggcccggcagcaccgggtcgccggcggcctcggtgctccgccagaagccgccgggtgggttgagcccagctacataggcgtcggtcgccacgaagatggcgatcaacatca

SEQ ID NO: 32112 - DNA, 498 bp, Oryza sativa
tatttttctaaagcagcaagcgagttagtggatttgatatggcgcctccagctcaagctgtggttccacaatttcctgctattccaaccccaagtatgctctcatcaactaagttaaacggctcaatttcatttttcttttcctcgtcaatttgtggcactttttctgaataataattttagtgggacatttgaacaatggagttaagaaaaataattttgctgggctggatgattgatgtacatgagtattttttttagaatgaattatatcttcggccgctataattcttcatccttatcactgtataatgccacactatcttattgccgttgccataaactaccggtgaattactagtccattaaggtcgattattgccgtagcaggatgatgcttggtgttatacctagtaaattggtggatatgtctggatgttatacctagtagaactccaatacagttaatatttgcttagtatgatcggccttgagcatt

SEQ ID NO: 32113 - DNA, 6307 bp, Oryza sativa
  unsure (1)..(6307): unsure at all n locations
attcctgcacccctgttgtcttattttctatgaatggtatgtacattttcaacgaaaggcatgtgtagtatatgcattttatgggaaattaatggtttgtagcttcatcagggaaagggcagcactgtgagttgtgcacaaccacatatttctgtttattgccaataacaacagtggtgggcgactgatcatagagaatagagatagccctgcctcagcttgatcatgtaaataaattaatgtttcatattctctttctcgtggaaattgaattttgtaccgttatttcattctttctttccagtccaaatcggttttagattgttggagttgtgattttgctatattcatgtgtttcagtagcttactttactcatatcagttaataaggtccatctttccccgccaaaaaagggtccatcttgatataacaattcctatgtgcaagagggttctatccttctgtttcagaggtcatattattatctgtatgatgcaggcacatatcaactacacattttggtcaacaatgcaagtaccatgacacatttctactcaccaacattatgataaacatttcatttgctggtttgtcatttacatgatgcaatgtagtacttcatgcacactgttgttctatattatttggtttggagtaaattttgagtggtaaatgtcaagctgtatttttttgttaggcctatttaatccccatcctagatatctatcaattggtgtgtctagatgacaatgagtattactgtaatggaaattgacatgaaagagaaaattttagtgcaaaacatcaacagtagcagagattatcatttaccaagatggagttaacgacacaataaagcaacacgagagacactggaacatacctattcttaatgggtgctactattgcatatacatgtactatgcccgcttcatccagtggttggggttcttgtgataggtgagaggtcacaggagaataatttttgctctgaaagtgtgaattccaaatttctctctattgcaaatgccatcatggttaatattgcttcttaagcaagcccctttcgacagctgtaacaaaaggtaatagaagcttggctaaatgagtagaatggtcaaacataatcaatctatcgctttctaatttcaggacaacatttttcttctctacctgaaatataacataaagagttcaacatctgccatctgcattattgcattgtaaagttagagaacagattaacttgctaatttctcctaaaaagaactcattgctcacttggcactatctctcttttcatgatgtatgcttagaagtgtaggagaatcccactacaacaatattttcaagggaaatatagcagcatagtcttttttttcttttagcaattaatagaataaattgtacaaccaacagagtaatctacctttaaaatcatgtccttattcatgaaaagtggcatttaagagaaaatgtangcaattatgtgtgcatcacanaataatttggctacaaggctaaaaagttttcttggcacaaacagattcctaagttcttagaactttgtttcattgttacttcgtcactactcactgaaatataatattgaatgaatttgaaccaaagagggatacaacataccttatgaaattcatgagaaaaatactccgatattccattcgatggacatgttaggcctatttagaatttttggatttgtgattcacccaaatacctcctcattgcagactgggcatgcctgaaagaaaagaaacataaaatcagatccagaaggataatcttcctataccagacaagacaagtttgtatacaaagcaatcaacattcagcccgtcagacaaagttcagacaatgtatcacattctatgtatcgaatttcttgagtaatattcagacgttacaggtactcttgttcgcatatatgcatttagtatctatacacagaatacagaaacttcttttgcattttggaggtacaacatcaaatataaagaagtataatttaccttgttgatcttaagccagcgagttatgcaatccgcatggtaacagtggctgcagggcaatcttatcaatttctgtcggcttttataagtcgatttacatatcacacatttgcacatagatatcatatagttgtaagcttgtcagccaacataaagcgtgccttagcactaatgattatgccacgtttattttttttttaaaaaaaaggatgattggaagtaaattaactggcactgtggcacatactcatcattcttcttcctagagaagaagctgcacttgttcttaaaaggcaccaaatagcatatcaggtcatctgatgaaccctgagttccactcgacactcaagactgttgtttggcccgatctttcggtgagttgagataactatgatttgggagaaacgttgacgacccgactacaaccgtacaagacgttgttgtgttgcgccttagcgatcgatacacctctccatgggttgttgatctcgccggtgcaaatcaaccctattcctgcaagcaaatcaaagaaacaagcaagaacaagataaaagcaatctgatattgcaaataggaatgaatacacaagataagttggggttccgaagaacaagcagacggatggtctagccgacacgcgcgctgcaagcaagtaacaaaggctaaactttaatctaacaaaacccgagaaaccctcaaggggtacctaactatttaaggaggtgggaggaccctaggtcgtcctccacctggttggggcgcaccccacatgggccccacttgggccggggttccaaacaaagttacaagcccataggcccatgacaggtgacgtagtaccttgttttttcatctgcggatgacttggatggaatttggtggtgaggccaaatccgatggaaagaggactccgagaggtttccatcaaatactcatgggccaaaaacggaggtcgtatgcagatttggcggccgtttgaagtcagcaatgtagcaggtggctgtcacaccctaaaaatcctaaatatataaattgttgtttaattggaattattagaatttattttaaaaagcctagaagagaagatctaattttaattaataaattccaatataaaatggggccagataaaatttcattaaatactttgcttaattctataattcctagatttttttgggatttattcgagctaaggaagtatttttaataaatgggattgcatttcatgaataatttaaattgaaaaaggattttaaaagtcttcttgtggctttgggccgaaagtcggcccaaaaccctctctctctctctctcggcccagtcggcctagttcggcagcagccgctcgcgcgcgcgtccgcccgctgacaggtggggcccacctgtcagtcttcgtcttcctcgcgtcgctgccgccgcccgaaccctagccgagccgcgccgccgtctccttccaaattcgctcgcgcctttccttctccggtgaaatcaatagaggggaaatgatcttcgggatctcctctaccatttctcttttggaatcgtcggctaaaatcgtttggaaatccgtggattcgagttcgagtcagatcgatctctctcctccgaaccctagactttccttcgtgtcgccggtcgccgtgggccttcgccgccgcctccttgctcctataaaaggacccccaagcctgccgctacccgccgccaccctcgccttcgcctctcgtcgccggtagagccctagcatagtgtagcctagcgccgccgtcgccgccgcagcttcagccgtgcgccgccgtcggtccggtcgtcgtcgttgctcggggaggtcgccgtcgtggtcaccaagccgtcgccgatctcgtccacccctccgccatcgccgtaggtcgccggagcaccgccgtcgtcgtcaagccgaaggttgccgccgtttcttcctcgacgccgtcgccgtccgttgatcttccgccgttgttttggtcaccggtgagttcgccgcatcgccctctacgtgttggtgtcctccgttcgcgtcgtcgcgccgtcgttcgctggcgagtttgcgcgcccgagccaccgccggtggtgacgtcatcgtcgtcgtcttccgtggtccggctgtggatcggtcgatctcggccgttcgttttggatggaaagatctcggctgttcgttttcgtcagccgccgccgtgcacccggttcaccgcgaaccctagccgctgatgcaataattcccttttccttttcaaaaataattcattattgcgtcataattcaattaatacccatataagtgttttaatccgatttaatctttaaaaattcataactaattcatcttagcttggatttagttggttcaagtctctaaatatttctaaaattgagatctacatgttaaaaatatccacatgtactgttcatgcttgtttatgtgctgttttggtgttttgctcctttctgtttagattccgacgtttccggagagtccgttttcgcaggagaagaatttgaagagttccaaggctagcaaggcaagtcacacagataccttgggttattataacttggctagttgggctttatatattggttcagcaagatattagatatgattgcttagccatgcttagaaacattagcacactattgggattacttatgattcactattacttaatgatggcttaatgatagctcacgatggtcaatcgtgattggtgaattaattacttgccaactaaaacttgataatggtgggttgtgagcacatggttttgggagtcgtgctcataacaattaaggaccggttcacgagtttcggttgtgaaacattaaccgtgccaaccacaagccagcgtgggcaacggctttaccttttgtatagcatggttcattgcggagcaccagactgagaagtggcgaagataagcccacgggggtcgctggggagtccatgccttgtttataagggggtgattatgatccaggaaaggtgcgctgtggtggattgtgttgtgcaaggggtactgtcacagctcctttccgaggtaccgtggtggtatgaaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcatcataataaaagatgctataactggtaataatttgattagctcctggtttggaatggcatattcctggtttggagatagaactgtgcagccgggatggttgttcagaatggttgggcctatgcaacaaggtatgttgtatagcgttggattaatattgtttaattattacttaactattttattaaattctgaaatgttcattaaatgctgtttatgcaaatgaaaccctactatgccatcctttgttatcctgtgcacttgcatatttgctgcgtggcttgctgagtatctcatatactcaccttgcaatcattcatcagaggaggagttctacagtgatgctgatggtgtggaggattaggtgtagccctggtcaagctgcctgtggagtggagtcgtctgcgccgtttatcttttttttccgctgcttagatctttattgattgagaggaactatctacctctgtaatgacattttattcgcttattaattagagtaataattatactctattatcaatttgttattgtgtgcctcggctgatttctggacgagggttcacacacatgtaagcgtttggaattttggatagaaattccgggcgtgacaagttggtatcagagcctccttgaccctaggttatgccaaatggtcacccatagaagccctctaaaaatattgaaaaagtagaactgttctcctccctttctcttttaattaaaccaaactaatggcacatgcacttcataatctcttttagtggttctcattcaaaatttattccagtgttgttagtactatacatctattactgtactaatggctcatttactagcaaatgtttataacattgttttattttgctgcaataaaataaatttcgcatgttgattttataactttcttttatttcttttggaacctgttgttcaaaagtgcaaaatttgtgatcttgtttccaactgtttcaacgtatcttgcaagcttggtttactttatttacttaccttttactttgattttctaactttattcaaattaatccaaaaacttgtg

SEQ ID NO: 32114 - DNA, 8697 bp, Oryza sativa
ccggaagacgcatataccatcgggagtggtgtctctcaagaagaaggaattcaggtcgctcacccaaggatctcgcacggtcaccgagtatctgcacgagttcaaccgtctggctcgttatgctccagaagatgtgcgcactgatgaagagcgccaggagaggttcttggaaggacttaatgatgagctttcttacccactcatgactggggattatcatgatttccagaagttagtggataaggctattcgccaggaggacaagtacaaccgcatggagcagaagaaacgccggattgctcacttcaaggcacaacaggggaatagtcaaaggccgcgtcttactttaggaccccagtccatgccacagggaggttcttcgtctgttgttcgtccgcagcgtcagttcttcaacaacaatgctggcaacaacatccgcaatcaagctccacgccctgttgcagctccaacacagcaacagcctgccaagagggagcaaggcagcaagcccagggcgtgcttcaactgtggagacccaggatattacgctgacaagtgtccgaagccccgacgcgtgaaggttgtccctgcccagagcaactctaccgcatcagcatcaaaggctcgtgtcaatcatgttactgctgcagaagctcaaggtgctccagatgtgattttgggtacgttccttgttaactcagttcctgcaacagtgcttttcgattctggtgctacacattcatttttatctatgagttttgcgggaaatcatgggatggaagtagaagatcttagacgtcctttgatggttagtaccccaagtaatcaagcactctctttgcaacgtagcccctctgtcagaatagaaattcaagaagtaccatttctagccaatcttatcctgttagaatccaaagaccttgatgtcatcctagggatggactggttagccaggtataaagatagactgtgccaacagaaaagtaactctcccagcaatgatggtcgagttgtaactgttcatgcattgtcttctgagtctttaaggtcaagtctgaaccaaatgactttggaagagattcctatagtccgggagtatcccaatgtgttcccggatgatttacctggtatgccgcctaaaagggacatagagttcagaatagatttggtaccaggaacaactccgatccataagagaccttatagaatggcagccaatgaattagcagaagtcaagaggcaagtagatgatttgcttcagaaaggatacatcagaccgagttcatctccatggagagctccagttatttttgtggaaaagaaagatcatacccagaggatgtgtgtggactatcgtgcactaaatgatgtgactatcaagaataagtacccgctacccagaattgatgatttgtttgatcagcttaaaggtgccactgttttctccaagatcgatcttcaatcagggtatcaccagttgaggattaaagaggaagacatacctaagacggctttcaccactaggtatgggttgtttgaatgtactgttatgtcttttcggacttaccaatgccccgctttcttcatgaacttgatgaataaggtgtttatggaatacctagacaagttcgtggtagtctttattgatgacattcttatctactcccgaaccaaagaagagcatgaagaacaccttcgccttgcattggagaagctacgagagcatcaattgtatgccaagtttagcaagtgtgaattttggatgtctgaagtgaagttccttggtcacgtcatctcagctggaggagttgccgttgatcctagtaatgtggaatccgtaaccaactggaaacaaccaaagacagtttcagagatttgtagtttcctaggcctcgcaggatattatcggaggtttatagagaatttttccaagattgctaagcccatgacacgattacgttaaaaggatgtaaagtacaagtggtcagaagaatgtgagcagagttttcaagagttgaagaatcgcttaatatcagctcctattttaattttgcctgacccaaagaagggttttcaagtgtattgtgatgcatccaagcttgggttaggctgtgttctgatgcaagatgggaaggtggttgcctatgcatctcgtcagttacgcccgcatgagaagaactaccctactcatgatcttgagttagctgcagtggttcatgcgttgaagatttggcgtcattatcttttcggtactcgtacagaggtgtacaccgatcacaagagtttaaagtacatctttactcagccagatctaaacatgagacaacggagatggttggaattaattaaggattatgacatgggaattcattatcacccgggaaaggctaatgttgtagcagatgctcttagcaggaaaggctattgcaatgctacggaaggacgacagttgccattggagttatgtaaggaatttgaaagattaaatttgggaattgtcagtagaggtttcgttgcagccttagaagcaaagcccactctaattgatcaagttagagatgcccaaattaatgatcctgatatttaagaaatcaagaagaatatgagaagaggaaaagctatcggtttcttggaagatgagcaaggaactgtatggttgggtgagagaatctgcgtcccagacaacaaagatttaaaaaatacaattctgaaagaagctcatgatactttatactccattcaccctggtagtaccaagatgtaccaggatctcaaggaaaaattttggtgggcaagtatgaagcgtgaaatcgcagaatacgtagcagtatgtgatgtttgtcagcgagtcaaggcagaacatcagaaacccgcaggtttgctgcagcctttgaagattcctgaatggaagtgggaggagatcgacatggatttcatcactggcctacccagaacgttatcaggccatgactctatttgggtgatagtcgacagacttaccaaagtggctcatttcatcccagtaaagacaacatattctggaagtcggttggcggaattgtatatggcaatgattgtgtgtttgcatggcgtccctaagaaaatagtgtctgatcgaggtagtcagtttacttcaaagttttggaagaagcttcaggaagagatgggttctaagctgaactttagtactgcttatcatccgcagacagatggacaaaccgaaagggtaaatcagattttggaagacatgttgagagcttgtgctttagactttggtggaagttgggataagaatctaccttatgcggaattctcatacaacaacagttatcaagctagtcttcatatggctccttacgaagcactgtatggtcggaagtgccgcactccgcttttgtgggatcaaatgggggaacgtcaggtttttgggacggatatcctgagggaagcagaagaaaaggtgaaaatcattcaagaaagattgcgtgtggcccagtctcgtcataagagttatgccgacaatcgtcgtagagatttgagttttgaagaaggagattatgtgtaccttcgtgtcacgcctcttcgaggagttcatcgcttccacactaaaggaaaattgggaccgcgttttgtgggaccttacaagattgtcagtagaagaggagaggtcgcttatcagttggagttacctcaatctttggcaggagtccatgatgtgttccatgtgtcacagttgaaaatgtgtttaagggtacccactgaggaagctagtcttgaacagatagaaatccaagaggatctgacatatgttgagaaaccaatccgtatcttggaaaccgatgagagaagaaccaggaatcgagttatccgtttttgtaaagttcagtggagtaatcactcggaagaagaatcaacttgggaacgagaagatgaattaaagtcagctcatccgcatctattcaccagttcttccgaatctcgaggacgagattctgtttaaggggggtaggtttgtcacaccctaaaaatcctaaatatataaattgttgtttaattggaattattagaatttattttaaaaagcctagaagagaagatctaattttaattaataaattccaatataaaatggggccagataaaatttcattaaatactttgcttaattctataattcctagatttttctgggatttatttgagctaaggaagtatttttaataaatgggattgtatttcatgaataatttaaattgaaaaaggtttttaaaagtcttcttttggctttgggccgaaagttggcccaaaaccctctctctctctctctcggcccagtcggcccagtccggcagcagccgcccgcgcgcgcgttcgcccgctgacagtggggcccacctgtcagtcttcgtcttcctcgccccgctgccgcgcccgaaccctagccgagccgcgccaccgtctccctccaaattcgctcgcgcctttccttctccggtgaaatcaatagaggggaaatgatcttcgggatctcctctaccttttctcttttggaatcgtcggctaaaatcgtttggaaatccgtggattcgagttcgagtcggatcgatctctctcctccgaaccctagactttccttcgtgtcgccggtcgccgtgggccttcgccgccgcctccttgctcctataaaaggacccccaagcccgccgctacccaccgccaccctcgccttcgcctctcgtcgccggtagagccctagcatcgtgtagcctagcgccgccgtcgccgccgcacctccagccgtgcgccgccgtcggtccagtcgtcgtcgctgctcggggaggtcgccgtcgtggtcaccaagccgtcgccgatctcgtccacccctccgccgtcgccgtagatcgccagagcaccgccgtcgtcgtcaagccgaaggttgccgccgtttcttcctcgacgccatcgccgttcgttgatcttccgccgttgttttggtcaccggtgagttcgccgcgtcgccctctacgtgttggtgtcctccgttcgcgtcgtcgcgccgtcgttcgccagcgagtttgcgcgctgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtaaatagttcctctcaatcaataaagatctaagcagcggaaaaaaaataagataaacggcgcagacgactccactccacaggcagcttgaccagggctacacctaatcctccacaccatcagcatcactgtagaactcctcctctgatgaatgattgcaaggtgagtatatgacatactcaggaagccacgcagcaaatatgcaagtgcacaggataacaaaggatggcatagtagggtttcatttgcataaacagcatttaatgaacatttcagaattaataaaacagttaagtaataattaaacaatattaatccaacgctatataacataccctgttgcataggcccaaccattctgaacaaccatcccggctgcatagttctatctccaaaccaggaatatgccattccaaaccaggagctaatcaaattattaccagttatagcatcttttattatgatgagaagtgtgagactaatcacgaaagacattgttagacccgcccataaccgcgggcacggctagtcgaatagttttactctggccagaggtgtaccactgtacccacaagacacagccccacaacatgtcaccatgtgcctcaataccaccacggtacttcggaaaggagctgtgacagtacccctcgcacaacacaatccaccaccgcgcaccgttcctggatcataatcacccccttataaacaaggcatggactccccagcgaccctcgtgggcttatctccgccacttcttagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcagaaccatgtgctcacaacccaccattatcaagttttagttggcaagtaattaattaaccaatcacgattgaccatcgtgaactatcattaagccataattaaataatagtgagtcataagttatcccaatagtgtgctaatgtttctaagcatggctaagcaatcatatctaatatttagctgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaacaagagctttaaacgggatcaacatgctcaaagggttgtttgggatctatgtgacttgccttgctggccttggaactcttcaaattcttctcctgcaaaaacggactctccggaaacgtcggaatctaaatagaaatgagcaaaatcaccaaaacagcacacaaacaagcatgaacaatacatgtggatatttttaacatgtagatctcaattttagaaaaatttagagacttgaaccaactaaatccgagctaagatgaattacttatgaattttcaaagattaaatcagattaaatcatttatatgggttttaattgaattatgacgcaataatgaattatttttgaaaaggaaaagggaattattccatcagcggctagagttcgcggtggaccgggtgcacggcgacagctcacggaaacgaacggccgagatcgatcctatccaaaacggacggccaagatcgatcggatccaccgcggctcactgatggacgacgacgatgacgtcagcgacgacgtcactatcggcggcggctcgggcgcgcatgcccgccggtgaacgacggcacgacagcgcgaacggagggaacgaacacgtagagggcgacgcggcgaactcaccggtgaccaaaacaacggcggaagatcaacggacggcgacggcgtcgaggaagaagcggcggcgaccttcggcttgacgacgacggcggtgttccggcggtcgacagcgacggcggagtggcggacgaggacggcgacgcgacggcgaccatgatggcgacctccccgagcgacagcggcgcacggctggagcggcggcgacgacggcggcgcgaggtctcacggggctagggcgctacggacgacgagagacgaaggcaagggtggcgacgggtagcagcgggcttgggggtccttatataggggttggaaggcggcggcgaaggcccacggcgaccggcgacggcgaaggaaagtctagggttcggaggagagagatcgatccgaatcgaacttgaatccacggatttccaaacgaaattagttgacgattccataagagaaaagatagaggtgatcccggggatcatttcccctctattaatttcaccggaaacgaaaaggggcggctagatttggaaggagacgacggcggcgcggcgctagggctcgggcggcggcagcggcgcgaggaagacgaagactgacaggtgggccccacctgtcagcgggcggacgcgcgcgcgggcggctgcgggcggactgggccgaggaggagagagagagggttttgggccgactttcggcccaaagccaaaagagaacttttaaaaccttttccaatttaaattattcattaaatgcaattccatttattaaaaatacttccttacctcaaataaatcccagaaaaatctaagaattatagagttaagcaaagtatttaatgaaattttatctggccccattttatattgggatttattaattacaaattagatcttctcttctaggcttttaaaataaattctaataattccaattaaacaacaatttatatatttaggatttttagggtgtgacgcgcgcccgagccgccgccggtggtgacgtcaccgctgacgtcatcgtcgtcgtcttccgtggtccggctgtggaccggtcgatctcggccgttcgttttggatggaaagatctcggccgttcgttttcgtgagccgccgccgtgcacccggttcaccgtgaaccctagccgctgacgcaataattcccttttccttttcaaaaataattcattattgcatcataattcaattaatactcatataagtgttttaatccgatttaatctttaaaaattcataactaattcatcttagctcggatttagttggttcaagtttctaaatttttctaaaattgagatctacatgttaaaaatatccacatgtactgttcatgcttgtttatgtgcttttttggtgttttgctcctttctgtttagattccgacgtttccggagagtccgttttcgcaggagaagaatttgaagagttccaaggccagcaaggcaagtcacatagatcccaaacaaccctggtttggaatggcatattcctggtttggagatagaactgtgcagccgggatggttgttcagaatggttgggcctatgcaacagggtatgttgtatagcgttggattaatattgtttaattattacttaactgttttatt

SEQ ID NO: 32115 - DNA, 2719 bp, Oryza sativa
ctattacaggtgatgcaacaccttgtttcttcaattgcggctcactaagatggaatttcgcaatgggttggatccgttgtaaagacaactccgagagctttctatcaagtactcgtggacccaaaacggagctcgtatgcatatttggcggccatttgaagtcagcaatgtagcaggtggccgaatcgaattccagcttttagagaacttgatcttgatgtcttcttgtagatccatgatgtgagcaatggttgtatccatagtagccatggtcacatcatcctccccttcttcatggaaaaacgtcatcggtttttccatatggtgctcctcacgtagtctatttaaaacaacctgtttcttccaatcaaaacaagacaaactcgagataattttgttagcaataacatttctctctagcttgcatgttttatccacatgtacagaaggttctaaatccgaacatatgtaaactctatgcaccaaatatattcctctatcattatattcgccaaagatatgagaaatagcattagttggacatggcaaatcaaatttagcaaataatttctccttcaaattttcgagctcacaaaaatcatcaaaccaaacatagcccaaagtatttaaataagatagaaattcatgttcctctacttcatttgcaatgtgaacaacatgcttaaaatcagcacacaaagaaacactagaaatagcatgttcattcactagttgtggcatggatataagtgaagcattatcacacaactcttctttatcacaaggaacaacaagtaaatcaacttgtgacaaaggcatctcaacaattggttccaccaatggttgctctactatagcatgaaaagtggacacgtgtagctcagcttgagaatactcacattcatttatctcagcacaatttaatttaccttgcaaactttcttccgaaaccgcaggtgcttcatcctctttcttatcaagtacaccattctcctccttttgttgaatgttctgaactccctgcaaaacgttagtaacaggagagacaaaagattgctcctccaatgtttgcacatcatcattgcataaggatataggagattcagaaatgggagataaatcacattgttcatgcttcctcgcatttgatatgatctaactctcaatgctacgagcaagcatgaataggtgcccaatatgattatatgtcacattatcaaacaaaacctgaattttagaattaagcccattgaaaaatctacgcattgtattttcattgcactctttgagatcactgtagatgatacagaccttaaattcatgaatgtagtccttaacagttctatcgccttatttcagatgttctaatttctcccgaagagtacatttgtaataagaactcacaaagcattttctcattatggttttgaattcatccaaagtttcaggtttgttacaaacataactccaccaaaataatgcagaagaggtaaacttattactagcagccttaatcatttgagcatcagaaaaatcatatatatcaaattcattgtctactgctagctcctaatcaatatatgcaacaaaatcatacttcccatcatagaatggtaactttgatgcaacttgtgcaaaattatagtcatgtacctcatatgcatcacgtggagaagtcgtcatatctcatcgaaggtgtagaagttgatgttctcgtattcccttgcgcaatcctgccattgttagtagaaaacaagaaacacacacaagaatatgcacgttcctatcaactactaggtagtggtagctcaaatatcacacacactcaagcttttaaccaagctcttacaagttcttaccaaagcaagcggaatggtgatgtacaccgactcaaccaagcaccacaacgaagtttggatgtatgaatgccttggcaaacacttgttgtacggctgtaatcaaatatgtggagctctgggtaggcttaaatatgtagcaaaggaatagcaaatgctcaaatcagagaatgcaaagttgaataatcgttcaaagtcaagtaccgtgctggtcctaggctagaacgtactagagacgcgagcctagacacaaacgataccacaagatagcactaggaacaactcatgcacaactctgatatataaagttcagctcaaacataacagtattttctcttttctttctttcttctttcttcttttcttttttttcctttccttttcttttctgtttttttttggtgcggctttttgttttcttttttttttcacctttctgcctttttttttctcacttttttcttgattttttttaacaaaaactgactcaagtaccttaatgtaagattacagggactcaaacataaatataaaatttacagggactcaaatgtaaaagtctaaacccaaaattaaaattatacaaaaaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagat

SEQ ID NO: 32116 - DNA, 962 bp, Oryza sativa
taattcctgcagcccttcacatttattactaagtcaaaaatttagactaaagcagatgactaaacatactcaagatcaagatcgtgcaaaatgtgtgtgtggtgtatggtggaaatggtacatgaagaaaaataaagaaaacacttctcctttgtgcttactttcttctcccaaaaatccttcttttattgcttaggagagggcatggctacatttttcttttcaacatcatgctcaagtgtaacaccctgcctccaaaatacgcattagtccactctacatgttgagcggacccacgttcgcatggtatcccacttacactttcgtcctcgcttcgtgtaaaagggttaacctggggataccatggttggagcaccaaggcttataagccggccctcacccacctaaacttccaaggtggtactaaaccaccactacacattcacttctaggccacatgggccaaacaccacatgggccaaacacacactactaggcttcaaacgggctggggtgttacattcacccccgcttaagggctaacgccccggcagcacaccgtttacatggcagaggcccagaaccccctccggtgcagaccatggcccaaagcacatgcatcatacagcggaggtttacgctctaataccaactgtaacaccctgcctccaaaatccgcattagtctgctctacacgttgagcggacccacgttcgcatggtatcccacttacacattcgtcctcgcttcgtgtaaaagagttaacccagggataccatggttggagcaccaaggcttataagcaggacctcacccacctaaacttccaaggtggtaataaaccaccactacacatccacttctgggccacatgggccaaacaccacatgggccaaacacacactactaggcttcaaacgggctggggtgttacatcaagcttgatggagcatgaatttttt

SEQ ID NO: 32117 - DNA, 3177 bp, Oryza sativa
  unsure (1)..(3177): unsure at all n locations
actcagatcagcaagtgcagctcatttacctcaggttcccagataattgttggctacttatatttaacctttgagagagcacttaccaagaacccatatatcagagatataaaacagagcaactattcatcatttcaacaaggagaactagcttgtcttacctagcatgactcaaacctatcctatctttttggtattttctattttgcacatttttatgttgtttttatttttataagatgcaattggaaagcaaatatgtaatttgataagagaaatatgcaatgtgatacaagttacctcagtgggggggagcgatgnctncccccccccaagcttggctttcgctcagcgtccttgataaggattgaacccctgaaaacgaaagtacacctgaaggttatcgtgctattgctgcatcatgtcgttgatgttggcgaattgagcatcagcagattgttgccattcttgtgtttgagctacgtgttccgtgaggttgtactggatttcccctatctgtatatcaagggtgtccattctcctaatgatttcactcaagtcccaacgggaagaactcgagcgccattcacttggagatggaggcacaccacttgacctgggaggttaattgtccccccattggatgtcatgaggcgcatgccaccgatcctcactggcgcttgcccaagttgagactccgatgctatggcgtggagcttgggtccaaccgggtgcatccccagttggtgcccatcctgcctcatacatctgcacgggtgtcgaggatgatgaactttctcgttcattccttgtcatgttgcgcgtctctctgtatgttccacctgcacgagattcctctatggtctgcacgggaatggttagttcatggcagttgtacaaatgataccccgcatttggcaacgggattccatttgtacaaccggggaaaaagtataccaaagatccatctactccacgtttcagaatatgcccttgcactagataagctttatcaatacgcggacgagcggctgagataaaagcaatttggtcgctaatgacccctagcccttttgctatccgagtaatcagagaagtgcactcaacaggagcagagaactttatactttccaaccatactcttgcagtcgttcccatgcttcaggaatggactcgtcccttgtttgctggaaacttgaaattcgtccacgcagggcattgattttgcccatcgggaagaattttgagaggaatgccgtagagcatttgtcccaggtgttgacagcaacacggttggtgtagaaccactgcttcgctctcccgaggagggagaacaggaacagtctcagcctgacggcatcgagattgacgcccttgatggtgtacgtgctacagatctccaggaactattgcagatgtgcataggcatcctcattaggctttccacagaacgggctaccctgtgccatcgtaataaggctggacttcaagtcgaaatccacgtctcctatgttgacctgcagcctagtggccacattgtcagcagagggagcagcgaactcacgaagagttctgctagccatagtcttgaaggtcgggggcactggtattgctagtttttctatcggtaaacttttcttcggagcaacgactcgcggcctgacactccggaagaaagcttctggattttctttaaagttttccgacaggttgaaaccagtcattcactaccctgtttccacaacaaatagtgaaaacaaccaaggttagcttgcaaaggaaaatgattatacagaggtaaataaaaagtattagttcaagttatctctattatgaatcttccccggcaacggtgccagaaatgcttgttggtatttcttaacgacattactaaaaatataattcccagcaatggcgcagaaatacttctggtatattatggttacagagttcatccgcaagcgcatggatataccattatagcatttcacccgagagtattctaagggtatcgtatttattttatcccgtgggaagatcatgtagagagagcttgactaataatttatatattacttgtgataatcgtattctaaacaggggttaagataatcaaagcgtagagtgacacacaagcatgaactactcattctcatgataaatcatctaagctaagtggatagaaaagagacagataatctattcctatacttctaatatacatagtacacatacattcttgttaactgatatactagctaataccctctttccgatgcgctcctgttacttcgagtaaccacccctgactgctgagtttcttacgacagcccgtcatgactatacaaccggggctaaatacggaggaataccctccccaggaaattaacttaggattatataccggcgcggaggaatacccgtactgagctatcaccataagcggccacctctcatccgcaatatataaccccaaataatgatatcccgtaatctagacaccacgtctaaactaccagatactactctaatatcatcgtcatgacatagagtaattgcataagcaaacattatacccgcaccaaagcatctcccagataagctagccgtatattcagtataacatgaacatagtgtaaagtaggtactaatattctcggaaagtatttcaatattgtaaatgtatatagaagattattttaataaaagtacaaagcttacaaaagaagaaaggaaagctgctagagccatacccgaactcttccgaagacttccggactcctgatttctactctattcctattccaccagctagatactactaaactaaaattgagagaaatgggagagctattgcttgaggtgtgtgagtgaagtgagaagaggagctccttttataggtaggtaatgacggttgcgacggttggaatggtcggtaataccctcctaccgtcattggggatcaatcccagccgtccatccaaaccttgcatccatcggcgccacgggaggttcagccgaaccccccgaaccatgggttggctcaacccagcccatctttggctagcggcctccttcgtgtcctccttcgtagacttccgaattttggcccaatgtgttgtgttaattctgagttcttggcccattcatacataagtctggttctgggctgcagga

SEQ ID NO: 32118 - DNA, 1896 bp, Oryza sativa
ctcctctcctccacttgtgcaaactctttcttcatcccaattcaattccttgattctccacccacaactcacctatggctggcaagtccttgatcccatacattggctcctcctccaattctacctacaatctcaatggagagccaacaccggcgaatcaattgatcccggtggaacactatatgatggaaggggtaaacgcactgtggacacagcctctcgcaacagtgccgggctccctgcaaatttggagcccgccggcgagctccctagttcggccgaaccctcctcggccccattcggcagcgcgatccctctcccctcgtcatgtcatcaagaccaaaatccggggggattcgcctgcgcgacagccgacaccgggagagctcggtcttttgaaggccgctccgcctcccgccgagcgatatgtgggcaccctattcaccaaggcaggggatgaggtgctccacaagtacaccacacccaccgctactccatccactccaaaggaggagcgattcggcatcatgggagtgcgaactaccagcggtgggtatggcaaaggtttactccggcctttgatggcatcggagaaggagggggcagcggaatcccgtagccctccacctatgaaggtgaagcgtcacttgacgccccctccaatcgtgaggactcccagccaattccaagaggatgaagtaaagtcaccggagccctcagtccaaaagctcgccgctcaagtaaagaaactccgcaaggagaatatagagcttagggatcgcaacgcggagctaggggttgaactcgctgaaattagaaataatgttgatacccttagctgtggtttgtgcgctaaaatcaagcgtgcattcatagagatggggaaggaaaataaatattatgctaattagatgtctcctttcccataaataaaatggtagtaggtgcttggtttttatttttccaatcatgtaaagcacttactatgaataatgtggctcattggtgttaaccccaatggttgccaaagttgttttttgttttatgtttaataaagttcaggttttgaataagtgtgggggagatattctagcttctgacgtgcatatactctgaaaaattgctgaatctctgaacacctggaagcactcaactctgcagaaaactgcagagggattgagcaccagagtggttcggccgaaccaccaggttcgaccgaaccaaagctggcctcaatccctctcaactttcataggtaagctggtgagcacgtctattatctgtatatctccaccatggtatagtactagagctggaaattcaaaaaacaattggtccaagcataagtaaaagataaaatttccaattaatgaaaattttcatatgattgatcttgtatattcattattctcagctgaatttgtgcttgtgaacaaccctccatgtttagggaaccttatacatccaagtgattgctatatgtgagatgattaaagatgaaaggaattcttgcaactcttgttatgactcttgggaatttgttttcaaaataacatgtttaaaaaaagctcaatcctccaattgacttcatgttatacctaccaaggccatatgcaagagtatctttgataaaccttattatgcatatgactgcttggcattatattgagctttgtcaaattgatgtgactcgtgttagatatctttcatactctcacgatcaaggggtcaattccactttcatttccacatacatgataaagctaagcttctacactggaagttggcttcccacaaaaattccattcaaataaactcgtactttagactatgctttcttctcctagaaaaaaatccttggcaaaaagaaaatgagaaaaggagggaaaggcatgg

SEQ ID NO: 32119 - DNA, 5822 bp, Oryza sativa
aagaactggaatcgagatcgttccatctatcaattactcaagatggtaagatagccactgataaagttcacaggaataggtatggttgtgaatgatttgtatgcttgattcatatcttgaagaaattcattctacactagcctttactcatggacaagcaaagggctaagtgtggggggttttgttggcggctgttaaatgctgattctataccgctaacatctgcataaagttcaaataataaaacatccaacatagtgataggtgcttaatctcacatattccacaagtgttggtgtatatttgtatgcaggtgataaaccctgaagttgggaggaaaatcagactaaagtgaggagaaacaagtatccatacaaggatgggttgtgaacttcatcaaaataccaaagactcagcccaaaattccaagaaacagacaaaggagagaccagggagtccacaggccgaaggccagcccgagagggcccagcccaggttcggccgaacccaacccccctgatcaccgttgatcctaatgacggttgcggggcagttcggatatttctccttctcacaaccgtcataactgccctataaatagacctcacttcttcacttcacacacacacttccaagcttgagctgaattgtaagaggctctattgtactatattgtatactagaataggaagagagtagagtagaagaagtcgtaagaattccggagttgtcggtaatcttcttctatttcttttattctgtttatttctctgaattcaatataatattcttcgtgagtaatttagatttatcttgtgagaattatctcttggttagttcctaaatagcatataggattattgttcactataatcaactaaaatatagtgattgctttggtgagttataaacactaaagtagatattaattgcttagacgtggtgtttaggtaattgttatccagtaattgctgcgtatcccactgtacgtttgttaacagtgaaatttggtaatcggcaacgtttgatgtaggtgtagaggtggtgacagccctcaagatcacttaagtcctccctatccgggtatgtagtagagcgacaactcgtttgtccatgttcccaaccctttctcctcgttttccgcgcgcacgcttttcaaactgctaaacggtgtattttttgtaaaaagtttatatacgaaagttgcttaaaaatatattgatccattttttttaaaaaaagctaaaacttaattaatcacgtgctaaacactgtttcgttttgcgtactggggagtcccgaccacagcctaatagtggttagctggctggaaacccagtaattgcattgctcacatatactcccaaatgcactgtttacctaagggccaaaaagaaaaacactattcaattcagggtgcccccactgttccccacatttgaagtctgaatcaaaattttctccaacttttagcacggattggctttcaatagaagctgggtcttatgggtcttatgacctttcttaaaaaaaataagaaaaacttttagcacggataaggccctgtttagatcctggtaaatttttttaccctgtcacatcaaatatttagacacatacatagagtattaaatataaaaaaaataactaattatatagattgcgtgtaaattacgagacgaatcttttaagcctaattgctcaatgatctgacaatgtggtgctacagtaaatatttactaatgacggattaattaggcttaataaattcgtctcacagcttgcaggtgaattctataatttgttttgttattagtctacatttaatactttaaatgtgtgtccgtatatccgatgtgacacgccagaactttacaccccttaatctaaatacagtctaataaaataggagtatacggaaaaagagcttccgtgtcaaagaagatatggtttagtccatcctaggacatttcgtcatctttgctactagtatattctttcaaaagaaaaatctttgctgtattccagaaaccaagtaatggtcagattgatgcgcagcaagtatataaaaataaaaggcaatagtctcctgttcttatttagctcatagtatttttttatcgttgttttgttttactcacacgtaggaatagaaatggcccccttttctatttcgaaagttcagcggcaggactgggaagcaataaccgaaccgaacttccctggcagaaaagaaaggaaactggtttctcgaaaagaaaaaaagaaagaaaagggaagtactatagcagtagtaatatcatctccaattcgttcccttctgttctcaaaaagcaaaaaaaatcgttcccttgctccatcacctcacccctaaatggaaccacatgtagtattcggaggagggggttgggaacccctcctaccaggcacgcaaaacgaagttcattttattgcataattaattaagttttaactatttttttaaaaaaatagattaatatgatttttttaaagataactttcatataaaatttttttatataaatcacgtcatttagcagtttgaaaaatatacgcgtggaaaaccaatggggcaagaagtagcgtcaatgcgtgatacagtcccagacgcacaaaacagctacagtgcaacatggactgtagacagctaaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtcttgcaaattagtccaagattatggatgggttttattaatagtctacgtttaatatttataattaattttcaaacatccgatgtgatagggacttaaaagttttagtctcatctaaacagggcctaatactcgcacgcacgcattcccatgctgcccacaaaaaaacgattggaaagcacgcgcaaacgtttccatcccgtgggatgcttccaaccaacggcagcagcaagctgcagccgccaacccaacgtcccaacccacgcgacgcgacgcacgcaggcaggcaggttcgttcggtgccaccacccaccacacgccgctgcgttccagtgccagtccatctccagtggtcagcggcgcagccaatttcccttcccccgcaagctatagccaccctgaccgaaacgcggtttttattagcgggggaatgccaattccttcctcacgccttccccccacccacatttagactctacgagacacaccatcacgccaccgagtggtactagcctctttgcacggcaactcggagcgaaaagctctttttacctcatcttctcctcttgttcgtcttgctctgtttctttcttgttctctcctggacttgtggtcggaggtgggattgatttgggtgacatggtgcaacaccatagggccaccctcctgctgcaccagcagcagaggaaaggggatgcgacggcagaggaggggcagcagctggtggccgaggaaggagccggcaagatgaaggagctccggcgccggctcgtggactacgcgtgccaccaccggaagcacggccacgacgcgctgctgcggatgctcgcggggttcgcgcttgtctcctgcctgctgctgctgctgccagggagccctttctcagccgcggtcgacgacctgctgcagatggggaggacgcgcctggacgacgagacgccgccgccgccgccgtgcgcggccgtgtccaacggcaccatctgctgcgaccgcaccgccatgcgtacggacgtgtgcatcatgcgcggggacgtccggacggaggccgcttccaattctctcttcttgctcgtgccgccgccggacaattccaccgccgccgctggccgggacgagcgcatccgcccttacacccggaagtgggagtccagcatcatgagcaccatcgacgagctccggctccgtgccgtgcccgaggggggtgcggcgccggctagctgcgacgtccggcacgacgtcccagccgtcgtgttctccaccggcgggtacaccggcaatgtgtaccacgagttcaatgacggcataatcccgctctacatcaccgcgcgccagtacaacaagaaggtggtgttcgtcatgctcgagtaccacgactggtggatgaccaagtacggccacatcgtcgagcagctctccgattacgcgcctatcgacttcaccaacgaccgccgcacccactgcttcccggaggccgtcgttgggctgcgcatccacgacgagctcgccatcgacgccgcacgaatgccgggcaaccgtaccatccaggacttccgtcggatgctcgacgacgcataccgcggccgcatacagatgatcatcgaggaggaggagaaggccgcggcggtggccttggggacgccgacccaaggcagcatcaggaagaagagcgcgctcaaggacgacaagccacgactggtgatcgtgtcacggaacgggtcgcgcgcgatcgagaacgaggccgagctggtgcgtgcagctgctggcgccgggttccgcgtcgccgtgctccagcctcgtcaggatacggagctcgccaagatgtaccgtgctctgaacgcatcggacgtcatggtgggcgtgcacggcgcggccatgacgcacttcctcttcatgcggccgggctccgtcttcatccaggtcgttccgctcggcaccgactgggccgccgagacatactacggcgagccggcgcggcggctcgggctgcggtacatgccgtacaagatcaagccggcggagagctcgctgtaccggcagtacgccaaggatgacgcggtgctcaccgacccggacaccgtgaacgccaaggggtggcaggtcaccaagaaggtttacctcgatggccagaacgtgcggctggacatggtacggttccgtcgccggctgcgcgacgcgtacgaccactgggcggagctgaggaggcgccacaacgcggacagtactgagacggaacagcggaaaccatggtaggagtaggagtagcatggtctcctaccgagttcttttgattaattctttctctttttgacacatatacatggttaattcaaatactgtatagagaaattcagggagatagttgctttacatgccaccagtttgatgggatgagtgacacttgttaatggactacagctgttaatgtacatactcataaattggtaacaggagcaaaaacaaacgcaggtacaaaggtttttgtgtagtagatgtcttcacaaattacacgttcggtaatttgcaaaattgcatataaggaaggatgtgtgctttttcaaataaagggaggagctatatatatatatatatatattcggaattgctaaagctatgtcgacagaaaatctaaccacaaatcttgtaaattttggatcactggatgtgcttcacaattcatgttcttcttcaccaactccggcgaccacctcttcttctccggcaccagcgaacccgaactccagtagagggccaacgaattagggtcccggggtggggtgggggtgggaagagggggggagggggagggggaaaaagggggagtttgccggctttagagggatggccgtaagaggcggcaggctggaagacagcggtgggccggcgttggtggatggggcatctcgccgccgactgctcaaagaagaaagagggggggaggggga

SEQ ID NO: 32120 - DNA, 8031 bp, Oryza sativa
  unsure (1)..(8031): unsure at all n locations
gggcctcgccggcgccgttgacgccctctgtccagccggcaaggcgggcggcggcgcagaggggcggtggctgccagctggacagcggcgcagaggggcggtggcagcgggagttcatgcgagggacgagaggagtggtggcggcgtgatctggatagggaggagaagaggagttagggttaaagggtctgctcgaatcttaaagcatatctaatagtccaaaatttgaaagataggaggtggaattttctatcaacagatatgtagatagtcccatattttttgctgtcctgttttgtttccatatggtgctatattttttactaaaaaatagtcggcattcatatactccctccatctacaaaagttacacctatttcacatttgagtttttccaaataagttgttcctatttataatctttaattctttatgcattcaagacttaaatgaagagataaattaaatgttttattcgaactcaaggagtcatctaaatattcattggttgtatgcttgcattcactccttaattttgtaacatccaagatgatttaatttctccttggtcttggtatcaaaagtaatatgtgtaacttttgtggatagagggagtatattgtaaatttctaaattacatatgtaattttagtgtatttacaatgtaagtctcaaaattacatatataagttccaaaattagatatgtaagtttaaaattacatatgtaattagtatgtaattataatatactccctccatcccagaatataataagttttatggttggacacggttattaagaaagtaggtagtagaagtgagtggtagaggattgtgattggatgaatagtggaggtaggtgggaaaagtgaatggtggagggttctgattggttgggaagagaatgttgatggagaaattgttatatttcgagacaaattttaagtgctaaaagttattatattttgagacagaggaagtaagtacgatgtgattagtacgagtaatttatccgttaataatatcagcatgtacgctagaaacaaaacagaacagcagaaaatatagtttaatcttcgagtgaaagcaaatactagccccacatcttggagataattggaccgagcaaaaatcgactgcaaccggttgaaaaaaatggcgacacaattttagcaatgccaattcgaaaaataccccacctatgaatgccaagtcgttagcgccgacacatgcaaaagatgtgtcatcaaatagttccgttagaatgacaaagttctttcgagcttagcgaccaacacatagcacatgaatgttatggagtggaacaggacattttctggggaataagatcgaggaatttccaacgacaaaagtatttctagagccaaatgttcgctctctttcagtgaactctaacatacacacccaaagtgtcacctcggcatgaatccagtctaaactgtacagtgttgtttttttttttttttttgggatatgacacaaggcactaggatggtgaaactgatacagcaggatacatcacgtaatgatctctgacagtggaggtgatcagcggactggcaatggccatctttagaggcagctaaccatgttgatgttgagcaattcattggtcccctgccacatactctaaggagaaacaccagccattcgcagagaaattgggccatcagatacacaaagaattatgatctcactggtctttgagcaaaatcttccattaatacatcttacattacagtgaaggctgcagtgtcatttcttgcccattctggtgattttctgatggtcccccaggtgcgtctgtaggaatcttcgaatctgcacagtgttgtaaatcccaagcatcatgttagttcattgtgtatacatacctaacgatggcatattcagactagttaaccaacaaatatattataaacacacacacaccaggttcagttggcaatggagttgaggatttgatctcttcttttgcaggtgttgaaacctttgaacaaggcttatgaaacagtaaatgtgccacaatgcggtcgattggatttgtgtttgtttctgcttcacttgctggagatctgggattgtatcaatcaagaatttgtcactgaaaaaaaatatacctattgtactcatatatacgcaacggcagctagctacttgcaagcagcaaaaagatggtataaataagatgaattggtacgaggtagaaattgcagatcttcaactacttgctggatgatgaaggaatttcagagcttcttggctagggttgtgtttatttttttggagagattttcagaatcttttcgtacaaggctgcacattccagctacaaccaaaatgtcaggggaaccttcagctgttccctccaaccagtacaacaaaaaaactagcattggatccatagtatccttttactaaggatgaactaacaaataaaatcttaaaagaaatgagaaaccccaacaaaacaaagatgttgaaacttttgattacttaatttcaatattttatcctattcaatttcaaatatcattgggtaaatatgatatgataggacaattcacaatattagaactgttatcctagtttaattagatagaagtacacaaacatgatgccattcagatcattatcccctgttgtgcccgatgtactgttgatgactggaacataattttattcctaaatgtacaatcgttcaacttaggagtatcttgatctaaaatagcaatattacttatatactccctccatccaaaagtcttaagcatattttttttttggttttaccaaatgagatgatcatatttgcagtttcaatgtgctaaattaaattgttgatcagagcccaagaaaccatcttaatactcattggttgcatgcatgcatatagttccttgattttgttacatgggggatgagttatattcttcttggttttggtgaaaaaagaaatatgcttagacttttaatggagggagtattgcaatattgcattatgtacagtaaagcaacgcattactactagcagtgtccaaatgcgaggatggtaatacttaatggaaccattatggcatgaagcaaagcataccttcttttagatgtgtcttctgaaacttcatcatcatctttattactcttgttagcactacttctgtcactagtaatttgtctctctgagacactatgggccaaacggagtaaactgtctcgaatacaacgccgagttctggtatccaactgtgtaaagaagaaaatatggtcaattaatttatcttgaaataagccctgcaacagatatggtcttacatggcataaaaaaatcaatgtaaaaatctgaagaaatactaaataagctaccttcgcaagagcatcttgaagctgataatatattttttcttctataaaggggtcatcaggaatcccagaactcttctgaatctcttcatggccagttggaatcagctctagtgagaaaactttatttgcattatcatctatgacaacagaactccctaaggaatctggatttttgctctttggtgagtacgcttgaggtaccatggtatcgctgccagaaccatcttgaccaaactgctgctgctgctgctgaatagctatcagtgcttgcatttgctgtcgacgcctaagcttttcaatcttttcttggggtgtcatcatcaatggtcttgatggtatatcttgtgacttttctgcggaacttgactgttttggggaatctattgaagttcggtaatttgtagtagctggctttgtttgatggctttcagcctgaacatttgacatcagaggaatgccaggaaattgatatgaaggatatccatagtcagggaaaataaactgattagcctgctgaagttgtcccatgttcttgttatcatgtaatagcaagtattgaggagtctgaaggggttgcgcaggggctttggccaatgaatgcgaactggctggtcgatgctgtccttggttctgggagaagccacttgtactattggacattttacttttgcctctttcttctgttcttctccgtgacctcactgacttcttctgcacatctccctacatggagaagcatatttgtgttcagaaacatatttacatttagttaggaagagagcaaacttgttccctacaagtcagataaactaatcaatattcaactgcatctcaaatcttaatttgaaaaattgacatttataatgaaaaaggtagataaacatgacaacctccaatagaaacaaaaaaaaaggagtatcataaatcacaagagtatcatataatgaatgtatgttggtcattatgatgcctcacagtgcttaatttactggaaccttaaaagacatcacaaagttatagctgaaactgtcagaaaggactttgatttataattaaatcagtttagatggcttcctggatttaaaatacatgctaatgaagaattcggtaaaacaaaaaactaattcgaaatgaacagctgtccttcaaacttattaccctaaatgtaaacactcttatatgagggatcagaacaatgaaaacaacctcaggacatattttagtgtatcactataacaaaatgtgggagatggatttcattcataaaagttgataggatgcatcacatggctgactacctcctttggaaactgatttggttttccagaatattcattattcagatgatttttatgctcagcttgctctccagatttagcattagcgtctactacctgccaaaaatgaataacaggagtagccaagaagtaactgctaattatgacacataaatgcatgcatttagacatttaccttgctttcttgttcggtagttccaccagatgtttcattaatcagaagcgaagatccatgatcagaagatagttgtttattcagtggtatatgctgtggaaccatcaagtaaatagtatagataaaaaatagttcaaaattatggaaagagatgaaaattcacagtggaagattattaatgtatcgacatactggaaaggggattgattgtacagtagtatccaccagatctgaagatgctgagagaaaattactgccatcagcaaccatctcattaccaaatatggagtcaccattgctgtagacaataacatcatgtgatgagtttattcaattgtaacatgtgatgattttattaattcataagatttcagggaaaacctcttccagtgtctgatattacctaaataagcggtcaaaatcatcaaaatctccgatattaccccagtcacaatcaaggaagctgttactcttttcttcatgatcattaccaaacacttcagtttcaccatccagctgcactgtacatgggttaacanaagctatataatttgctcacaaattatgtcacctcttctttacataaatggtatccttttttccatgcatcaacatgcttatagattagctgttgtgaagatgaccaggaataaaatccacacgcagcagtaataggatgaaacaaacctgttgtgtttcctgtgaccttctctaaactaggtgcagaactgaaatccaaatatgtagatgctatattatcatcgctgtagtttctatcaagtgtggcattcaaagaaggcaagtcaggccaggattcaacgtcaagttgtgtagctgaataatgttcactagcctgagaggcaggctgcttttccaaaactggaaactcagtttgaccacttgaacttcgttcagtaaggccaggaatattatcagtttcttcatcattcttcttctggtctccaacacttactaatgcactatcctctgtatccttagggtaaggcacaatatggtcttcattctcattgaactcagcccatattgcatctcccacctgcaattcaaacgataatctgaaaatactctgaggaaatttaagcagagtctcattgtcaaattattttgaaacaatttacggagccatcgtttcgcttattcgcggaataagcgaaacgcgcgaataagtgaaacggcgtatttgcaaatgaaaagtaatttgtgaataaaactgttatatacgtgttcttagcgatctaaaagaaaaggctgaaaaataaattttgatgaaaaaacctcaaaatcagctccaaatttaaggttgaaaattcaaattttagctgataagcataagcataagcgaaaagatgaggtcctaaaggagaacacacatgaatataccctacaatataaattcaattgtatagtagaataaataatgtgtaaaattagagtgcaagattcctatcatggttctctattcataatcgagagtgatatgagattatacaatttaggtcactaaaccgaaactattaagccacaacgttttaattcatatgggtaggcctgctgtctgaatcatgaatttttgataaaaagaagaccatttttcataatcaatccaatccattttacattacccaaagagtgacctactataagagaactttaatacaccaaatgacataagtatcagagtatgatcctacttctaataattcacaacagaaacactgtaacttgaagttatcagcgtccagcagccgtcacgtgaattcaaaaatatataaccttggttcacaatactgctatgtagagaagactaacgatagaagtcagattggcagcactcccgtggagtcgcaaaagattattgggacatccaccacccgtcgacgcaatagacaattctacaagttacataacttccaatttagtgtaaccttaccttatgagacctagcacaacccaaccgcacgcggtagcatctaaatgcccacaagactctctctgctaggtgagcctccttggaaataatcctatcatcctcgctcgctcgctcacaatcatcagctgcttcttcgagcactaaaatcccctagaaatgagaaggcggaaaagcaatatccccttaccagaccaccacatataaactagcttcgcgcggtacacgtgctcgcacagcaaagcagatccagccgccacagcatccgcggcacgaaactacagctaagaaaagcaaagggaaggacggatttcctctgcggcgcacctgctgctggtcgtcgttccactcgaacatcctcctcaggtggcggccgccgctggcgccgcacccgaacgagagcccgatacgcgctgccccccgggtcccgacggttgcatctccagccacggcaaaagggaagggcagaaaatcctccaattcggtgacgcggcggagaatcgcgttgcgcttgctcgcttctcctcctcctccactcgcgacctgtgttgtcgtcgtctgcgcttccctctcccccctctccctctctcctctcccttcccacccaccgagaggagtccagggaggggcggacgcgtggtgcaagatgattgggcgggcggtcggggttgaggtgcgggagggccacgtgtggagggggcgcatctcgggtagtggcggagatggctcgatcaaatgccgctcgttgattggctactgcgggacttagcgggttaacgggcggggcttagcgggctgggccgcgtcgactcgtgggggtcgcttttcatggcttgttgggcgggccgccacgggcaaaacgtaggaccagagatcactaagctttggtcatattagcgactccatatcaccgcaagtcgtttaggtattcaatcatgtttgtctactggttaaaaaaaacttatcaataaccattagtaaagtacaagtctagttgtgggttttgtatccaacgattgaccatctgtattattagaaaatttttatgattattagtatttttattgttattctttgtgtgatttattttttaaaatttttttatagatttttcaaataagacgaacgattaaatattggatatagaaactcaccactgtacttagggtgcgctcgtctgtgtttattgtagtatcgaattaaatctgagtgtaatcagtactg

SEQ ID NO: 32121 - DNA, 16902 bp, Oryza sativa
taatgtgatcagcaggatgattagttgtagattaatgtacacaattaattgctcgataaaattctaatgaatgtgaaatgcgtgattaacaataccaaagttcacatagatagcaatataatagcgttatacaaattcgagtagaacaacaggacagttgtttctcgtaccgagaacacacataaaataggctaacttgagaaagacatgagcaaggaatacaaatttattaaggatagaaagtgatgcaggactaattgttgtaaactttcaatcacgtcacgaacagctctcatccccgcggcactattccgtgcgtcataccaattgcgcagcagtggtgcctgtgggatgggcgggtacctgttgtacaaccggttctgtgtcatgaaatgggggtctgcactgtcgagcctgaagttgtggagagcaaaaacgcagtgtatgatcttcgtttgggtgtggcctagggaaaagaggtatctccctaagaatcctacactgactcttcataactccaaaagctctctcaactgaagtacgcagggaggagtgcatatagttgaatgtttcttccctcccttgcgattgaccagcaaattcattcaaatggtagcgtacatgcgggtacggtggcaagaaaccgcactggcaagcgtacccagaatccactagtagatatttacctagacagtgaacatgagaaatttcagatgaaaattgcatgagggagtaatatgatggtgttgtgtactaactggattaaaaaaaccgtcaacattggtacttaccccatggcagccttggaaaactatggggatagttccggatagcttctgtgagcacccgctggtcgtgcacagctccaagccatccggcatctgcaaatataacacgatcgtcccatccaattacaactaatacattccttgatgtgatatggtgacgattgcggtgcaaattagcttcttcaactgcaacatgaactgggatgtgggtcccgtctgcagctcctgcatccccagcaaaaggcaagaaattttcatcttgcgcaacacggttatgcactcttcgaaaactaggatccacaggcttgttgatatcagctgccatggagtaaactgcatggtcaacagacactctcctaccaaggtcaacagacatcatcagcgaagatcaaacatacgacaacgaaatcggttaagaatttcacttacctgctggcaggcagcttcaacgtcctcctctttggaggaggagccagactacctgtatcccgcgtaagatagcaaatcatgaccccattccggtatctttgaaaaggagtcaaagagcgaggacggtgcgctttacctcggagccggcagacttctgccgagaaccggcgggagcgctcgatctcgcccacggcttccgcttggtcccgctgccccctgcgatggcatgagcggatgagatcttggcgacctcatcagcgaccttgccctttagcgaggcggaggcctagtggtcaacaaggggaccgatgacatccgtcaatggcaagacctgcaagagttgaagtcactttggccctttaaaagaataaagatacgcggcgtcccggttctcgcttacattaatggcagcagctttctcggctgccgacttatcgcagagcggggctggcggctcttcagccgaagaggtgccactgatcaagacctccttgaccctctgcaccagcgtgtcgtcaagaagatctaaaataaatgaagatacaaggaaacaagattagatctcgtctacaagtttaacatcgaaagtgatgagatgaaccctgaggtcctctcggcactcaaggctacagtttggcccgatctttcggtgagttcagataactacgatttgggagaaacgttgatgatccgactacaaccgtacaagacgttgcgttgcgccttagcgatcgatacacctcttcgtgggttgttgatcttgccggtgcagatcaaccctattcctgcaagcaaatcgaagaaacaagcaagaacaagataaaagcaatctaatattgcaaataggaattgaatataaatgataagttggggtttcggggtttcgaatacaagcagacggacggtctagccgacacgtgcgcttcaaggaagtagcaatggctaaactttcatctaaacaaaacccaactaactctgaaggggttactagctatttaagggatggaggaggtcagaagggcgttctccctttgtttggggcgcagccccccttgggccccacttgggccggggtcacaggcccataggcccattacagacaatgctgccccttatttcttcaattgccgatgactcagatggaatttaacaatgagattggatccgttggaaagaggattccgagagctttccatcaagtaatcgtgggcccaaaacggaggccatatggagatttagcaactgtttgaattcagcactatctcaggtggccgaattggattccagaacgcggcggacttcatctccatctctgcatgcaccatggccatcgtgtttatcttccatatgcaggccaaaataagtgaattggtcctgaacatataaacacatacattatgaggcagtgtcatattcttgattagattaaattgacacttgttatgaaacgataccacctatgggtatatgacatgatcaatggttgtatccgtcgtaggcatggtcacatcatcctccccttcttcacgggaaaatgtcctcggttttaacatgggtaattcacatagcatatcctcacgcaacgcttcatatggcgcattctttactgtatatggcagcaacattgagcgatctcgtcgctccccttcttcagaaccaacctgcgtctttggacaaaagcaaaacaaacttgaagtaacattagtggtcctaacactactctccagtttgcattttcttggcacaacaacagagggttgcatatctgaacaaatgtaaactttgtgcaccaaataaatttctctatcactatatttgccaaagatgtgaaaaataacattacgaggacatggcaaatcagaatgagcaaatattttgtccttcaaacaattgagctcacaagaatcatcaaacagaatatagcccaatgtatttaaagaagattgcaattgaagttcatcattctcactggacgtgtgaataacatgcttaaattcagtacatggagaatcaagattaaaagtagcatgttcattcactagttgtggaatggatataagtgaagtgctatcgcacaactcttctttatcacaaggaacataatgtaaatcaacttgtgacaaaggcaattcagaagtaggttccactaaagtttgctctaggttagcatggaaagtggaaaagtgtaattcatcagaaacatactcaccttgagtaatttctgcaccatttaatttaccttttatcccctctttagataatgtaggtgcatcagccttctcctcattcgcgagtgatggaagtgacatctcaaacatatcgttcttctcattttggggactgttctgaacttcctgcaaaacatcagtgataggaggcacaagcatagcttgttgctctgttgggttctccaaaattttgcgctcaacattgcaagcaagcatgaacaattggcctatatgattatatgtcacattaacatgcccatcaaattttaaaatcatgaaagtactccctaacagttttgtcaccttgttttagatgttgaaatttctcaaggagagcacgtctatagtatgaaaacacaaatctttttctcaatagtattttgcattcatcccaagtttcaagcttatttcccacagtatgccatcaaaaagatgcagaaccggtacacttattactagcagccttaatcatttgagcattagaaaaatcatactcatcaaattgtttttctactgctagctcccaattaacgtatgcagcagaatcatactttccatcaaaagatggcaaaaacagactcactcttgcaagattatgatcatgtaccttatttgcgtcatgttggtcacttgccatgtgttgtcgaaggtgaaaatgtccacattgagcacgaacagctccaaactctttgtgtaaccctgccatagttagtagcaaacaagaaacatatacaagaatatatacgttcctatcaactactaggtagtggaagctcacaaatcacacacactcaagctttttatcgagctcttacaagttcttaccaatgcaaactagaatatggtgtccacaccgactcaaccaaacactcgatggagttggatgtatcgacactttggcacacatgttcacaatctgtatagctgcagtcaaatctgtggagctctgggtaggcttaaatatgtagcaagtatggcaaatggttaaatcagagaatgcaaagttgaataatcgttcaaagtcaagtatcgtgctggtcctaggctagaacgaactagagacgcgagcctagaaacaaacaataccacaagataacactagaataagctcaagcatcactttttttttgagaactactcaagcatcactttgatataagagaacaaaatcaaagataagagctctttttttccttttttttcttcttccttcctctctctttttttcctttcgttttcttttctttttttttgttgcgcctttttttttcttttttttcacctttctgcctttttttcccttttttattttttttcaaaaaccaactcaaggacccggatgcaagattacagggactcaaatgtaaatataaaaattacagggacttaaatgtaaaagtgcaaacccaaaattaaaaatacacaaaaatagaatgctctcgtcccataggttccgtttttgcaaacagaattctaatctgatactccaaaaaaaattttaccaagttgtatgggagatcacggtatagatgaacccagagaggagatactcggactcggcctggttgcggacccgcggtggtggtgggtgaggaaaggaaggatgcggccggatttgttggggaaaaatgggaaacttatttttagccgaaccaacctactatttctttcccaatcaaacgcatacttccaaaaactgattcgtcctctcgctcaggtcacaagcgcggccgaatcaactcgcttcacatacaaaccacaaactcgagcaaaaccttgatgcgactccaaaactaaccgacaaaaacttctaaaaactacaaaaatagaaccgtggcagcgaactgattccgacaaggggggaggggggcgacgactgtggtacaaaacgtgaccagaactcgaaactttaaacgaactagacgctaagaccagcaacatgacatgacgatgcaacacaaaattcaacaaagcaaaaactgaaaagaacagtgcaatggcacaatatggctaggtaaatgacacaattttttttttgtctggctattttctggttatggatagataaaaaaaactcaacgagctttcggttatggatagataaaaaaaactcaacgagcaagaaagctctgataccacctgatgagatgaaccctgaggtcctcttagcactcaaggctacagtttggcccgatctttcggtgagttcagataactacgatttgggagaaacgttgacgatctgactacaaccgtaaaagatgttgcgttgcgccttagcgatcgatacacctctccgtgggttgttgatcttgccagtgcagatcaaccctattcctgcaagcaaatcgaagaaacaagcaagaacaagataaaagcaatctgatattgccaagaggaattgaatacaaatgataagttggggtttcggggtttcgaatacaagcagacggacggtctagccgacacgcgcgctgcaaggaagtagcaatggctaaactttcatctaaacaaaacccaactaaccctgaaggggttactagctatttaagggatggaggaggtcagaagggcgtcctccctctgtttggggcgcagcccccccttgggccccacttgggccgaggtcccagacgaagttacaggtccataggcccattacagacaatgcagccccttgtttctgcaattgccgatgactcagatggaatttgacaatgaggttgatccgatggaaagaggattctgagagctttacatcaagtactcgtgtgaagcatctaggcccacgttgttaattttggtaattaatgacaagcgctaattgtggactaaccattgctattgagatgatattttaagttaggtccacgtcatgtgtgcgcatggatgactatcgatcgattaaaattgacggcgcaaaggaaagagaaagaagacggtaaaactagtgctttaatttagaattgatcgaggtgtagggcgatcaaatttgctagtttattttctagtttcgctgtactattaagaggggtaatgacctagcaaagagatgattaaattgccacattaggtcattgcattttcacttgtgctcacattttcatcacacacacaaatactcacctttgctttcactgagctcggcctgaccaggggcggtcaaaccggccacatagtggcggtctgaccggtgtgccctggccagtctgaccggcctcacaacggtggtctgatcggcccataaggacggtctgaccggcggcacatgcccggtcagaccggcccgctggaggtcgggatggtgctactcggggtggccgatacagagccgacggagccttattcggtcagaccgagtcgatggcggtctgaccgagccgaggccggtctgaccgcctgctcaacgccagtctgaccggccaggccgatggggccctctaacagcactacaatggctagttttctagccgtcgcagagtagcacggtctgaccagccacatacctccggttagaccggcagagcacaaagttgggggatttcacccccaacggctagttttggttggtgggagtataaatactccccctcaagcagcaaggggactctcttggcacccaattcaattgcatacaccccttgcacctctctcacacccacttgagctttgtgttcatccatctagtgtgttagagggttaattagccaagagtcaagtgcattgcttccatttgtagagctagtatggcacttgattgatcatctccacgccgggtcattgcttgttactcttggaggttgccgcctcctagacggcttgtggaggagttgcccggtgacctctccgagaagattgtggaggaggcccggcgccggtttatgagtggtttggagttcaccaccttcggagtgaaggaagaactaccttagtgatcgaggcttgggtagtcctctccgtgggccggctcccgccttgcccaccccttgacgaagggggcgtgcggtggcttcgtggttgagcggtggagttgggctcgcctcaacggggagtaggaaaccgacgagtttctgaacctcggtgaaaaatctcttgtctccttgtctcatttgattgtcgcatttacatttgtgcaatttacatttctagagacaaacttgagatcatatcaccctaggattgctaaacattgacataggagtgtgatttactttcctagagatataattgagccactatcaccctaggtttgcaaaacataacctagttgcttagttagagttgaccctcaccaagcctagcaacttaggttagttttgattatgtgtcatttagttttaaatcgcctattcaaccccctctagtcgacatctcgatcctacaagtggtatcagagcttggtctctcttgattgggttttaccgcctagagagaagatgtcgaacgaggtgaaccatgtagggaaggctcccatgttcaatggcacaaactactccacttggaaaattaaaatgtctactcacctcaaagctatgagcttccatatttgaagtattgtggatgtaggctttgctatcaccggcacgcccttgactgagattgatcaccgcaacctccaactcaatgcccaagccatgaatgctttgttcaactctttgagccaaaaggagttcgatagagtgagcaaccttgagaaccgcatatgagatttggaacaagttggcggagatccatgaggtcacaagcgagtacaaggatgccaagcttcatttcctcaagatccaatatgagacattccccatgttgcctcataagagtgtgaatgacatgtatgggaggctcaatgtcattgtgaatgatctcaaggggcttggggcaaactacatgtcacaccctaaaaatcgttaatatataaattgttgtttaattggaattattagaaataattttaaaagccttgaaaagaagatctaattttaaataataaatcccaatataaaatggggccagataaaatttcattaaatactttgcttgattctatagttcctagagttttctgggatttatttgagccaaggaggtatttttaataaatggaattgcatttcatgaattatttaaattggaaaaggttttaaaagtctcttttggctttgggccgaaagtcggaccaaaaccctctctctctcctccttggcccaagtcggcccaagtcaagccgagccgcccgcgcgcgcgctcgctgccgctaacaggtggggcccacctgtcaggcctgtcgtctacctccggccggccgccgcccgaaccctagccgagctgcgccgccgtctccttccaaatccagccgcccctttccgtttctggtgaaattaatagaggggacatgatccctgggatcccctctatcttttctcttatggaatcgtcggctaatttcgtttggaaattcgtggattcgagttcgattcggatcgatctctctcctccgaaccctaatctttccttctcgtcgccggtcgccgtgggcctttgccgccaccttccaacccctataaaaggacccccaagcccgccgctacccgtcgccacccctgccttcgtctctcgtcgtccgtagcgccctagccccgtgagacctcacgccgccgtcgtcgccaccgctccagccgtgcgtcgccgtcgctccagtcgtcgctgtcgctcgggaaggccgccgtcgtggtcgccgtcgcgtcgccgtcctcgtccgcccctccatcgttgctgtagaccgccagagcaccgccgtcgtcgtcaagccgaaggtcgccgccgcttcttcctcgacgccgtcgccttccgttgatcttccgccgccgttttggtcaccggtgagttcgccgcgtcgctctctatgcgctggtgccctccgttcgtgccatcgcgccgtcgttcgccggcgagcttgcgcgcccgagccgccgccggtgatgacgtcatcgccgacgtcatcgttgccatccgtcgtagaccagtcgtagaccgttagatcttagccgtccgttgtggttaggatcgatctcggccgtccgttcccgtgaaccgtcgccgtgcacccggtccaccgcaaaccctagtcgctgacgcaataattcccttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacattactattcatgcttgtttatgtgctgttttggtgtttttgctcttttctgtttagattccgacgtttccggagagttcattttcgcaggagaagaatttgaagagttccaaggccagcaaggcaagtcacacagatcccaaacaaccctttgagcatgttgatcccgtttaaagctatcatttttattcaactattgcatttattttcgaatgtcattgggtggaattaacctatggtttgttatagcccttttgttcttgattattttattccttgataccttgggttattataacttgactagttgggctttatatattggttcagctagatattagatacgattgcttagccatgcttagaaacatgagcacactattgggataacttataattcactattatttaatgatggcttgatgatagctcacgatggtcaatcgtgattggttaattaattaaattgccaactaaaacttgctaatggtgggttgtgagcacatggttttgatggtcgtgctcatgacaattaaggaccggttcacgaatttcggttgtgaaacattaaccgtgccaaccacaagccagcgtgggcaacggctttaccttttgtatagcatggttcattgcggggcaccagactgagaagtggcggagataagctcacgggggtcgctggggagtccatgccttgtttataagggggtgattatgatccaggaacggtgcgctgtggtggattgtgttgtgtgaggggtactatcacagctcctttctgaggtaccgtggtggtattgaggcgcatggtgacatgtcgtggggctgtgtcttatgggtacagtggtacatctctggccagagtaaaactattcgaatagccgtgcccgcggttatgggcgggtctaacaatgtctttcgtgattagtttcacatttcccatcataaaaaaagatgctataactggtaataatttgattagctcctggtttggaatggtacattcctggtttggagatagaactgtgcagccgggatggttgttcagaatggttgggcctatgcaacagggtatgttgtatagcgttggattaatattgtttaattattacttaactgctttattaaattctgaaatgtttaataaatgttgtttaagcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggatgattaggcgtagccctggtcaagctgcctgtggagaggagtcgcctgcgctgtttcttatttttccgctgcttagatctttattgattgagaggaactatctacctctgtaatgacattttattcgcttattaattagagtaataattgtactctattatcaatatgttattgtgtgcctcggctgattcctggacgagggttcacacacatgtaagcgtttggaattttggatagaaattccgggcgtgacactacaccgatcttgaggttgcccaaaagatgcttagggctctaccggagaagtatgagacccttgtcaccatgctcatcaactccgacatgtcaaggatgacacccgcaagcctcttggggaaaatcaacaccaatgacatgtacaagttgaagaagaaggagatggaggaagcctcaccttccaagccgaagttgaagataagggcaagggcaaagtgaatgaagtcaatgaggacttggaggaagagattgctcttcttgctagaaggttcaataatctcttgggaaggagaaaggagagaggaaggggctccaactcaaataggagaagaaacagaagacccaacaagatagaggagaactagtgatgcttgcaatacatatatctattagaataataatattccactagtattaggtatactaatcttttgcagagaatgacaataaagtggaggagaatcaacatcaactccgacgataaatcaatcggatggtgtcgagaactagacttatgtatgaatgggccaagaactcagaaataacacgacacattgggccaaaattcacaagtctacgaagaaggacaacaaaggaggccgccagccgaagatgggctgggttgggccagcccatggttcggccgaaccatagggttcagccgaaccacccgtggcgccgatggatgcagggtttggacggacagctgggattgatccccaatggcggttggagggtattaccgaccattccaatcgtcccaaccgtcattacctacctataaaaagagcttctcttctcacttcactcacacacctcaagcaattgctctctcatttctctccagtttagtttagtagtatctagctggtggaatagaaatagagtaggaatcaggagtccggaagccttcggaagagttcgggtatggctctagcagctttcctttcttcttttgtaaattttgtacttttattagcatactcttctaaatacatttatggtattgaaatactttccgagtatgtgagtacctattttacattatgttcatgttatactgaatatacggctagcatatctaggagatgctttggtgcgggtataatgtttgcttatgcaattactctatgtcatgacgatgatattagagtaatatctggtagtttagacgtagtgtctagattacgggatatcattatttggggttatatgttgcggatgagaggtgggccgctgatggtgacagctcagtacgggtattcctccgcaccggtatataatcctaagttaatttcctggggagggtattcctccgtatttagccccggttgtatggtcatgacagactatcgtaaggaactcggcagtcaggggtggcttctcgaaatactaggagggcatcggatagagggtattagctagtatatcagttaactagaatgtatgtatactatgtatattagaagtataggaatatattttctttctcttttctttccacttagctcagataatatattatgagaatgagtagtaatgcttgtgtgtcactctacccttggattatcttaacccctgcttagaatatgattatcataagtaatatataaattattagtcaatctatctctacatgatcttcccacgggataaaataaatacgatacccttagaatactctcgggtgaaatgctacaatggtatatctgtgcgcttgcggatgatctctgtaaccataatataccagaagtatttctgcgccattgctgggaattatatttctagtaatgtcgttaagaaataccagcaagcatttttggcaccgttgccggggaagattcataatagagattgcttgaactaatactttatatttacctctgtataatcatttcctttgcaggctaaccttggttgttttcactttttgttgtgaaaacagggtagtgcatgactggtttcaacctgccggaaaacttcaaagaatatccagaagctttcttccggggcgtcagaccgcgagccgttgctccgcagaaaactctaccaacagagaaaccagccataccagcgccaccgatcttcaatactatggccagcaagactcttcgcgagttcgctgctccctctactgacaatgtggccattgggccgcaaatcaacataggagacatggatttcgacttgaagtccagccttatcacaatggcgcaggctagcccgttctgtggcaagcctaatgtggatgccaatgctcatctgcaacagttcctggagatctgtagcacgtacaccatcaagggcgtcagtcccgacgccatcaggctgcggctgtttccgttctcccttctcgggagagcgaagcagtggttttatgccaaccgtgctgctgttaacacctgggacaaatgctcaccgggattcctctcgaaattcttcccgatgggtaaaaccaatgcccttcgtggaaggatttccaatttccagcagacaagggacgagtctattcccgaagcattagaacgactgcaggagtatgtggccgcttgtcctcatcatgggatggacgactggctgattgtcacgtcctgataaattcatcccgaaataaaattcattctctaaatggaataatagaattaattaaaattcgaaaagaaattggttaacactaaaatacgtacaagaaaaattcgaatgtggcccggagaatttttgttaaattctccttggtctaaaatgagccctcaaattttacttgaattttcagagcaccggaaatatttattaagcaacaaaaacaattatcaaagtttattaaaaagaaaaacctaaaaataatcctccttcctcatttgggccaagtctggcccaaagtcctctctctctctctctctcggcccgcagccaaagtcctctcttcctccctctctttctctccctctccttctctccctccttctcttgggcctccccttccccctcggcctaggtcccttttcctcccctcccgcctaggccgcgtcccggcccaagccgccccacccagccgccccagcctcccgaggcgcccccctgacgcgcgccacatgcgcgccgcatgcgcccgcgtggggcccacgcgccggtcatcttcctcctcccggacggcctcctctctctcccgtgcaaccctagttcgttcctccccaaaatccacgccattcaaaccgggaattccaaaattgattagggggaattaattcccattccttcctcttcaattccccctaatttcccccttgattcgtgcccccaatcgtcgggaacgcccgcgccaaccccggccaccttccatggccgccgggcgcctattccgccgccggtccccgcctctcccgtggccagctccctctcctcccctataaaatggaaccccctccgtgcgttctctcgttttagccccttcccgagattctccgtggctgcaccacctctccccacctcctccttctctttcctcggcgccggccaccctccagccgcctgtgccgcctcgcccgtgcggtggctgacgtcgccaccaccttcctcggcctcgcaggtgtcctctctccaccggcgtcgcctccgtttcgcgcggagaccaccggaggcgtgttcccaccggtgtccagtggcatcgccaccactgcaccgcctccagtcggccgttcaccgtgcctaaagcgttggccgacgctgctgccccctccctcggcacggtgacatcgccatcaacctcggccactccccggtttcgccgaaatttccccggtcggcccttcctccacccatgcgccgtcggccgcgccaccaccgcctccggcatcgcagcggcaaggtcgccctcggcctcgcctcccctccacccgaaccccgtcggtgttcgtcgtcgtcgtctccgtccgacgtcgccatcccctcctccggtcggccgttcctcctcgccggctcatcatctcgcggtgccgcctccgtcgtcggattcgcagcggcgtgtaccgcgccgtcctcgcctccgtgcagctgctgccggctgcctcgtcgcctcatcgccggccccggtcgtcgtcgtcgtcgtcctctcgtcgttcccggtcgtcgtggcgtccgtccctccgtcaagccgcgttcgttcgtcgtccgcgttccgtcaagtgagctgcggcagccccgtcgtcgtcttcgtcctcagctccgcgtcgtcaagcgttgcgccggccgcgtctcgccttcgtccaaggatcgtcgccgaagtcgttccctcgccgttcgtctccgtcgtccccgagccgtctccgctgcacccgtttgccgttgtcgttcccacgcctcgtcgtgtggtggtaaggatccgtcctctcgctgcccccgtcctcgtcctttcggtgtcgcccgtgcccgttgtgcggttgtcgaccccggtacctgtgtactggtgtcagtagtcgttcgcttgtgcgtgtggtgaccgtgttagtgtgcccgcttggtagccgcgtggtttccacgtgtgcagcccgcgtggtgtctagtggagtccgtttgtcggccactcgcctcggttgacacacggggtccgcttccgtcgacccgtggaccgtctctgtgtactcggtctaccgcggtcctttaggttgacatgtggggtccgcatgtaaacggcgcagccttcctgtcttttctaggctagcgcttacacatgttttatagttgcaaaacctaattataataatccgcaaatctccatgtaacagcattaaacttcggatgatcatatcttggtcatacgaaccccgaatcaacccgttcaagtctcctaatgtttgttataacataaagaaccgtgtgctttctttttaagtattgttattgcttatttataggcttgtagctttgcttgtgtgcttcgcgtagcttctgtcgttccgaaggttctcgaagcgtggttcgcggtcgtcgccgaaggttcggaaggccgttctctctgagcaaggcaagtcgcatcacccttgagcatattgaatcccagtttataaaattattttgatttaaattattgcattaccgctttatttaaattcctgcgttatcactgttttatttagcacttcctattaatcctttgttatgaccttattattattgctattgtttattatcaccttgttcaccctaggaaaacaaaaccccaacaagtgggtactctattcatggttccactagtatgaatttaggtagatgcttcgctgattaattaggcaacattaggtggttttataactttagactttgggaattctcaaatcacttggatactatgaaatggttggcttatggtggaattggacatacccctctcttcctctttcaaaacccctaaaacatgttttctggtggggtattgtatgcatgccagttatgggaagtagcaccccggccaatataaggattaagctcgggcctctgttgcaaagcactaccgtactaaccacatgtctaatgggtaaggcttaactcggtgctcagtctagtcctgaacaataattgacaaaagttcgccg

SEQ ID NO: 32122 - DNA, 679 bp, Oryza sativa
aacgaaggaatgaggttactgttgacggtccttaaatcataatatctgaccgtcaatacttgcatacaatgaaataaaatgtggtatccaacttagtggtagggattattactaatcaattccactagtgttggtgaaatatgtgtatgcaagtattttaaggagaaaacacacccggcatacaaggaaacacacctccggccaatcagacgcaagtacacggattggagggcccacaagtcaggtgatactgccacggaatgggtcataactgtcataaccgccatcagggccaaccagtcagtgtccctgccaaaggagaggctaggaggtggggcccagggttcggtcgaaccaccataggcgcccctcatccttgccttccacgtgtacgttcctgatgacttcacaatgatggttggagggcaaattggacatttcacatagctgtaaccatcatatggaggctataaaaggaggagctcatctcacttcaccaacacacaactttgagctgaattacaagaggctctattgtatcttttgtacattagaaataggtagagagtgaggagaagctctagaggagtgcccaaaagtttggcgctctctctgacttctgccttgatgagtgtagctttctaggaggaattctggaggagtatcggagctatcggta

SEQ ID NO: 32123 - DNA, 249 bp, Oryza sativa
ccgaggagaatattactgtccaaagaaactttttttcttcttcttgtcggattagcatgcaagaaaacgtgcatattatagtttggttgtgctgaatactgtccataagcacacgatatgattaacaagtcaagaacatatcatttgacctagatatatatatatatatatatatatatatatatatatatatatatatatatatatatatatatatatatatatatatatatatatatatatatatat

SEQ ID NO: 32124 - DNA, 1215 bp, Oryza sativa
tgttgttgggcgtctacgtcttcaccgaccggccgcctcgtcagtcaccgactggtgtctccgcctgcacggctggcctattatgccgctgttgttgggcgtctacgacttcaccgccggcttgccttcaccactgccgaccggtgcttccgcctgcacggccggcctattatgccaccgttgttgggtgtctacatcttcaccaccggcttgccttcgtctccgccgactggtgtcaccgcctgcacggctggcctattatgccgctgttgttgggcgtctacgtcttcaccgaccggccgcctcgtccgtcgccgactggtgtctccgcctgcacggctggcctattattccgttgttgttgggcgtctacgacttcaccgccggcttgccttcgccaccgccgactggtgcttccgcctgcacggccggcctattatgccaccgttgttgggcgtctacatcttcaccgttagcttgtcttcgccaccgtcgactggtgcttccgcctgcacggctggcctactatgccgccgttgttgggcgtctacgtcttcaccgagcggccgcctcgtccgccgccgactggtgtctccgcctgcacagctggcctattatgccgctgttgttgggtgtctacgacttcaccgccgacttgccttcgtccgccgactggtgtcaccgcctgcacggctggcctattatgccgctgttgttgggcgtctatgacttcaccgccggcttgccttcgccaccgctgactggtgcttccgcctgcacggccagcctattatgccgccattgttgggcgtctacgacttcaccgccggcttgccttcgtccgccgccgactggtgtctccgcctgcacggctggcctattatgccgccgtcgttagacatctacatcttcaccgaccgaccacctcgtatgacgccaactggtgctatcgtcttcacggctggccacgtcgccgccaccgctaataggcgtcgttatcttcaacacaagttgtctgcgtctgctgccgactggtttcttcacttccatggctgcatgattatgatactattgattggccttatagtcttcaccgccagtcgtcttgtctactgattgactggtgtcctcgcctctacggctggtttataccgctaccactactgatggacgtcatcgtcttcattgctggctgccttgtctgacgccgactgg

SEQ ID NO: 32125 - DNA, 15305 bp, Oryza sativa
  unsure (1)..(15305): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaaatgaacgaggcaaaccgaaaacaaataatctgaagatgcccctagctttgttctcaaacaaaagttgggattaagctagagaacaatgtaaaaatatctgaatgtaattatttgggtcgatggtactgtcaagtgtcaactgtcaagtactccagtataccaacttgtgagttggttaccatctggtgtactactagtaaaaccggaagatgcttttgcagaattcaaattcaaattctccgtatttttgacttgaaacttgcagcgttgacttaccgatctactaaataaataaatggatcagatcgagaaaacagagagaattaggcccagcagaaagcccaagaagcccaagagcgaaatcagcagcgcaatacgcgtagtctagtctcctctctttctttcttcttctcctccgccgacgccgtcgttttctccgcagttcgccgctgcttccactccgcctccacctccgccgccgccgctgctcctcctcctcgcgcttacagtttcctctacttccccctccttggtcttggtctgcctcctcctcgccatggacgtcaagccggtaagcgtccgtcgatccccctcccgcacttaccctttccttaaggcttaaggtttagcttctgcggtctgcggagaaggcgacgtgttgcggcgaatccggtgctgcggcgattcagatcggaatcgcggtttttttgtttttctttttgccggcgaatccggtgcccaatcggtcaaccgtctagtcatacatagcttaatcggtggtgggcaaatgattttagatttaacaagaagaggggagtgtttacgcagatctagtcatggaagatcgtctggagttaggggagagattatgggtgtagcgtagagatcatcaacacttcctactcctccctcctttcctttccttttaataagcgacctaattgatcccgtctgcatagtgactctgaattagggcaaaattaggcaggcggtttgtttgtggctctgtgcttgggattattagtctataaataagctttattacttccataaacaggctctagccgttctgcgcaagtttttcagtgctgtaagccccattttgtcattttggtcgatggtgctagtttgtaactgcacataatattatattgaccttttctggtacgctcagaaaatacatctttacatagtttaggcttcttcatgcgagtgaagtattattatttacttcattcatcattttaggctgtgaattatttatacagatgaaaatctcaagcttagacttggttagaagttggtcaagggtagccccacttgcatgctctctctataaactttcaaaagaaaaaaaacctttcttatatgtgtacagatgctgatctcagtaattgtgtgctgttgcctttgattttttttttcatataccctgttttctatatccctacatacttgattcgaaaattatagtgataatgttttattcgttacaggtgaggactgtgaaggtcaccaatgtctccctgagtgcaactgtgcaagacattaaggagttcttttcattttcaggagacattgaacatgtggagatgcaaaggttcattttttttaaaaaaaattgcaacatgtacccaaccaaggagatttgatttgccctttactagcattctcatcattttgtttgccttccattggcagtggcgatgagtggtctcaagttgcatatgtgactttcaaagatccccaaggagcagaaactgcacttcttctttcagtaagtaattgaaggacttcgtagcattgagtacacttgttgcatattctgtactccattttcgctgttccttattccttaaccttcattgaactcttgtttccttcatcgctacatgtgtatgtgtgtgaagctttgatgtctgatgtttctgattgccttgtcttgtcttaccttatcatgcttttttttaaataaaaaaaatagacttattatctcaatgaaagcaccttgttacctacaagtttggcatgcttgatgtttcctcaatacctgaagtttagcttttgttgctacttatcagttgtgaattaatacccgttttacccatttttttttgctgatgataggctcgtggtcaatcactatggaacttctagtgcatgcattgccaaaaaaaaggaagcagaagcaaaaacaatatctttagttgcatttccatttcctatagtaggatttgatgtccctgtaacaattgtttgttctgctagagcaaaagctgagatgtcgttctatttcattgaaacagggcgcaacgatagttgatctttctgtcatcatcgcacctgctccagaatatcaaccaccccctacttcatctgctcctccaatggtacacaattcctcagttttgatttaatatgctcatattttgatttttcaatatgtgacccaagtgagatgttatcatcaactgaatatggcagttttgtctgcacaataattctcacccatgttcttgattgcactggattttctgctttcttagcttaaatgaaaccttgtctcatgtgcttttacatattccattttcataaccataagtgcaatctataatttcaaattataggtgcaaatataatttagagtagctcccggtgctaacatgggcatatttgcaacattctgttgatcttatggaatatgaatagcttgaattgaatattgtgttctgttctcagtatagtgcaaccagtgtccctgtcagtgaagacaacaatgttgtccataaggctgaggatgttgtcagcaccatgcttgctaaggggttcaccctggggaaagatgccgttggcaaggcaaaagcttttgatgagaagcatgggttcacatccactgctggcgccaaggtggcctccattgacaggaagattggtcttagcgagaagttcactattggtacttccatagtgaacgagaaggtcaaggagatggatcagaagttccaggtgtcggacaagaccaagtctgcattcgctgctgctgaacagaaggtgagcactgctggatctgctatcatgaagaataggtatgtcttcaccggggcttcgtgggtcaccaacgcattcaacaaagttgccaaggctgccactgatgttggtacaatgacaaaggagaagatggcagctgaagaccagcataagggctcgggtccttctggagggcactcgtacacacccatccagtgatgactccacgctctctcatgtgccgcattgtgttgtattgatggatgtaaaacatagatatagaacagaaaaagtcccctcctggcataccacatacttctatcagtgaacttttcgcattgcaggaattttgtttccagtagaataggaaatatgatggtgatcacaatgtattccgctggtttataaggcgtatgttcaaactgtttctggttgtagtaacttgcatgaaccttggcaaaagttgtggaaagctcctttaataatgtcatgttgatgttggttcatggttttgtatgtgattaccgtgtccattgaaaacatattatggcttgctcagtcataatctgcagttgtttgaccgtacaagaaatgtcccaattttatggggtgcaatcgattgtcagcaacaaagtcgttgtagtatagtggtgagtattcccgcctgtcacgcgggtgacccgggttcgatccccggcaacggcgatttcactatttttttgccagtttcactttttttttgtattcttgttgatattctaaagcttttgtttgtattgttttgttacttcttccgtttgttacttcttcctttcattctactcttgtcggtgctttttcagatactacttttttaatcttttggtattcttgttcatactcttcactctaaagcttttgtttatgttttctaatacttcttcctttcattctgctcctaatgaattagctctatgtttttttatacttcttcctttcattccattcctgttcattctaaatcctttatgtattctgattctacttcctttcattctacccttaaaaaaacgctccatgtttcttgatacttcttccttcacattgcttctttcttattatgggtcatcttagcagattcatgagatcttaaatatccatagagcatccaaaaaggtgggcattcacttgttataaaataatatcaagctacaagtgacatgtacagtatgttatatattgatgtatatattgctatattattggtgtggtgacaggaagagtaacttgccactccatctggtccaccactctaatgcatgtgtcaagtgtcaacttaatctcaagctcaagctgaataaactgagaggctgaagctgaagcctcccttgccaagctacacaaaatgccatcatgtctcaagctacaattagcctggcttgtcccttccaaattagcatcatgcatgtccttgatgcggacaagcctcttgtttcttgcgctggcttcttcctcaatcaactacctttatctactactagctccatgtatgtactatagtccactgtactcttctgcttctactaactgcacacacaagattaaattaatccaacaatcaagtgcagaactgaccctaattaatccttctgtgcttgcttaagctcagcactggctggagtactttttatttttgtgccccaataggagtcaagcactgttgctagtcatccatgatgtgtgtatgctgccccttttttctttggctttctgatgcttctcaactatgcctttgaccaaggaaggattcatctacctaaaaaaaaatgaagctgccgcttgctaaattggttacatctccatgaatgtagccatctgggacagtgtaatgatatcaagggatcaagaatctcaagccacatttttcattggctgcatttcagttgataattttaacttcttgttaaactcctattaatccctcttgtgacttgtggataacggttttctttttctcctcctctgtgtcgtgtacaggtgcttgtgctgaggcacttgcgtaaatataattaattaaaatgacaaaatgcttgctatagtattattctctaggtatatatattccagaaactcccatttgtgtggatgtcaagataaaagaacaggtgaagtgagatcctcctttttaattttaagtgaaaaacaagaacactatttcctttggtgagattcaggcagcactgcatttatatggtactatttagagaattaaaatggatatgcaatctcatggtgtacatgttcttgttgcaattgatacttttggcatgttgattttgtacggattaaacaggtgcctcactaaagcacttcatccagtaccatttctttatgtccagaaagcaactataaactactggattccatccctaagcatcaatcctgtggtcacaagtacatgaactaggatctgacaaggacaatcacaggacaaaagaaatagtactaactacaaatgattcagttcatcagttggttataatccaaattatagatgcaacttgcatactagtaccgtattattttagcatctcggaatctgtgccgagagcatttcagtttcacattgctattggctggttttggatatatggtacagtagcttgtgcttgttttgaggttcagacactgacacacagattcagggttgaagcattctctgaaacaattaagaattgaagatttggagtccttccagttttatctgtaaccaactcttgatacctatagtacaggcatgctctgaaacgaaatggttcatcaattgtgcctaaaaaaagaagaaagaaacatcggttcatcaagaatggtctgtcaatctcagcagcactgttttgtttgatctacacgcacaagcatcaagttgacttttggcaggcattggaagtgagttgtacactgaaattgcgctagttaacccatccattcggagaaaatttcaggccggcttgatttgcctgaccacaaaggcaaatgttgtgtcagttgccacagacagatcacctgcttcttaattatttctagaaccgttgtgagatgatggcaaattagcaatgaacaatccaattccaaacctcgtatggaaaattaatattcttttgcaaattgatctgaatgaatatatagaccaggcccctggtttcagtaaggtaaagtcaactcgtgcatgcatgtatgcagcacggcccggctgccccggcatcccctaacaactcagtttaattagttttaagcacaaaattgtgaacaatagttaagttctttttgcacattttcaggtaaagcagttgtcggtttattacacaataccatgacaccatggagaccacacatgcactgcaagttgaaaaatctgaagatagaatgaacaaaatatgttcaaagccacaactgttcttgttttctatggcgagaaaactaaaaactgttcgatcttataatttataagtacaacatgccatgatcttttttatttatgtcgatgcatcaaagatttaccatatccaattatatatactgagatattaattattaccggcaacctgagacaattgcatgaatatttttactggcatatgacatctgatcgatcagcaagttttttttttcctttttcacgatatgtaactgatgatgtcacaggaagaagagatcaaggaccggagcagcgaactcagtctcgaaacggtcttagttgactcatacaaatttatcaaatatcatattcatttctagtttaatttctacacgtctgcattgcaacagtgtaccgttgaatcaacgctaacacccagcattttttaattaattaatgctagctacgtaccaagatcgatcgatcaatgcattaaggcatcaagtagaataagaagtgcgtactatttgggattaattaacatgtaatatgcgtggagatacacgtgaaggggtagataactaaaatcaacttagaagcttaaacacacaaaggctcaccaaattataacaactaacagtgaccttcggagtggaattagatcacgtaaagatctggtcctatttctttatcagattctgtttactaactactcgtatatttatatagtgggatgcagtctctattgcttattgcatgtaaattaatcatggccctgttgagccagatcagccgtaattcaagtcatcataccaaggaaggacgtacatgcatgaccatcatcatattcattcattcatatatattctatgttaagggtgcacatatactaattaggttaagaccctgcatcctaatcctggctaaaagatccccatggctgtgcagctgtttgaggaatcctcttgagtttctgttcatttgacttaaaccgtttggatccctgttttgttttcatatataagtaaccacatcttgcaccaactagctatttgattagtctctgcaagatgaaacattgaagctagccttaatattattgtggccaacgagaataatggtaaccgtagaagcatttggtttttatagattttttggataatggatggaatccggagtatatatatacatatgtaaaggtttcacgaatacttatattccaggtcttataactaataaacaacaaaaaaaattaaaaaagaaaacaaaaaatactagaatactcagttttggttttctgctgcctgatgagccttgttgtaccaaaaacgtatcgaataaatattgaaatgtagtcaaaactcctataccctcatcctctttcacccacctctctctggtttgttcgcaaacctacccctactattggacagatccatttgatctagatccgaaaactcccagcacttacttccttcgcttgctgacatcatcgagtggaggcaaagaagtgaagaactagtgcatttgctctcagatgccatccagcggaggtagagaagaagaaaactctttggtgcattgagttcgggcacaaacacggaaacaccttggatccatggcacttagaccctagatctagggttgtctgttgctgtcattgctaaccagcctactaccacgctgctgatattgctcctcactatagccgccctgcatactgatcaccactggcaccactaacaagcccgtcgtctttttgtttttctcactgcatccgccttttgtcagggcactggatctgaccattaggccgaagctatccaccctggatgtcgctgataccgcctacaataccatctttgttctaggttgtcgttgccaagagaacgttacatatgcacacccttttgtttagaagcattttatatctccaatcttcatgttattctctccccctaaagctcatatgcgcctttttttttttcttatttcctttttcttttgttaatcatcatcttggggcatttcagtttctgctttgttagttttgagaacatataccagaagtatgtagactggttgcacccactctggtctctaccttaatattccaaataaataacacatcttagtctttttccctatactagaaaagatgtccgtgcgttgcaacagttgaatgctatgttaatcttattattgttatacggtttggctagggtgaaattcactgtaggaatccgcttggattttttttctaaagaattatgagctgcaattaggagtccgacattcatctcaagttagcatgcaagtttttttaaagagatatattatacgactccttttgtatttctaaaagcaaatgaacttaaaattcgactcaaacatggatctatattttcaaaagcaaacgaatttaaaaatcgactcaaacacggatgacgtacgaaaataccggcaaaaaaaatatacagtttagttaagatgaaattcactgtgagaatttgcttagatatatatttttttctagaaaatcatgagttgcaattaggagtccgatcatctcaagttagcatgtaagttttttttgaaagagatttcttatacgactcctgtatttccaaaagcgaatgaacttaaaaaccgactcaaacacggatgacgtaccaaagtataccggcaaaaatatctttaatttttataatagtatagatatagatatgtacttttggttatgattttggggaaaaaaaatcaggaattgaattcccaacgatatatagcttaggccataatatatatagtaagacacctcaacataggaattattaggacacctagaatatgatatacaaaattagcaagtagttctatcgcatttctgacattgttgcttccattggtacgcattaatgatgaactgaaaatgagtgtttcattaataaacatatggcagtacatgatgtccttattggatttcttaccagaatggattactcttcagttgagcgcgagactatcaaagatctctttcatttcaaaaggactatcaaatctctcgtacaaataatagagaaggattataaataaacaaataacaagagaaatctgacggaatgttttgcctgcagtagtattcatgtattgcctgcagtagagacaaccactggtactgtatcttgtacgtcctctgaccatactccaatttaatttgtatgtactgatcactgctactatctttgtatcataatataagggattttgctcatgttgcatttagttatatgcctataatctcttatattataggacattggtagtattaattaatttgtaagacatgttaaaaccgatcagaaaactaaagcaatcttttggttcaaattttttttcttccagtagtgctaatgtaactgtgaataatgctttgaatttggcagttaaaaatagaaatttgcgtccatgccggattggtgtagtactgtgcttcaaatataaaatcacactaaaataatacattctcgtctcaattatacgagcaatagcaagacaaccatttcttgtcttttttccctagtagctagatgtctatctagatttttgtttttagatgatgagatgtcaagctagatactactcatatatctgaattctactgtgacatgcttgccaattcatccatgcattagctagattacttgcacactctaccaaaattaaaacacaatttcttcctgccatgtctactcacattatttaaaaggaaatatgctctcaattatttgcgtgaaaagataataaaagtactacaaaatacaaatactaaaggtgctctgtacgtacaaaagcaaactgatgtactgcttacttctgaacattactctgtgagtgtgtgtctagccgcaagtttttagtgaagattgtattaattgtagcaagttaaaatcagaatttcattgttaattagctggtatttgcaccaaataataatatagtctggttaaaccagagatgcaattttaaaaagaaggtagttgaaggggaagactaaccaaataggctgcttaatgctgcaacactaagggagattagtacagatgaacatagtttaatttcacactctggacagtgatagtgattgtcctgacgacgatgctgatacgaaagatctattgacatatgtacatatactattcaagaataattcgcattatatatatggtagctagtctgcatgattagttattgatacagattgaaacctgcagactacggtacaacagggcctgaaacttgtactgcaataactagatttgtaaccagcagctgcagaaagggttgtctgattaatcacttcactaaactttatgggaaggataaattggcagatgggaatatatggctatggccgtgtctagttccacagtcaaatttttttaaaagtatacggacacacatttgaagtattaaacctaaactaataacaaaataaattacagattccgcctgtaaactgcgagacgaatttattaagtctaattaattcattattaacaaatatttactgtagcactacattgtcaaatcattggcgtaattaggctcaaaagattcgtctcgcaatttacatgcaaattgtgcaattggtttttttgtccacattttaatgctccatatatgtgtccaaacatttgacgtgatagaattttcggaagtttgggaactaaacacagcctatatatgtgcagtagaccaagtgaaaaatgcattctgttcagatgttctcttcctttgtagtttcaaactttcaaaaatgcattgactaccacttctgaaactattcatcctttaatttagggacctcaaagagaaagagagagtaataattacactcgtatagtgcataaacttacatggggtgagtgaaacaatttgcaaaatgtgtttccccccttttctattttggcagagtgcatgttttagtagaacaacttaattatttagtctgtgtaaattagggctaaaattggccacacaaattaatgaactgagactattttgattggaacactcatcattccaatttataattaagttgtctaatctgggcaatttacaatccattgtgtcttggccttatatatatatttccttcatgtgggtagaaggagtactggggacagcagaggcaagctcagtgtaaggtggtcttgcaagccaacctggcatcctagctagtcagtatagaaaatcaataatttgcctcggagacatattttggccttgtttttcactgactaattacaccggaataagaattttgcatgtttttaaacgtattttcacccactgtgcaagttcaattcatacaacgtatttgtcagtatttgtcaagaatgacattagcagttatggcagaatctctcagcttggaattgaagcttccgatgaggtgtttgtacgcacggctcaaacttcagtttgcaaatttaccacagcaactcgatctcttcatgtcaaagaaggtagttgtgcgtttggtaaatgattaactgatgaccgtgtgcattgcatctcaaattaaagtcgctttggtttcttcgatcagtaccaaataagaaataaaaaactgggggaataaagaaaacaagctagtatttgatatagacagaagaagactcagacagatcgagtattattgttcatgtgcagaaattaaaaccatcagaagagtacgtgtagccatgcatacacctacctgcaaacatgcatctaactgctggactccgtgcagagaacacgaatcaaatcactttcctgcaacctatgtgtcctgcaatctctaaaccaatacatgcttgcaatttacatagtaatcaatctgtactgttatcatgtgtccatgtcaaagggtctaacattaattccaattgcacaactaattttctggtatacagttaaacaaatagtgtgcaggtacactttggtcccccttaatactatacaaaaatgcccagctagctagctgtatacgtatacacatttaagctagctgcccttaatacctaatgattcataatgtatagccttttatttcttttgtccaaatagaacactaaacaattcaagaaatgataaagggacccacacatctcctatgaaggtttctgtgtgctgaaaccacgctgtttcatctcccagctagctaggtcttctgatgatatgaatatgaatcatttggacgtggaaaccgcagataattcagcacttgacctttgttttattcttaattacgcatgcaccctgtctaatcatctttgacaggattccagtgtaaattatctgataggtgaatatcagatagctaagcatatatatgcatgttccacaaagttcagagagtttgcacgcgtcatgggtgcaaatattgcctattggccataaaggatgcatggaatcaagggatatcccaacatatagtgcatatataattaagttttaagatcgacattctcatcccaggcaacttcaattcgtctttaatcttgcaaactaattaacacacaatatacaaatttgtgttctcgaaggtacttcccataaagatcaattatacatggaaacgacacatatgactcctcacaaaatggatcaacatctgagcaatatagtgtaagtttcaaaagtcaatttgccttgtgttgtggatatgccattgtattgctaactgtaatgctcatgatctcccacaacagagcgcaaatggtgctaagtcaaccattcatgtgtatgtactatatatgtatatatagttactagctagtatacatatattcttttttgggaaaattggaactatgccattataattttgcaaaattttagatatgccatcctgacccacatgtcattgactcatgtgggtcctacatgtcattgagataccgatggtatatctcaaactttgcaaaattataatggcatatttctaaattcttttttagataatggatgaaactaatacactcatatactattaagttcgtttattagcatatgcgattataagttttaaggtcgatcaattatttttttcattaagtataaattgatgaattaattagttttctttagttcatctacttgcattctaaagcatcatctttgtgagagcaaattaactgaggttgcactatatttaattatttcccatgcatattcaaattaaattatatattcgcgaaaacaaatatcacaataaaatcaatattccatacaaaatggatcaacatataattagcttgagctaaaaaaatcagaattcattttactatatgtttgtggtgaatgctcctatatataatatataatgccaataattaatattgggtagaatttgtcactcccatcccatgcatacgcatatatatagctacgcatgcgtgcatgcagttttcacattttggtccttttaaaaaacttatttcgcaaatagacccctaaaaaaactaatcccagaaatggtcctttttagggcgccagagtggctggcgctgtcatccaatgggacggcgccagcctctctggcgccgtcctcctgccaccgtggcgcacgcgaaccgacgtggcaggaggagggcgacagcatggctggccccgccgcctccattcctgtccattcctgtttctctgtatggagttgcaacggtgtcatttttttttattttttcggatgttttttcacactcaggatcacgatacaaccaaccacaaaaaaaatttaaactcgaactaccacttagctaagtctgaaaatatctagcataccacttagtctactttgcaccttcactaaaattagactataactcttttagtaaaaccctttgatcagcatgttaaacataatgcactctaccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggacaaaatatgtgacatgtagaattttccaaaactctaccgaaatggacaaaatatgtcatctattaaaataggcataactttctcatacggactcggaatcaggcaaataatatatgcacggacatctacagaaaaagttacatccgtttctccccgctctgccgggttcagcgatattaaaacctccaaattccgcttgcaagattgtgttttcaaggagagaagtttttcggtggagctttggaaaattccacatgccacatatttcgtccgtttgagtttattttttacgtggttggttcctgtgagttcctaagtgtgaaaaaaatatcaaaaaaataaaataaaaataaaaaagttgcacatctctctcctctgcactagttcggagagaggagaggagaggaaaaattctatatgtcacatattacgttcatttgagttcaatttttctatggttggttcttgtgtgtccctaagcgtgaaaaaaatatcaaacaaataaaacaaaaataaaaaatttcggggggggggggggggg

SEQ ID NO: 32126 - DNA, 26364 bp, Oryza sativa
ttttaaaggaccaaaatgtgaaaaatccagtagtaggtagctagtacacatataataatgcaattaagtttcgttaattatgtcatcattgctttacaaggaaagaccagtttagagcaatggcaagaacaaaagctatatatgcacatgaattccacatctgtagctagttgggtgggccccaacccctaacgaccatagctatagcttcttgttattgatgcaaatatatatatatatatatatatatatgtaccaaattaagtgagaggtttaccaactgcttaattgtattttgatcgtgtcatgcatgtgtgcgtgtgaaacaagggatctagctatcatatccattccatcaatcgagcaggtatagtagttccttccttcttcctggatactctagctagcttgcttaatttgctccttgattatttgttgttagatcatggcaattaacaggacacacgtgtcagaccacacgaacctaattctcctctgcctcctcaacacgtgccgtccacgcactggatctacacttcatcccatatttacatgtgtgtcatgtcaatattacctaattaaacacgcatgccctgcaggtataccggccgacatattaatgcttttgcttttgcgaaaacctacatattaatttgtacacgtaaataccaacgtatcattgtcaatagttactacgatactccctccgtcaaaaaaaatatatatttttacctatggacttcttaaagtatctgcaacgttaattctgaggaaaaatatatagtgtaaaccatatatataatgaaaaccaaaactaccgttaaataaaaaaatgaatatttgtgatttatctatgtcactaagaataaaaattctactcacagattcagtcatgagaaaaatttgctgggggtagaaattttgctttcgataacatggataaatatcacacgtccattttttaatctaataatagtttttatttttttttacgtacgtggtttatactatatatgtccctagttttagagaaggtcctaattaaggggagaaaaagggatagagcccaccctaaacactgcagctgttttttcaactgtcctcaacatagagaccggtaccagccatagtgcttgatccttaattaattaaggagagagagtattttgactatttgtcatccttcacaactttctttttttaacagcagtggatcacacccatatatatatcacctctgagagtttttatacactacaaagcttttcacaaggtgcatgctatcttcaccgtgggccccacttatgggaccttgttatgaaataaacattacacatgctcctcttagtattgggtttattaattattttcttctcgttttagtcattcaaccattagtacgcacttctctttatttttctcccctattcattttctctatgcattaatgatttagtaagaacaaatacacttacatatagatagatactccctaaataaattcacttttatgcgtgaatctcgacatatagcccatacttttatatgataatttagacatataggtgaacttacttttgggtggatgtagcaattaatagaattaatatagtatgcacaccacaggtggtatatagtatattaataaagtatcattaaaaaaagaaaagaaaagaatggtgtcctttagtttgttctctcttgctaattaagtttcctggctggataattaagttgtcaagcgtacgtgtcaacgcactatattgtgtacgtaacatgacgtccaaatcatgcatgaacttacttgatcagagaggtgtttttcttgtatttttccaagtaacacgtcgccctcgtagacgcacacacagtagaaaatattactatcacatcgatgtactagtatatatgtatgctaatgtgctggcctttttcacatctatctttgtacagtatctaccatgcatgtctttatacgtagaaatatatataccattatcaccatcatccttgcatgcatccacggtacgttaataaaatcgtacgtagggcaaagttatataaggagtatatacgtacagaagtacgtatatatatatatatatatatatatatatatatatatatatatatacactgatccttatatatactagtagtaatatatatcaattcgtatgctatagtattgtgagcttatattaatataattgtgcatgagaaaaataatgtaattggggggatcctaaataaaaccccacttgcattgggccatatatgtatatgttcaaaagtcccaaataatttaaggtacagaaagtacggaggaaagaaaaacaggacacaataagcacacgacacccagagcaaatgcatatcgatctaaccttagctacctacattgacaacatgcttaagcaagctggcccctgctctctgctgctttccgttggttcgttggttgcatgagctaatggctaatcacgatggacgtaagtctttggactaattgaagtcccaaagtgagaaatcaattagtgccaggcataagagtcagagctagagacagaaaggaaggatgtttgcttgcttgagcccacaattaatctcacttagcttagctagctagctgactcgatatgatcgatcatgcatgcatgctaatgctatggtctttgtgtacttgtctagtttatttatcacttaaattaattagccccgttaaataatattagggctctctcttcctcttctcctataaaaccacccccaccatagccgtccatctaacctatcatccaaattaaacatactcttgtggccatcgtctagcttagctagcttcttcctcctagctcagctaacgaacgaggagtagtagctaggaagagagatcgagatggggagatcaccgtgttgtgagcaggacgccgacgtgaagaaagggccatggacgccggaggaagacaagcttctggtggagtacatcggcaagaacggccatggcagctggcggcgcctcccgaagctcgccggactcaaccgctgcggcaagagctgccgcctccggtggaccaactacctccgccctgacatcaagcgcggcggcttctccgacgacgaggagcgcctcatcatccacctccacgccaccctcggcaacaagtaaccactagcctcttcttcttcttcgtctacctctagctagctagctcatacatatgctaattaagggagttgctttcgtgttcgtgcagatggtcgtccatcgcgacgaagctcaaggggaggacggacaacgagatcaagaactactggaacacgcacctccgcaagaagcttctcagccaggggatagaccccgtcacgcaccgcccgcgcaccgacctcctcgccggcctccccaacctcctggccgccgccaatctcggcggcgccgcccaccagctgcccttggacttgaacgccatcaagctccaggccgacgccgccaagttccagattctgcagggcctcctccgcgtgctcgcctccaccaccgccccgccgcccaccgccgctgtgctacctggcacagacctcatgacgtccatcctcggcgccaccctcgccgccaactccgccggcatactcggacagcagcagcagctcgccggcgttgacctcagccgcctcggccagtacaacggcaactacgacaacctgccgccgttgaccaacgacagctgcacgcagcagacgcagccggccatgtcgagcatgtcccccgacagcctactcaacagaatttccagcggtatttccggggacatgctgggctcgccggagctttgccacggcggggacgggcttagctcgccggagctcggccagggcggcccgagcgcaagcaacatgacgacctcaccgatggcgccgccgccgccaatggtagctgcagatgatcatcagtgcaatactaacacccccagcggcggcggcgacggcatgtcgtgtgagcagacgccggcgtcgagcacgttcgacgggctgaacctggacgacatcgacatggaaggttgttgggcgatgacggacatattgctagcagagtgagtagctactctcatcaactttctaattaattaaaaaagtaattttatatcgagttcaattgttatccaaaaatcttttttttaaaaaaaaaaatctttccaataattcctctctgatatatagttcaccagactggtcgaggtggaacaataatgtcaggacaatatataagattctaatacatgatctaatatatactatatatattagtttagaaattcagtactactgtatgtagctagcttaggtgcccctgatcttcttttaaaaccctgcatgcagtttattgccaaattaaacagattaatggttactacttatatatacttatctcacatgatactaatttgatgcaggcaatgcccatcatggttgatcagcagcaacaacgcaagtgagatgtatatttcaaaaaacaacacaagtgagatgtgaagaactagataattaaagggatactaaatggagataatatgaacccaaaaaaaaaagaagaagagaactattggatcggttgatgtcaagtttatttgtttgttcacatcagaaaaggtggtttggtccacttttagttatgtagaaagaacacaaagaacatgcatggaacactcgatcagtagtgtttttttgtttgtttagttttatcgtttcttttttacccctttacaaggaggaaaaaatatatgtaatgattagatagctgggacatgaaattaagacattaattttcccatttttatgtccaagtgtgacttctgttcagatatgtacttgttgacacaccatttactactaatatcgtgtgtgactaagctaaattttggtcgtcacggtattgaaataattgctcgatctcggaataattaagctaggtatgcgttgtcagaacaaaaataaacaatatataaattgcttctccaacagatatctaaaactgttattgttgatgtggtcgctagcttccttttggaccatttcaaaatcccaatccctagatacacttgaaacaaaatcaatcaaatgactatatgtactacaatatatatatatatatatattttacgatttcgtacggctataatatataatccatatatagtctcaagtttactctagttaatatagtatatacgaaaccagttttaagcagaacagtaattaagccggccgttcatccccgcaaaaaaaaaagtaattaagccgttcattttcacagcaggacttcgacagagaacaatcttcttttcttttcgggcacagtattatatatgtataccctctaattaaattgccaggggatttaatatatatcattgtctagaataaatgataaaaaaaaagaaactaaaaaaagcaacggacgtatacatcagcacgcatggcccctgcatgcatatgcagcttccctagctagctttagcccgtgtctttccgaaacgaggttaattactggttagacacatcatatcactaaccagggcggttattagatgcatcagataacatgcaaacggtatatgacttaaaaagatttagttagttggagatggagagggatgggtagcttgtgaaagtagaaaaggttaatcaccggccggcccctatgttctagaactctctccacaagaatgaacctacatatattaatcagttcttaatatattggtcagtatatatagcacagtcaaataatcaagggaagttttaacacttaagctagccccgtagttaataataatgaaagtcaaatctagcaaatcctaattaatgtgtatagcataaatgcacatatatatatatttccatgtatccgatatgtgtttgggctgtttcagcagatcttgtttgcttcattgcttgtgcatgtattgttagattcgttagaaatcggatgtggaaatatcattagctacttgagtgtacttgtagttaaaatggctcctagttgtgccttttgctttccataaaaaataaatatattatttttctctggtcctgaaacacaagtcagacaattagttagccagtaggtatacctcatttcccgacaccacaagccattgactatcccacctttgcgcttgcctatgcttcatctctctcatctgctggctgcagacctctcttctcgatcaaaagctttaattattattagcatcatcctttagcagccctaactatatgtatatatatgcctgtcaaatccattttatgcatggtcataggttattacaagcttatcatctgaatttgacagagttgttgagttggaaggttttgatcgagctcattattttccacctcctgacgcagctagtaatcaaacaactaatttgctcggtgaaattattttttatgcatacaatgtaaattttgcacgttgttacaaattaattgaaacatacggccaccatttataattctattgccttaattaaatgggctatatatacgttttattgtttttatacatttagttatatctggtgtacccggaaattttcgtatatatcgctttctgatcatgcaggttttgtcatgtccatgttggggcaaagcatagacagcctatggataattgttgaacaggaagaacctactcttctctttctctctcttcctttgcacacgtttataaaggcattaatatatagctcaggtttggcggcttcagaaagcattctacagtgactttcatgtagggactagtacagtttgctgtgcaacagaattgatgtgcaagagagaacaaattaatgtacagggatcgatcagaaaggcacatgtcttggtagtacagtagcagtattttctgcacgaactggtctaacaagcggagcattcaatagcaacatggttagaaatcgaatgcagatgttatgcatcgatcattgctgtacgtaaaacttttattaagatatcctaaactgtatgcatcaggtaaatataattaacgtgtacagatcgaaaaagtaaattaagttacagaggtagcttctaccacctgaaaataatcctctcaatcgttggcatgcgatctacgcaacccagtccacagtatggtgacatacacagatttacctaaccgatgaaaaaggaatataaaatatgcatgcgatggctgcagagcatggtcaacttcacatattgactaccaatgtgtcaaacctagactttcttatgcataaagtgtgaataatttaaaacttttagaaaatttcctgaaattgtgctgcttttgaaatgttgaagaagggagacttcgagttgctatttgttaggaaatagtgcattgtgacataggctaatcaaccatacaggatacgctttgaacaaccatcattagctgtctatcaaattaagtatatatgacttgctcggtgttctcaaaagtttccaaatggtatgggttgcatttgtcactgcagattctgaaactttttgtttcacacaaactgacaagaacataattattagtttaatggaataagtaaacaacttttctttggctctacatacctgaaagaaattagtgtagagtcggttttgaatcattgagctcccgttacctgagtgccaccgtccaccaatagtccaatataatcttagtcgtaagtattcagtctactgagtaagtttgcaacagtggcctcttattccactcctgcattaaaccaccgaggagaatattactgtccaaagaaactttttttcttcttcttgtcggattagcatgcaagaaaacgtgcatattatagtttggttgtgctgaatactgtccataagcacacgatatgattaacaagtcaagaacatatcatttgacctagatatatatatatatatatatatatatatatatacacatccgttaaaattccccagctacatgaagtagtttctattttgtcattttcacaatctgcaactgctcgcttggaatgatacataagcaaaatctaacaaggaaggcaaggcaaggcacagcctttccatgaaactaacctctcaatggcgacatcttcaccggttacctgaaaaatggattaatccacaaactattaagacatcataaagtttgactttaatgtagctagctatagctcctatttgtcatgcaattaattgtaatgcgcaggagtgctcaagaggataacaaagtggcagtataatcacaaagcaaaaaagccttgtcccacaagggatgacaagatattagtaggtaaaccatggacctagaatggaacaaccacgtacctaccttccgcaagaataatcctgtggtccaaccgatgcttgctctgcctcactctcaacctcgttgcatcatcaatgaaggcaagggagaaatgatacatttctgaaagtgctctgctttattgatccaatgatagatgaaagtacaagttatcatctataacacagttctataattgtaagcctagtagtacatcataattcataagtaccaaggttgaagaagtaccctttcttgaatcattgtgcatgttaatttgttgaaacttggttgttccctgtagtttcgtacacatgattagtcttggaaaaaacatgatcagagtcagttgctccgtaaaattcctttagaagtacacaaatcattaagcacaagtgttatctgttatttggtgcagataaacccttcatattctcatttcttcacaataataaggtcatatttcttctagagaagtagaaacgtacacataggtatgattacatttcctgcccttgcaaaagtatagaagttacatcatacattttctttttaccatccatttcagtagcagtaaaacaacaaccataatcacctaaagcttgagggagaaaggaaaaggtgttttagttcagcacgcggtaaaatggatcaggtaaattgtaacagataatgatcaaagatcatcatccagtgcatcatcttgatcaaaaggtattttaatccttcacgtggtaagagagtaaattcttaggactctcatgcagggcaaaacttttcttgtaagctcataaacaaaaggtgttacaattcagttgagtttttaccaaacagacagagatggctgcatacatggagacaagaggaaagagctaaaatatattcaagcacactgtcatggtttttaatcacacctagctgtgctactgctgttgatttcttgttgcttatcggcaagtgttgcttgcagagattcacaatctgtaaaagttaaagagggatttcattatcagagagggaatttacagagtttacccgagtgatgcaatgatgagtaggacaatatgatggtgctcatggcttatatgaagtgtgacaggcaggcacatcaacggtgctcatcagcttccgtttaggctgtttctgtcaaacagtggttcggttcaatggcttgttgggagcatacggagctccttcctgcatgcatgctaagataaattgggtgcaaaccaataaacatgtagccaacattgttcctgtaactactaagaattgtcgaaatgcaactagaaaaaagctagtgctctggcatctcctgatagcatagcaatcaccagtaggttcatgataattttcagatccccggataggcggatacgaactgcacctggcaggctagatcaccagtaggatattgatgtagttctagaatgggggtagaagcactgcatttctccataaagattattaagcaggattttctctgaatggttacaggaaagggatgaatgcagaacagagtcgaacttcactgcaggacaaacataagttgtgtctggattctaggaaaccgttattgggctattactagcatgcaggtgtttatgccattgcaatattgcatagctaggtggttaactacaagagaggtgatagtgacactaatggcccacaatcatcatcattgtcggcagttcggcacatggcatacattacccgtccagccagacagctaatctagtggcatgaccaggattcatctggcaaggggacaataagcaaaacagatgggccatgccatttgcacatatgtaggctgcatctgaggtagttttctatatggatttcaaagcagactacgttatttaaggacttctttagaacgcagttacaaaggaatagaaattttattagttagttcctacgaaaaaaaacaaaatctcatccattccattccaaaggaggcctaaactagtaccccaaagatcctagtggtaaaactagcacgtgtaacaatcaacaagtaggaaataaatggtaaatatgaagtggcagagagaatggatccgtaaggggcactaagcttttagatagtaacacatccctgtggatagtgctgatgcctgcctgatggtccataacgtaaggtatactcaacacaactgtgggcgctgtggcttacgaatccagaagtgccagtgaatcgggagcttatttagaaaatgacctagctaggtgatgtagagaaggaagaaatgacaaggaccatagccatctcctccacataaataaatagtacctgatagatcctccaagagccctttctttgtcaatgttgcaacggtgtggagttcttgaaaagcctttcttttccgctaggatgttgcaatgcaatcatggcgagttcactcttgcttgcccatcctagagcagtagatctatacagaagaacggaaggatcagcagaacaataacgacagcacaagcgacacatttcatgtagcgatgacccaggttcttcagagacatgtaatagtagcagccactatgaacttaatacaacttccctgtgaacgatctggagttctggacgactccgggactccaggtggcatatgcaagtaaatgcagtgaaacgactgtaacacaactgcgtttctactaggtaaactgatacggcgttatatgcgtctcagcaccaaagattcgggacacttgtttgctcaaatacagcaatcaggctatctgaattgtcgcatccaaattaccggaatgttcaaattacaggtcgttacggctacaaacaagagatgaatactcacatctaaactggcatggcactgttagtttggatacataatttgctcctaaaatggcaggcagttatgtacaaaggtgttgttcaaatcaagtaccactaatcaattccaagaatatacaacaaaaatatccaggcggttaggtggttaggcttttcatgcctcctgatttgccttgtttcctgccaagatgagggagatctccagaccacggctgaaagcttgattaaacaggaaacgtgactggaaggtggatacgaaggggaaccatgaaaagaacacaatgggcacaaagatgagagcacccattccggcatcatacatccgagcaatctcacggactgagtcccagagcccaacgaatttcacgaggcgcttccatgtgacagccagctgccatgatatgcaacaggttagaaggcatgtgggtaaaatccaaacaacaaagcatagaaaatgtggcaaccaaattcaagtagagaagtttgcataagccaggaccgcatctgtaagaactaatcaaactaactaccagtgatgcaactaaaatctgtgctacaaacagcattaaccctgcaacatttgaggaaagaaacaagaggaatgctgtacttacacatagaacacaccatccagttgctacaaaagcaagcgcacttgcaaatagatcagcaattgtaaactttgtcaatgcaataagtagagcaattcctgcaatcattccaatcgcaaggaggccctgtagaaaccgaacaaaagttggcaaggcggttgacttcttcggagttgcagtaaaaagctgcagcacgatacagcaaaagattagcttagatgatgttgcccatataaattaaaatcacagaacaggtagagatattaagacttcaacgtaacaaaccttaaataggagcaccaaaacgagaagtacaatccatgagaagccataaacctatccaaaaaatgcattagatataatagaagatcagaaggatagatttgctagattgtagaagctataggaatccataccatgcagtcttttgtggtttataacactattgttcacataggaattttaaatcaggtgctccagacaaatgccaaaactaacaaaaaattctttttcagctaacatgaggcctcacagtaccaagtgtttcacattaacgaaaacacatgaatgttttttaggccaggaaagaagagctacagcatttaatactgcattcgacatgaatggaagaatgcaagatggaaaaagaatcaggcagacacgtgcttaactgaatttttaacaaaggttttgatgtgacgaaatggtttgctaacatagcaattaaaaatttgcagtgcaaaacaatggggagatccctgacttaccgcaagagatgtattgtgtgaagcaattttgagcttataaacaatgccatattggaaaataagaaatctgaggcttaggatagtctctaggatacgtcctcttaatgtctggatgtgggcctgtatgcatgcaataaaacagtgcataagtgaaatagtcaaaagatatggttaaatcaagtatacggttaacactccaaacagtcatagttactgacttgctcctcatcccaccaagattcccagctgttttccccctttacaccaactccacctttataaagtaaccaatttgtccagtcatcaaagtcctcaacagtcctgacgtttggaaatggaagccaatgaagagtgagaattgtggaaattaatttatccagccccaagaacatctctaaaactaccccaagcgtaagtttctaccctatatactcctagaaaaggtatttcatcaaacatagtgttatgtttcttcacaaaaacaaattgaacaatcccttgattttacccaatcactggtgatattacctgaatgttaggcaactaaagagaaattaactaaaagataggaatattctgaacatacttttgccactcgaaaccagaagggttgaaaatgtatggtgcgaagagccaggacacgacgaggaaccaactactgatagttaatagaataaaggaagatgaaccgccccttgtataaccatatgcaatgtagataatgaggaggagagcaacttcaagcctgcaaatattaatatatatcagattaatcatcaagtagtcaagaaaccaatcaggcacaccataattaaaattgcagatttcattcgttgagtcagatccctacagtatccagacaaaagaaaacagaaatgcgtgtttgcaagagggcttgtgagccttctaaagtaaaggtatctagcacttccctccaccaatatcgacacatgggatagagccagattttgattcatattgtaagatgcataaggaaacatttcattcaatcactctcacaaaatagctcatgtctgataacataggtaggcatgggtcactgtaatacaacatactaaaagaccaatatgaacaaaatgaaatgcatgctccatttcatcaggcgaagatatctataaatgacaactactcatataagttgaatttcttttaagtattcacttgaaaacttggaagtagaaacttacgctttcacaaagtggcttcgagaatagagccgataattttcggcaaattttatgtgacgaacaacaaaacctctaccagtagcatgatactgcataaagggccatgcgtcagaaaaaatctaaaaggtaatataatatacgtacactagcaaacaaattatacctttgcaccaccatgaagtattgttctcccaaaataatgtgttctagttccaagagagaatgtgaaaaacactgagcagaactgcagttgcattgtaataaaactgaaaatagcctgcaaaacaattgaaattgtaacatgattatcatctcaaaaaagaatcctaacatgatttacagcaaccctgtgaaaagcatgtatcgttctctaaaaggaaacaaagcccaccttcagtagccccagttccaaaatgaaacccattatcatcggtactgcagtaaaaataccaatctggaccaaaaattgagcgttcaaagcagcgtcgagtgcagtgtttcccagaaacctaaatgacgagatatttcatagtcgagcccagagagtgcctgaatttacaaatttgcaatagctagtaagaatggtaaaagaaatatataatatacaacacaagcaacattcagcaaaatttacttgcattcagaagcataacacattataatttaaatacttaccagataaacccttccatacaaaaagatatacacagttagaacggtcatctgcatgcacacataaataatatagttatagtaaataactggtgatagtaaacaaaataaaagaattgctgacaaaactacaaaaatgtctatgatgtaaacgtgtccaaaatcctctaggcaacaatataactaatggacatgcaatattccattcctcaaaacaatgcttataaggacattgagacattaggtatcaggtgacagattgaaaatcttgcagttatagaagctatttatccagcaacaatcaagaaatcatacacacaggtcctcggatgagaactagtattttcgatcagaatttatcatattcacatagcactatattccatcaagttagtgaaactatcttttgctaattgctaaatataaagttatgcccctaacatatactgctattatgatttaacaggcgtatgcatgatgagggtttatactaaaatatgatgagggtttatactaaaatatgaggcgtatcactcgatgagagtttggaagagtagaaagctccacccccattgattaaaaaagagaagcagcaaacaggtgtattaagccttcaactagatgttgcatcctcaaaccttaagaccttgtttggcaaaggccaaactaccaaatcctggctcctccctggatggtccaggaatttagttggccagaaatttgaaataaattcccggcccatccctggaaagggcctaacttggtgtaaacccattcatggtatatgatttagacctagttctcgtatcttgatccctgtgtttgatctcaagcaaacaggtgatagtttaggatagtgcaatgcaattaaaccaaaccatgatatatgattagctaactgcaatttgtcgctctcatcccatctaacagcaattatatcaatcaaataattgtctggatgcagtgcacacatgtactcaagtgttcaagccgagctggttcatcacatagaccatgtaagttgcttcaagcgtaatcatgtgcgattggggcgaggggttaccattgtgcagacataataaccaactgtggtgaaaaagaaagtaagcatcctaaagaagtcaaacagctgccccagacggtacacatctctgcttaaaacttgttcaccgttaccaccggctactttcccttcgaaaagtgctatttggttcaaaccaacatctcgtcctttcccaaccttaaaagaagtgaaatagattgttagattattattttgggaaatgataacaaagatatactgattttaaaatgcaagtgtacacaagatgacatatgcacccattaagcaaatgtgttaacctgcacttccaaaaaaaaataaatcaaaagtgtaagaaagtttagttcatctgttcaagtgcatttgctaatttgcatgcccaagaaaagggaagaccatattgatgtatgtgtaatacgcgtccaagccgcttaattctctgtaccagacatgctaacaaaaaaaaatgcaagtgcacatgccatattccaaaaccatgcatatttaaaatcctcaggaccaatctcatacacaaatcataatgagtgcacattattcatgttatacacatttgcagtgcaaaaaaattaaacagataacctggatatattcatggtgtgtgatatttccctggcgcagagtcgaattgaatcctgcagattagataacacatacaagtcaagtttgaaagagatacactactaagcatgcacaagtgacgtaactaatgtttagttctcaataagccatatatggtttatatactgtgaaagaacaacaggcatggtttatcagaacagtcttatcaaaataatggcacctcaactttttgcaggattgatgggttgtctcgtgaatgtagacttaacctacgagaggggggcaacaaaaatagatccatcaaggaacccaatagtttttttttttcagttatggtttttattttcacggagaccatgggagattccttttccaagttaaacaagcagcctagacagtcatgaggccatgagatgttttcaatgaacaatgcagcaataaccacattcaggtaacttcttaaccggagcatacaaaataccaaccagcatatatatcttcacttatattaatcaccccggatgctttgcttatgccacctctggttatatgaaatatgcgatcaaaaacatcaggatgtccataatgcattcgaaccctgtaataagaacaataaaacacaattaagttccttggttaaaaccattgtcacaggtttgttgcgggggaaaaaagagaatgtggtaagaatgagatattattccctgcaactagctaaatttgactcacttgaggtaagcaagaacacgttgccccaaagtaacaaaacttgtttcctggttagacataaatgatgcaagcgaagaaacactgcagcaggaataaaatataataggttaatacaaaaataaaagcaaaaccaaaagctagtgaataactgagagtagtcatagtaaggataccttcccgtgaacacatgttccctaacaccaagaattgttggagggcggattccatgcttaccacgaaactcttcaagtaaattcctcattttcattgcttcctctaagtagttatcctacaggagaaattttatcagccaaggatccaagatggtttctggtgcacagacaccttttcgaaaaagaggggagtgccaagtatatttcatctacgtagagcaagtataaactaatgtattgcatggaccaatggacaagataaggtagatgggtcagaatatgaccccatgttatttctccatatgagcctgggtcaatgatcctcacatctcttttgaatctaatctgcatgtcacatgttagcacctaaagatgtcctctacctcactcaatgaggtattgagtgtaaattccccgtggcccctggtttgtacacaatggatacctttctccagtgattttgttaatacttccatcacaaagaaaaaaacaagaactcatcttcatgtttagttgtttacaccaatttaccaagcatgaagaggacctatcaccgtcagaatcatggttaataacagcatgaattgtgaataatccaaatggcaagcagcgtactacatgagcatatttttagaatctatctcatagaattacacataagaatctagacaagctcgacatttcatgaggaatatatcaacaaaaaggataatgctactgtttttttgccgggtcggccaaaagatttggtcgacctaatttcattaaggaaaaggggagtggacaaggctactgttaatgataatgataagaagaaaacctgattcatgtcaattgtctgtattgcatctcctcgagtgaatataatagcatggttctgattttcaggttttccctcgccgagcttgggattaccaggcagtttaatggagtatatttcctacaggtgcaacagtatggttaagtaaaacataactgatgcaaaatacaccagtaaaatacatcatagattgacaagaaaattccttctagagttcggattatggataattaaagtgcaccacaacagggaacagaataaaataagaagcatgtcatatagttgaacggtctaatctcaagaccttattcaaaagtatatttcattcaaaatcatataggatatctctcagcacagtaacatgaattagtaaccagactaccatgattaacaccaacggaatacatgagttatattttcataaactgttaatttattagaggatacaattaaaaattacctaacactacttttctacagattgtgcataagttttttatttatgtctactccctctgtcccaaaaataacttcatctttggctctaggtgtgaaaaacaaggtaagagaaaaaaaactacaaaagtgcccctcattagcagaaaagtagtattagtgggtgggtaggcaaggggtattgaaggaataaaactcatcgatttgctgatagtgggtaggttagagagtaaaagtgaacttattttgggacaaacggtggaggctaaaaatgaagttattttgggatgaagtacttagcaaggcttggaaaagggcagaggagaaatagctatatagcaatatatgcagaagacaagattgatacacagcaatgtcgagcaataacatttgaagatactagaagagttaagtgctgaatgcagacagcattggagctggtttttggtagcaagaacacataatgcagtagcaagagactatgaaatggtgaccaagatcatgtttccttctaatcctcttactcgacatatgaaaattgagaagacattgttgcaaatactttataaacctaagaaaatttgatctagaggaaacaatgtcaaatagttgagaatcacagtagtttctgggattgcaaacaaggaaagaggactacaggacatcaggaacctgtgagcacttgattacctatcactcactaattcttttgacagccagtaaggccaacaagtaataacgctaaatagttgacagttcaatccaataaactattgtctactccctccatccacaaaatataagggatttgggggttcaagtttgtccacaaatataagggattccaaccacccttcatttaattttcacccacccttacctccacggctccacctaccctctgactccccaactatcccttagtctttccccctgactttaatctctccaaaagaacctaaatcccttacatttgtgaacggaggtagtatctactatagcatattgtgtagcagggttcagaaacatgcaccatatagggtaaatatcagtaagaaaattaatgagaatatactaacttgatcttttccatgaacatcagccttaactagcttggagtagtactctttacggccatcgcttgacacatcctcctcgtgtataaaagcaacccgaagagcttcatttctacaagttataagaacaaaaatcagcatttattcaatggtacagtttacagcatgtaacagcaacaattaagataagacactaatcagggaacttcgcataatgaacacggaaccaagaacacctagcacaccatacacaccacacaaatttaccaagctacctttgcattaagagcgcaatatctgcagcctctggtgctttcctttgcttctgctgtccatatatttggcaagaaacaacataagtaaatttaagatctgcttgggcccgtgcatctggagacacctcataaccttgagtgtcaatatattcagctgcagaatatccatcttcaatgcctggtagaacaatcaaaatgatgaagatagccgagaaacgtattgaattaatctagtaccaacagaataccaaatacgcacccccaagatatctcttctccaggtaactctgcaacatcaaggcccttcggtagtacatcatgccacgcactgtttcagcaaaatatgaaggaatatagcaatcaaatggtaggacaagacatgaaatttgatatgagaataaagttgatatacaggtgtagcattaaacatactatattggttggatatgaactccattgcaactttatcatttatattgcagacaaaagaaatgaaacaacaaactgacctgtccttgccaaagtttgtccacgatatgatacccaaaaccgcagttctaacatgtcacttggactttccttgaaatcatcttcggatgattctccccgaccgattcgttctaagaagttgttccactcatctgcaaaccaaataaaacgccatgccacaaacccataacaactcaccacattataatgaaaacaagcatctttagataaatattgattttgaaaatgctaattattatatgttgtttggagttgaaaattgttatgtgaagacattagctgtggtctgttatggttctaaagggattcaaggttttattttattttcatttatttattgcaataatgattctttaacccgttacaatcaacggataactactaaccataatctataagcaattatagtattaacaagtcccagcgctatccacttatttatataggtgagcactaaatataaatatgtaaagaaggagcaaagtatgtccaaaagtaaagaaccttcagagacaataagatattgtaataaagcagcggaatcataacaataccaggatagattttttgaagatagaaaagtatagaaatgccatcttcgttctcaacacatagctcagacatgctataaagcactgtctcactgtagtatggggtaaacacactgttgcacaagataattaggtgtcaataggttcctatttttgaaatagaatgaagtccatacatatttacagtacctgaagggtatcatctccgagacaggctttgctgccggcatatccatgaatagagagttcgtaaaaaattgcaaccttctctgagcttccaaatttttgggaatgttggcagcagagtctttaacagtcaaaagtaggtgtaaccgcttaacttgttctttctgcaggcaaacatagtcactcaaccaaggatatagaaaggccaagcaaatttcagttatttgcataagagaagtaccatttccagatcctttggccagaaaatcctagagaacagacgcccctcatttctagctcttaacagtagttgccatgtatcgaattgttccctgtaacaagaaagagcatattttcagaagaaaataaaacggagctatgtcttttgcaaattaaacagcgagttctcaccacatacctcaggttcggtgccagaaactcatgggtaacaacctcataaagctcacggagagcttttgtaacaccagctgcacgatcagcagtttcatcgcgtatctaaaagatattcaatttaccacataagatttcttcatggtaaatttaccaaacagaaaaaataggaaataattaaacaagaaccaaggcacgatatctctctatttgcattttactccaaaataaagtgcaatagtctttaccagaagtcctgtcaaaccagtaagcctcgactggactaattgcagcttcttgagatttatggtcactaaaagtgaaccttgtgctatactttcattcagatcccgaaaaagcctttcaaccctgtacatgtatcaatagtatgcattggcattaagtaaagaaaacttgggggaaatacaacacaatattggtgtcagtatcagatatttcatctttcagtaggaaagcataccaacgctgcccttcaccatcaactaaagagtgaagaattctctctgcactgaaatagcattccttgacggcgtaggccatgtattcatctcttgatattctgtcccataactcatactgtgagtctttacaatctgaagcatagtcattcgccaacataatctacaaaagaaaaaaccaacagattcatagcaaccaataaaagaatatatatgcaaaaaagggatctatctagctaatttcaattaggataccttgctagtcagaagaaacaatggccactgtacaagtcttagattgccacagttacttggcatcataagcaaatccatttccctgaaagagaactttgtcatgatactgaagcaaatgggatataacaaaataacaaatggctgtgattacatgtacctgttgctgatatagtcctcttcacgtaagctcttaataatatcattccaaaacggggagaatatcgaggcatgcatcttagtaatttctggaccctaatgttgagacaaccaaagcaatggtacatacagatattacacttgatagaacgtcaaaaacaagactagtatatcagctagcctgattttggggagctagattgtggtcagatggctaagtggcgcaattgtgcatccaaccctctacggttcaaatcctagatttggaggttgtccaccaattttaggagtgtacatgcatgcaaattcagtggatgcacactctaggggccattcggtgcctcccataatatttgaagcgcgcaggtgtgtgcgtgtgtgatagtgtgattgcggtgtgtgtccaaatgtactcactcaaaaaaaagccagatctttgaagtggatagaaaacggaggtcatactaatatgttcaggctatcataagtttagagaggtagcggcgagaataatgtaagaatacaacaaatctggtgcttaacaagttaagaataaacctagtagctccagacagaagtcacggaacaaactaaattagaatgacatgtttggtgaagtttaaataattgcatgtcagaaccaatctattgaagttagtattagaagcaaaatgtaagtttatttacctgagcaactggtccgttagatatcctgcagtgttacacaaaaacagaataaaaaccaaggatcggaagatcaaaatcaaattaaccaaacgacagatctaaaagaaactataagatctattaatcagctcctatcatgagcagacagaatagcaattctggattagtgggagcgagtacctcagtggggaaagggtttttgcaaaagcttcaggaaagctctcaaaacgtttatgaagcatttctattgaacggatctgcgttaaattagcaaatgtaacgatgattacagtttgcaaactacaaagagtgagcatacagttattaagtacttcgggatagttctagaacatcagaacaaaatgtacctctccaaggcgatctctagcacccataacaccaccaacgagagcagataaaagagtgtaccaaatgtgaatgtccatcaggtatatctaacatagaaatgaaatgaaccatgtatcattttcaaagttcatcttattatttcatagaaaattacatgtcaacacaagaaacttacagctaagactggtgcccatagactcaggatggtcaaagcatttttattccctaaaatgaaacactgtcaggaaggaatttgcttatctcgtacttagaggaaaaaagaagaaaatagttttcttcttagtaaagctgtagcagaaaatgggcaatgcttttagtgatatgtgcaaaatgtactaaccacttgatacaagatcatgccaggaataatgcagattacggagtgtcacaatcacattcgtaggatcgactagaggtcgaatctgcagaaatgagataacacaataaacaagagtaaattttgataacacaaaaaaataataaacattaaaattctgaaatacacagttataaccacctggagaaaatatgcaaaagtaaatttgcatgccagtataaccaaccaaaacacaacgtatctgcatcagaatgtcacaagtaaatagcataccatgaccaaaaaaatagctataagagaaccgctggtgaattattcaaactaacaggttggtaacgaatcatgtatatggttaacaaatcagaaaaaatattcaagctttttcttttttgcgatttccacataacgactgggtattagaattttttttcctaatctggagagatcaccagaaaaactaagaatgccttgtacatttccaagaatcatctagagtaaaagaaaagaacctggtatattcgcctatactctcataaagtcctcgtccaatataatatcgctcctaaatgcaaacaggagaaacaatataagtacacgatttcacaatgtagatatgttgcaaactactgcgcaggatgacaatgtgcatacttggtatatccacttaaagaattggaaaaactgtgacccatcagaaaaattggagagcctgtgacacgctggtatcttggccatcaatgcaaacacaagccgaacagcagcataaccaccaagaacaagaacgtaaatccggaaataaattgaatcagagcttcttgcatttttctcatccaagactttcctgtttgacattcagcattcaagtgaggtgacttgctgtacattaaaaaaacatgaacaaaatactgaatactcacaaataaagataggttacaaatgttgagactgcagtcaaccaaatgaaccggatgactaatcttgatagggcaaaacctctagctgtcttatatgctccaaacatgagcagcacatccaagcagcctagagaagaacaaaaccaccaaagtcagcttaggaagtatcctttgattctagtccacataacaattagaaaagggattctctttatgtcactaagctgtacattcatcttggtttaacattttgactgttaaggctacatgtcagatgaacccagtggcaaaaaatgagatgcatgaaaagcttcgtgatgaaacaaagtatatccgccaaaaattgtaactagcaaaagtgaaaccatgaacaaagaaatagagagcgtacactcaatgaagttcagtatgaaaaatgctggtccagcactaactaatattttaatggtaccaatgtctatcttcccatgatgaaaagctataatagttaggcactgcatcagaaaagagcacttttagcatcataaactgtattcagaaatgatacttggatttaagctatacatgtgtacaagtacgatatcaaaccactgacctggaacattaatattagaaaaatccaaaggcgatgaaaactacggtacaagtgcagaaaagtgcgatgctcaacaaagtttgtctttccagtctgtaaatataaaattaaaagcaaagttaagtgcacataaataaccataatgcaaacaagatatgtacaaattttcagtaaaataaatgtgtccatttccttctagtcattgccccagccttagtcatcggtaagacccaatattttacataactaagtttaatgcccgtaagtttgctatgggttaaaaatcctacttccatagcacagcaagcccttgtcacaaatcccaacacatgccacaccatatgttcttctatggtgactgaacgagctccgctttgacctctgttatgcctctacggccttgcactacctacatcttgccctcttttacaccgcgcacaacccactttggatccactgttagtggacagtgggagtgtagagcacaccatgttaccatcacaatcaccaagtgcatcttttaagtaataggcataaggataggttaggatgaagattgaacactgcatgtttacttaacagaatacatattcttttaatactctccttttcagtcaatagatacatacaactcctttttaatactgaggcttattgttctcactctacatattcattacatgattgcagtagggtacgtaagtgcccattttgtagcaacgactcctgttctacagtacctgtggtacaacttatgtgaatagaaaccatgccttggcccttaagacagtctctactttcctaacaatggcatatctctaactagggatgaaactggttcagatagtcatttttcggattcggatagtttcggtcggaattatccggaaattctcggattcggaaacgaattcggatattttttctcggaaacgaaaacgaatacagtaagggtactatccgtcggaatcggaaaacagtcggaaactatccggaatttttttcggatatccgcagacattgagcaaattatataaaaaacacgtatatatacataactttttcatacggaatcagatgaagacaaactttatatcaacattgtagagctcgatgagatctacaactttattattgactattttattatttgaggtcatttatgggtctaaatattcattataatataccatattaatttttacaaaatctcatatctacgggcctgtttggtacagctccaactcctaaatataactccaggagttgagtctggagtggagttgtggc

SEQ ID NO: 32127 - DNA, 6350 bp, Oryza sativa
caggaggggtggagctggagctggagctgtgccaaacaggccctacaattcaacgacatctgatggagatgtgttccatatcaaagttgaagagctcaacgggatctaccactttgtagcttataacatttgtatttgaaagcatttaaagtataatacaaacattacaagtttcgaagatgtgaagtaaaataaataaaatctccaatttatacaatggtaagtaagttatacatctagtaaaaggtcttgggaatagaaaatgataaatcatatttgcatatggatctcttagaggaacagccatgaaaatcaattttcacatatggttgtgggaccgtctataaaattgacgatataaatgttggagattttgaactaaaataataagcgatatctcttccttgatcaagaaactcaatttgaggggttttttatataccggtaaatattcgctaccgtattcgttccgtctcatattcgctccgtatctgtattcgataatattcgatttcatttccgtatccgagttttcgattccgattccaattccgaaaaaaatatgaaaacgaatatgataaagctagtttccgtccgtttccgatccgttttcatccctatctctaacttactaattaaaccgacaaccttccaaattaatacataggattctgatctattatctaatattacggaaaaaaaataatgttacacaatctatctctaaggaaactaatcccagtggtgcgaaagtactgttggctaactgatagaaaggagaatctcaaatgatacaaaaagcacacataggctgatttttccataggtttgcaactcacacagccacattgctagccctaaaatactatggatgactacttactcgtttcctcttagcaggcttgcgcaaaaatttagaaccttcagcaggtggccaaccaagattaaagcaggagcgtgacctaaatatatgcaagagattaaatacagagaagcaagagatataataggaaacagcataaaagcagcagtttaaagggaaaaaaccagaaatattcattgaagtcatcataatttcgccatgcagaatgtgcagctttcccattattattattctgtgcctcctgtagaaggtatataatggatataactttaatacagaagaaaaatatcaaacatacagaaaacggttgctgcaatgtaactagctcaatttatcctttaaaaaaggattaaatcatcacatgcctcacaataatcaaccaattacaaatgaattggacaaaactactgagtgcgcagttacaacgaaatgccacctagtagtggccgtagacaataagacatgagaagatttcagaagattcaacttaattggtactgatttagatttagcagaagcatcatctaaacccaaaagtaaattgagatagaccttcaataactgaacgtaccgcttccatagtttgatatatcggagtaattattttctccagatacgaagcagaatcattagtaatagtacagctctttgcacgttcagcttcagatgaatcaagaatcccatcaagttcctttgccatctgacaatttgcaagcagcatcagtaagctcagcgtattgtacaacaggaaattgccactaaaaccaaaagaactactctcctaataagtatatatactgctacgtaacaccaaaatgccatccgattgctgtatcagtgttggacaccgtgttcacacaaatatatctctgagagagcgccatactgcgcaagtgccaggatattcaagagagaacacagattcggcatttcatccactctccatcctctcccatgttcccaccaacgagttcttcgcccttgatcaggcagtgcccggccccttcctttctgcctgttgatgatttcctatcaatctcagctctgtacccgtcatcctcgatctcgatctgggtaacttagttgcttcgcactgcacccatcttatccttaggagatggaagctagatgtaagtacgctgattgaagagcaaaggcccaagcttaaggtttcacggtggaattgtgctaacgttctaaacaagatctgctctaattaattttatcatgttattaaaatatatacccatgtcaccatgtttgtgacttctgaatccttgtaaatgtgcaatgctgtgacgagatacccatgtccaagcatcaaagatatactgaatcgtctaatatcaacagtcaagctcaagtttggcataaatatacagttggttactttaggacatggtgttttgttcatccaaagaataaaaactaagggtaaagtccatttatagcctttaaactttggccaatggccatttttcaccttcactagaaaactggatatttttcaccttcaactcttaatgggacaagaaacaccttgggacatattttttagtggttttgtttgaaatggaggtggttttcctagctgcatattttgttgatgcaaatggtacttaattaggtcgaaaatcataatacttaactgaagttcatgctagcgaaaaaccactatcatatcaattagaaccacgataaaatatggtttagggtgttatgcaagatgagaaatggactttgagcacagtttaaggttacaaatggactttaacctaaaagaaattcatgatctaatatttgcctaaatgaggaattatcgacaaaacttatttgactatccttttttagcataaagcaagcttccctgaatgtagtagtgcaatatcccattatcaagaaacatggaagtttcctgaaggaaaagcgctcaacagaaaagtagaaaagtacagtcaataatgatctccacaaacaatattgctcattatcattttgcgacatagaaaaagtaaatgtgcaacatccaacatgtgttctcacagtactataagattgaaccctaaaaaaagcaacttgacaaggcgaaagctgagataactagtcatctaaatgtttgctgtatttaataattttggtcatcagcagaaacagaccagaccatatatatataacactggatcctatgttgaaataatttctacgtgtcatcatctgcaattacatgaaaagaaaaagggcagaaattagtaggagagaaaggaactcacattgtggaaaatgtagcataggcattctggaagaaaacggacatttgcagcttcaccccaaataagaaaatacagagcaaccaatatgatttttctgttcttgttgactgcttcaaggctaatagaaaaggaaattaattagaaagcatccattgaaataataacaggcacagagaaaattaaccatgagaggttaaattacctggtccatgcaacacgcttgcccaagtacctacaccatttcatgtagttgtccagcactttcaaaaatacttctgtcacagccctctcatcaattttctacaagagccatggccattgccaatgttcattgtataataatatgtatcacaagaatttatagacaaaaatcgcaagtacatggaatttaaaggccaaaaaagaaaggaacaagagtaatcagcctatgcactgttaattactagtaactataccttattcattacttaaggtttcaacattgctttcataaaacatctggccgctgcaccgaggcaattataatagattagccatactgacttatatttctattctacaaacaagtttgaactttcattgattctatgaagggaaacagcaaccaatgaaatttatttagaccagtagagctaaagtgaagatcaagcaaaaggctggtgacatttttaaagctgagacagtattaaatggtaaccaccattattgttgcatgtgctccctttttttacatgcagaactatatatatttagtagcagaggaagtatcatgtcagtaggaagaaagatcttattgtactacaagtccaaatgatactccatgagaataggggaagaactaaccggctctgtcacatcaagcaagccgagccgggattgggcattggctaaggcaagcacaacattctcacgctgattgcgaacattatcttcctggaaaaacaatttaatctaattagaaactcgatagaaaggcagtaaccagtgatataaattagaccagtacacagaagcaggaaaacagaaagaaacaatttctcacacaatagatcgacgagtaaataatttaaataacataagatcaccaaacaaattatgacaaagcacatatttgcaccaaacttatttctgttttataatctttagttcttcacaaggtttctatctttctgaatagtagaaccgtaatgatcctacaatcttgggcaatcattccaatcatgatgttgtacaggatctaaattagggagaagtgtactaaatagtagtccagatctggccatcctttaaaataatgatgtttcaggtttgatcctgtaattcatatcctgtcaacagtcaacacaaaacaatcctgcctagaataggatactcgacatgcaaaccttgctcacaagctccaacataaatcaagaatgttgatgcaattgcaaattcacaaaacatctagaagatgccataacattttaatcttcaaaagtagaagcggattatgatcaggattcacataagctgctagatggtatactggcttaagaaaccaatcaaaaattgccatagcactatagcagcatgtaatcaagtgaagttgatcgttacagagaataaggcgtagtgaacaataaatattctgtagtatgtgcatactgcagaacaaggatttgctggcagatgcagcatggaaaggacacaggtcatgccaatcaatttttaactgctaagctagtacaagatttccaaaggttctatttatgactggatctgcagagaggatgcctcctagtatggaatttgctaaatactccaacatgtcacaccagcaaagattaaaggaaaattattgcacgatttcagaaaaagtaacagttgtaactgtcacatgtcaactcaacgcataatcaattcaaattattctcatagaaaccaacataatgtggtcaactaaagaagaattgcccgtatgctaagcatacagatttttttgtgcacccttgaaattaactattgttttggcaccaaaaagaacataacagcttccaaaaaatgacaatgcagtctacaggatgtctttgcaccctgcatattaaacttttaatttgaaaatgtataaggaaaaattacaagtaggtccaaatagtggcatgcgtctttttctccttttcattgtcatacaattttctcgtttttgttgctgtttgcgtagaatgaatttagacttcaaatttcatgcataagtaaaatgcatcaataactacatccctaattttagatttgtcatattgagtcagtgcaacaagaaaaagcaattgcacgtatgtaaccaaaaagggatggttacatagcaaatgttgccatgaaatatatggtatgagatttttcctaacctggaagccaaatacgaattgcagaaggtcaaaaacatctttgtgtcttagctgtagttgaagtgcatcagaaggaaatcgtggcaggtcctcacagttttgaattgcagctattgcagccctgacctaatagatttgcatgaaacaatagacaacaccataaatatttttctgtttggcaaagtaatgcaagatgataacggtctgtgctgtgtggacaacaagcattgcaacatgtacctccgggaaaaaaccaatagtatttgccactgatgatggtgcatcaaggggtacaatattatatggcataagttcacctctcagggctgcatcagatctttttattctcctaatctgtaaaacgaaaatgagagggggaaaaacactagttgagtgagtatatgaaaaaaaaatcctcagaggtgttggcgagcagcagcaacaaaagggtttaacaggagtaggggttctgtaatgactgcacaattacctcgtctagaatttgcctaccaagtctatcggatggtgattgtccaatgagaatttccagaacatcaagcaaagccctcaaagtagcatagatctttttcatctcgacagccctagatcccatgctggtaaaaataaaatagtcatgagaattattagaatgtgcataagttgtctttctatggttagcacaatactgcaatagagtgtaaacacgagagcaatataatgatgcaacatcgatttcatcgaacaaggttgttaagaaatggctggcagaaacaacgggcactgcagaagttagttgttaggaaacaaaaaaaa

SEQ ID NO: 32128 - DNA, 51381 bp, Oryza sativa
  unsure (1)..(51381): unsure at all n locations
gccgcgggggcctccgcctggacgacgacgacgacatcgccgacgcggcggaggcggaggcggaggcggcgagcccaagctaggtttagcgatctggtgagaccaaagcgcgcgggcgccggcgcggcgccgccgccacggatgggcgcgcgcctggcggcctggcgggagctggccagccgggaggagcggcggccggcgggaggagcggcgggagcgccggagtcgcgccggcggccggcctgccggctcacgtcacggtcgccgggtcgcggcagcgccgtcgccgtgacgccgtcgagtgggaggggagagagcgcacgggggagacagccagactggagaagagttagggttttctttgttttgatgggccaggcttttttcgtgggctaaaaaaatgaatacttggggttctctgggtcaaattctagggtagtcctgggcctacctagactacccattgggcccgcccctggacggccggacgacgcggcgggacggagagaggacgcggccgcgcgggcgctggcgcggctctgccgccacggatgggcgcgcggctggcggcctggcgggagctggccagcctggaggagcggcgggagcaccggagtcacgccggcggctagcctgacggctcgcgtcgaggtcaccgggtcatgggagcgccgtcgccgtgacgccgtcgagtgggaggggagagagcgcacgggggagacagccagactggagaggagttagggttttctttgttttgatgggctaggcttttttcgtgggccaaaaaaatgaatacctggggttctctgggccaaattctagggaggcatataattatgctagtcaagatcaaatcagtacagggagatatgaacgcagaaaggcactcaccgtggtggaacttgtgaccgcatcgctgccatatgggttctactgacacataggcgctaccatggcatgccacattagcacacggagtgagttggagcccatttagacctatatgacacccaagataagttaaggggcccaaaagtgcattctgagagttcagggacctaggtgacacacccgcacaagtttagggaccgctcgtgcactttactctattctgaaatatacaggacattatatccatagcaagtgtaaattatcattggttccatgaataattgtgtttactgcattagtttttttttctaaacatgtaaattataacagcaccatattctttgttcttatccattgcagcatatgtgttgcttggattaacaaaagacagatcgatatttgagttgctctaaagggtagattagttgaactcaattattatagggccaccaaaaaattcggccgcacagagcaaatgttagaccacaaagccgttacaaatttgtcctaacctaatcagaacagaaggcacaagcaaagccccagaggagccgtaactgatttagccacaccagaggaagcaggagtcacgggggcgagctcgccgggatccctacgaagcccgcggagcagcctctcctcctcctagaagtgtggtgatattgccaattgaggttcctgagaaattattgcttgtcaagctggctgaaattattttgaacagatataattagacagggttgtatatatgcatgcaattctaatacgaaatatcagagactattcttgaaaagaatgtgaagaaaatgaactgaattactcagattctgtggatagtttaattaaacacgcaatatctttctttcagttaattctgacttcatgcgttcttaataggaaaatcattcacactgcaagttaaactaaaggaagcaatgaattgtccgatcatgttggcagtccattatttctccgccgtgttcagcacacatcacgtgcaggaggaggagactggaccccaagccaacacagtacacgtgaaccctttgtagatcaagaaccagattacattgaaattgaatactcctaaaaaaaccattgttggatctaataacagtgccaaattaatactcctaaaaaaaccattgttcgatctaatacattgtcataagaatatacattatattatgcttcatttggttaaacacacaaccgaactactgatgtttgagagacaataaaaccgaagtacctgatatcttatcacctaccattttcttagtgagaaaaatgactcgaagttcaacaggacactacaaagtatgcgaaccatacaccaccgtaggcgggggattgagataagacctgaggggagtagcctcgccgtagacctcagtagtgtcaacgcagaccgagcagcaaattgagcactggaccactgtcactgacgcgaggtcatccccggcgaggcagctgcgcgtggcggggatagggcatcaaagagggtggaggcaatcgacggcggcggtgatggcgaggcgaagggcgatgcgcggaggcgcgggctgcgtcggcgcggagacgcgggcggcgttggcagagaggtgaagggcgtcggcggcagcgcgtgagaggggaagaggagggattagggttgggggagggggcgcaggtcaccaggtcgggctgtcagggtggggagggaggtggggtgaatccggagcgttggatcagagtgaggtaatctggaccgttgagtgaggaatgaaagaatgagtgatgagtgaatgagtgaaagaatttgcccttgttgaactatagggtagatatttgttgaactttagggtagacgtgtcacgctatatgagtgtactgccgatttttcataactttcatatacctaaatcaaatggttgagacgattattagtaaaagtttagtaataaaaaaaattagtccgtgtagcagtgctcagtaaatgaatgcaaactgtgaaagccgtggaaggggtcgttctccggcgatggctccggcgacggctctggctccggcggcttgtccttgtccttgatgagctccgccgtgcgctgcgcggccacgctgagcatgttctccacgtccatcgagctggcctccagcctgagcatgtccgtctcctcctcatcgtcgctggactcgccatcatctaatacctcctcttccttgccttcagcttcgtcgccggcggcgtgcttggcgcagtactcgaccatctcggcgaggggtttggcggcggcgcagccgtcctcgatcagttgccgcagttcccgcaacagactcgccgccctctctgccattgatgatatctccccgtcggagctcatcatcttgttgatatcttcttccgccattgatgacgacaactgtccagcgagctagcgaccggtttgcacggagaaatcaattagtaatatgctttgtcgatcatctattttattagtatatattaattaattgcatgaaaccgatctaatccgagtctaatttcaacttattacgaaatcgtaaaccaactgttgcgatgaatccgtttctgaaacatgcacacgcgtgcagttgagtggatttgctctgatccagaggggtttgttggcaacttttcgtaaaaagtcgacaagcacgatcgcagcaactaaacgacttgcggtgatatggagtcgccaaccacctcgatctagccaaaagctagaccaagatgggttttgataactaaatcggctagcggagccgatttctagataactacccgtctcgtgggcaaaacggaaggttttcaggacaaacctataaaggggtgtcgcactctcgcagcggcggcggacgatttacagcgcaaattgacaaagatggataaactaagagaaaattaaaagcaatatgaaaaacgattcgattgattgattgtagattgattagttacaattgaaccggccatgtcccttatataggggttggtcttgccctctacaggccctcctccacgtccaactcggggtagaaatcaaatgaaacccgaaacatgccttcccgagcaaggaaacctcgagacccgacgaaacacagtcggactcggacctgccggtcagaccggccacatgccgccggtctgaccagccctaaaccggcggtctgaccgcccaacgcacggcggtcagactggccctactcggaggaaaccggcagacttccaaattttggcaattttttctatttaatctctaggtgccaaatttgggtgtaaacacatgccccccctaccttttttatgaacaacgtgaatccaaaagcatagaacatgtttttggtcttagggcgataatccaattactggccatagcacctcctaagcgtcttgccaaacgctcgggaagtatttcttcaagtatttcccgttgattgctcgctgaaaaggctccccttgaagtgtctccaaaaaatatgcgttccctcgaacaatgccgcatattcgataaggaccttccctactaggagaccacttaccgaatttccaaaaaatatgccgcatattcgataaggatgccgatacaaatttccagtatcttttggtttgaacccaacctgctccctcattacatcggcaatcatatcagcccatgatgtttgctgaggtactccttgtgtttgttgctgcattagctcaaactgattgaactgaggagcaaactgaggttgaggcgatcctgcctgctgatactaaacatgaggtgacagaggctgatattgataattcaaatttcttccttgatagttctagaagttcggttgaatattacgtaccaaatgttcagggataatctgaggcacaactgattgatcggcctgtacatgatggaccaagtgttcaggaataacttggttcacagtatgctgcattggccgattgtcaggtgttctcaatctcgctgacgcatgttgtaagttttgctgctgagtcggatgaactgtctgctacctcggctgtgcttgctgagtcggcaacggctgtgttgggtcggctattgtcggatttggcaagaacattgcagcaacttgctcctgagtcagccgattgacattttgcccagcatgttgtggttgttctctggtcaacaatctggggttaaccatctgtcttggtgctgattgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcttccaacttcgtcttcagctcagaagcactacacttctgaaaagggggaataatagcaaggctgagtacaaccaccgtactcagcaagccacaccaacgatgcggacgtgcaaggggatacaaggaggggtttgtggctatttgcataaaggcggttgtaaaacattttatttagcaaacagtaaaactgttgaataattaaagtgacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcactgtaagtcttccagggtttctcgtgaaccggtccttaattgccatgggtgcgactcgcaaaaccatgcacccacagcccaccattcagtcgtattttagttggataattacgaccatgaaacatggccagacgtctcgagcacgcagctcaacaagatactagaatgtctaatactgcaattatcccatcgactgagctagtggtaattaagcatggctaagcatatagttctagctaggtcacataagtaacacgagctagtcaatttatcacccaaggttgacaaaggatagatatcaagtaaacatggcacaagcgagcagataggtaaaccctgaccccgtgtaattagcaaaacatgcatatttatttgtaaacggtaaaacatttataaattaggatcaacatgctcaaggggaatgtgtgacttgccttgcttcttcacttggatcttctaaactcttttcctcgcgaccgcggacttccgaaacgacggattctacacgctggcacgcaaaacgaggaaaaactctaataaaaaccaaggaaacagtacataaaaactaaacaaacatgtagagctcaattttagatgaattttgcaagttgaatggctcaattcggaattcgaatgaattagatatgaattttggaagttttgagccattttaatggatttctagaattattaccgatttattgcgcaatttaaatcaattatgacgtcatccgacgggggagaggtggcgccggcaagcgggccccacctgtcggtgactcacgggtggcgggcacaccgtggaccgagtccacgcacgcgctggtccgcgggcgcaccacgtggcagacacctggcggccacgacggacggctagcggaggtggcgccgacgtggcgccacagaggcaccgactcgggcggcacgggagggccacgtggacggcccagatcgccccgaagggggatcgggcggccacgggcgagcgggagccggctgaccgatcggccggccgggagcgacggcgcacggcccgatggtcgccggcgacgaccaccggcgcgacagcacgcgcgggaggcgacgaaaagaggggaaagggagaggagatggagggggtcctcaccgaggggcgccggcgacggaaggcggccggcggagctcgggcggaggatggcgtcgctgctccggcgacaagcggcgcccgggaggaagcggacgagggcggccgcgacctcgcgtggcgggaacgggcatcggcgacggggagctcggatgaggggaacgccgggcttcctatcgacgctgcgatgccactggaggaggacgtgaggccggaaatggtttggagcggcggcgagtggcagccggaggcggctgctatgatggcggttcgggtggtgtggtggagtgacggttccagcggcggaatggaggagcggaggggatgccggggtacgggacgacgcaacgaagccgtcggtgacagttgcgcggagcagcgacggcgggagtgacggtggcggccggctggagggcgctggcgggcggcggggctcgggcgcgcggtgcagtggtgtttcggaggcggagaggggaaaaggagtaggggccggggtgcggcacggcacggcgatgccaatgatggtggcggcgcagcgcgggggcgactggagcggcggtggcgtgcggctggaagcacggcgacgagcggcggagctcgggttcacgcggggagagcgggagaaggcgcgacgggcccgggaaaattggggaaatgggagaggagagcacagggatcgtttttatagcctcgagagggtgggagagagcacgagcgaggtggatttggggcggcaaccggcgggaagcggggtgtcgacgtggagctcgtggcggggcaaaccggcgccgttttcttggggggaaatgggggaaacggtggaggaggtggtgggggtgcagttccaccacttgggcgcgagcgggaggggcggggtggtgcggattttgcggcggagtgggcggcaaccgccgggaagcgtgggcggcatcgtggggtgtgggtggcggttttggaggggagagatgggggaaaacggcgcggacgtgggcggcgaggtcccacggacgaacgcgcgcgcgcggggtggaggaggtgggcggaaacggcagcgtcgtggggcggctcgggcggccatggcggcaacggcagctgccggcctgaggttggggatgacaggtggggtccacgggtcccacctgtcggagagagagggagggagaggccggctggggaggcaaaacagacttgagggagagagagagccgagcgggccgagggaggaggccggcccgagagggagagaaaggaggggttgggccgaaaggggcccaaagagaggaaagaggattttaattgttttctttttattttaattgatacaatgatctttgtgttattaaaattatttcttgagctccgaaaattcacggaaaattccggagagtattttagggcacaaaggatattacaaaatattcccggccaatgatttttaagggaaaattttaattctcccaataattcacttgattaagttgatttaacttttatttaatttctagaaaatgcattatttaatgatttttaatcccgaacgaaaatcggggcgttacactgatgatgtagcttgtgcagaagttgaagctgaagccatcggctgagccggtaatgcatgggagacattcgactgatttgctgtgaccaatggtctataatttggaaaaacacctcctggtaaatagactggtcctgaagcttgatgttcggctatcgaaccatcgacaacagtctttaccatattggttaaggtattaactaatactccagactgattgatcaaggcatgttgcacggcatagtcgatcctatcttgaaaattattgaattgcagtggctcttggttgccatctgcaccaaggtcttcaactgtaccatcttgaggaatatcacttttgttacctgagccagttgcagtacctttgtcaccctgagatgaacttgggctgacctcatcggctgcgaccaccttcaacttgtacttttgtacgatggttcctctgcgggtctcctgaaaagaatccatgaatttgttcttcacgttgctcatcatctgttcaagttcatccctttgctcagctgtcagcctatccaatgtgattggaacaatattggttgggtccacttcagctgatggatttttggcccccattttatttacgggaggtttgactcctgttcccggtgatggtggtggtttttcggccatcgggatgaagtcgttgaaaactcaggtcccaccgggcgtgccaagagagtgttgatgtaaaaacacgaggcctgggagatctgcttaactctagtgcaggtccaaaatcttgcctttgaggttcatgagcatgccagttgatttgatcctgcaatcaacaagaaataaagacaaagaaatagtagttagtccataaatgatagccgatcgaccagccgccgatgacgtatcatttgtactcgagccgatgtcatctttgcatcgatcggctgtgcgaggcaataataaagaaactaaatctattcaatcggctgtagatatcaatgataaataatcttcatgtcgatatatacttaaatcaagtaattgggatagatcggtcgccatgccgagacagtataaatcacttagaccgaaatatatattaacaaggaaactataatcattcacagcatagctgatcaaatagatctagcttgtatcggctaatactccgatactactctaccttaagatattaaagcaagtaaaatatatcaaacgtaaagtttaacacacctaaaagcaataagatcttaacataaagggcagatttaacatatcaattaagcacatgaaatataaggctaaattaggtaagatcggctgaaaccccgatactactctaatcgacaaccaagaagcaggctagagattatagttctaagcacgacttatgagatcaaactcaactgatgcagccataagtatgaaaagaaagacaatatttaggcaatcaagctattggaagcttcataaagtggtagatatcctatataatctaagccaacgtcgatacttaacctaatcggctgctctccagcgatagacactagccgattggaggttagatagcgatattgtcagagattatataagatatatgataactcaacaacttacatagataggattagagtatcataatgatggaagcaccaatctcgagaacgcaagccaccataacaagtcatacctctagttgaagatcgaaaccgatgcagttcaacccgaaagcaagaactcgtcgaaacaaaacgaaagtaaaagggtggcgatgcgccaagattgtatttgaacgtgtgttaattgattacatgggactcggggtctatttatacccgagactacaaaatatgtcctttgtcggacacgactattatctctaacaaactctaagataccataagtctttgcagcagacttttgcccaaacttatctctaaggaaattacataaaatatcctaattaatagatacaattgccttcttagaactctatccatgtgtggcaatccatgtgaagcacattaactcagctcgataatgtaaaccgattcatattgtcggaatcggctgtatcggctaaccctatctgacttggactcagccgatctggtcgtagccgatctggactcttctgttccctgggcacaaatgtccgaattcacagctaattcggtctttgaatcaattgcggcgtgccccccatcgctctgtccagaatcggtcagaccagccatacaagaccgatcagaccgcccggggtggctggtcagactggtggcatgtggccgatcaaaccgcccctgctcaccggtcagaccggccgtgcaacgccggtcagaccgcccctggtctccagttttgccaattttgcacaaaggtttaaaaatcaagcaccggctcttctagtatcagaaataatcccttcttcacattatagccagatgcttgttgtgccaaatcatttgctctagaattatcgaaattagcaataatgtccaagcatgaatcaagatacctatttagtgatccgtccaaacatttgtagattccggcgacttgttgcaccaccaattccgaatcaccaaaagcttccacgtgcttagctccaatcatctccatcacttgtaagccgaataataaagcattatattcggcttgattatttgtacaataatactccaaatgaaccgatgcctcataacacatgccattaggtgaaaataaaactacttctataccttgaccttctttgcatgaagaaccatcaaaataaatcttctaaggtataacttcaactaagcaaaccccttcttcataagcaatatctacatgatggtctactataaaatcacatacaatttggcctctcatagatttcaacggttcataatccaaatcatactcaatcaaagcatatgcccacttgccaattcttccacttagaattggccattgcaacatgtgtttaataatgtcggcttgacaagcaactatgcatgtactagataacaagtaatgcctcaatttggtacaagcatagtataagtatagacaaagtctctctataaagacatacctcgtttcggcatccaaaagatggcagctgaaatatgtaatgatatactccttgccatcttcctcttgcggcaaaacagcaccaatgactttatcctcggaagcaatatacaaccaaaaaggctttccggctttaggcgcccgcacaacgggtggagtagataaatacttcttcaacccttcaaatgcctcttgttgttttgccccccaagtaaaatcggcttcttttttcaagcggagtataggaacaaaagcatcgattttacccgctaagttagaaataaatcttcttaaataattcaccttacctagcaacttttggacctccttcttgcatgtcggcgctttgaaatcacgaatcttttctatcttcttaggatcaatctcaacccctctctcatgcaccatgaatcccaagaacctccccgccgacacaccaaaagcacatttaagtgggttcatcttcaaaccataccggcgcatcctctcaaaagctaacctcaaatcggctatatgtcccttcataccatccgatttgacaacaatatcatcaatatagatttctaagataatacctagcaaatcatgaaagatcaaattcattgccctttgatatagtgcaccggtattcttcaatctaaaagtcatgacaacccactcaaacaaaccaacaaatcccgggcacctaaaagccgtcttgtacatatcttcttccgccataaagatttgattgtagccagcattaccatccaaaaaactaatcaccttatgacccgaggcatcattgatcatcatgtcggctataggcataggatatacatctttgggagtagctttatttaaatctctaaaatctatgcaaactctaatcttaccactccccttcttctccaccaggactatgctagaaacccactccgcataacgacatggcctaataaaccccgccttcaacaaccgatcaatctcctctttgactcgatcatatagcaaagattaaaacgacgaggtggttgtttataaggcctaaaacctggtttgattggaagccgatgctcaacaaactcacggctaagacctggcatctcatgatactcccatccaaagcaatccacatactccttaagtagctcgattattttaaccttataatcggctctcatatttttgtttacaaaattcggccttggctttgttccatcacctatgtctatttcctccaatggatcggccgatgtaaacccttgtccaagcttctctacttcatcaaaatcttcaatagtttcaccaatatcgttctttgtagaccgatattcttgcaccctcttttgcaaccactctaaattagcttctttactcattatacaaatttatatagcctagccgtgctacactagccggctttacagagataagtacaaatttgccatcggagatactaatgaaatcatagctagaaagatccctccccgataagcattggatattcccatgacgccattcaaatgtagcatcggccattgcaacctcggccgatgtatccgttttaacaatctcaacatcatcgccgtcccattgaatcaaacattgatgcaaggtagaaggcacacaacaattggcatggatccaacaacgacccaaaataacattgtagttaccttgcacatcgactatgaagaaagcggttggtagtgtgttgtttcccacggtgagctccaccgaaaagatacctttcgcctccattggttcaccattgaagccattgagaaccatgttggtcttcttcaattcattatcctcacgccccaacttcttgaataatgaatacggcattaagttcacggcgacacctccatctactagcatcctagagactggcttcccatcaacatgacctttgagatagagaggcttcatatgacggtttgattcatcgggcttctcaaaaaccgcatctttaggacctagtgaaaattgagcaacctcggcttcatccatagcacaaaactccataggcaacatacacaccatgttgatatccatgtcctcctttggagatgactcatctttagcaaccgattgttcttctttctcctctacaacaaccggttcttccctctctacggatttatgcctccaaaaggtggtggtcgcaattcattgaacctcttatctctttgctcttcggcctttttctctcttatctcttgggcccgaagatgctgcaaccttctcctttgagtagccgttaaatccttagggatccacctaggtttcggctctgttccaggaggtaaataatgccccctattgattttgcttgaagacaatgaagcccctgcactactcctttcaaacctcctgtcaaaccggcgttgaagcccggtcaaaccggacgtagaccaccggtcagaccggctagaagcgccggtcagaccgacattgggtcggtggtcagaccggcctgatggcccggtctgaccggtccgcagagctacggtcagaccggccagagggcctggttagaccggccaactgcgatgagctggtcccaatttcggatttgttgcttgatgacttcccaactccatctccagaaggtattggcatatcatgagatcccactttgatggtaatcacctccgaagtccttgcctccaccttaacacgctttccttccctcttttcttcattaacccgattttttccataaaaccggctattatttggtgaagacaagcgctcatgaattggcctccttggtcctccccacccttagttgaattgcattggaggcatatggttgaatattggcggtgttgccccccatggcatgtagtaaggataaggataacccggtggcggcattggataaggtccccatgacatgtcttgtgaatgatgatatggaggtgattgcgaccgttttggtgaatgaccaaatcgctccctaggaggtgatcttggtctttttcctttgttgcgagttctctcaccaccttgcttctcatacttctccaaaagcatgtccaaagtcactttagtcttcctaggtgctttagaagttgaagcctcactcctattctccttccatacaccaacctccagtttctttggcactatcatctttggcctaggttcaccaatgatcactccctttcctttagtagattcggcttgctccggccgaatcaacaccttcttatcattgaaattaattgtattcaccgaaaaaggatcatgatcaagcttcatcttggaaccatcagtgaacttcaattgtccttcatctatggccgattgaacctgtcgtcgaaacacattgcaatcattagtagaatgagaatgagaatcatgacatttacaataagctcgacgcttcaattcttcttgagatggtatgatatgtgtcaacgtttgatgtcgcgattccggtatttgcatagtatggggatcgttggtactaggatatacgcgagattgaggtaaaagagatagacagggatttttatacaggttcgggcccctgaattgtcaggtaataaccctacatcctgttggccgaagccgatcgttgctcttattcaccataatcacaccagtacaatatttgtggtagcctatctatctgttgtcgacttggcagtctgaagtgctaactcgtagtcgacaacagggtagtcttcctcctcgaactcgtgcccggcgagatcagagataacgctagatccctacagccggcctccataggtaccagatagggtcctcctaggcatatctctgatgttaatatccggcggcttgtcctggcgtatgttggcttctgttgttccttctattgttgcgtgtcccctctcctcctagggggtcttgtatttatacccataggtgtccccttgtccaagtagaactagggagtccaatatggatacaatccgactagtccttgccgtttccatatagaactctagttgtctttccttatccagaacttcctccaactcaaagtcagtttccgtataagacatggtatgtggtgggtcctgccgagatttagtcaactactattgggtatgtggtatccataaccctgacaatatggcctttaggtaatctaatttgtttttcttgcaaaagataatcaaaaatcttatcacatttggccacatcaaacctatacttaatctcactttgccgatctttacgaggagtcggcattaaattagagcaaacaaaaggcttatttttgttagtccatgtccactcagcaacatatatgtcatgatcaccctcatcatcactatcactagcctcaaagtaatcaattgaattaacattaggctttttctcatatggtctaacagattttttattatccttaacccggctttcctgagccagagccttttgcatgagttgactaacatcaataaattgttggccatctaatctctctttaataggagtaattaaaccattaaaagcaagatcagccaaatctctatcagttatgttcaagctataacatcggtttctaacatctctaaatctcttaacataatcaatgataggttcattatacttttgcttaaccgatgttaaatcagataacctaagctcaatttcaccagtatagaaataatcatgaaatatctattctaattgagcctaagtatgaatagaatttgtcggtaaagaagtaaaccatgtaaaagcagtaccggacaaagacaaagaaaataagcgcaatttaaaagtatcactattagcctctccacattgctctaaaaattgacctacatgctcccatgtagtcctactatcctcaccactaaatttggtaaattcgggaaccctataattacgaggatatggcacattatcatagtaatcaagatacggcttttggtaaaccttagcacgattcctagcttcaatcctgaatttatccctaataattccactaatcaagtgctctatattatcaggcctatgttgatttggtggtggatttggtggcctaataggttgatgttgtggcgcaatatgattatattggccttgcctagtatcaggaggataccccctagaaacatcattataagcattaggaacatgtgggggaacttggggattacttgcagcagtagatacaggaggaccaaatgttctaagataatacaaataactaacattagtcattgaatctatcccctgaatcggcactattgtgccgatttgaccggtccagagcccggtctgaccggcgtccataggcgcggtgagaccggcctgagtcccggtctgaccgccggggtgaaacccggccagatctggccggtctgaccggcagtggctttatctggcccggtctgatcagcagtttgcgccggaaagccctcgccgatttgttgtgtcttcgctccatcggttttactatttatttgatctataggagcttggctagcactggtagaggctttatctttgattacaaaatcggccacgagagggccgagtttatttctcataaacttttcacaattattttcaaaagatgcttctaatttgttattgaaagcaaccatagatgcatctattgtatgagcaacttgttgttgaagagattgtgataattcctcaatacttaccttgtcaaaagtagatgaagacaccaaatccggcttgaagactacgccatgacgggtctttgagcatgtctttaaaagctcgtcggcatacttcttcatgtgttcatcgaaggccatgcgtgcttcctcatcaagactctccatcatcaccggcagcacattggatggatccacctccgccttggttgatggaggcttcgtcatggcgatgtcgaagttgagatggcgttgaacggatttccccagcggagtcgccaaaattcgtgttggcaactttttgtgaaaagtcgacaagcacgatcgcagcacctaaacgccttgcggtgatttggagttgccaaccacctcgatctagccaaaagctagaccaagatgggttttgataactaaaccggctagcggagccgatttctagataactacccgtctcgtgggcaaaacggaaggttttcaggataaaccaacaaaggggtgtcgcactctcgcagcggcggtggacaattttcggtgcaaatcgacaaagatggacaaactaagagaaaattaaaagcaatatgaaaaacgattcgattgattgattgtagattgattagttataattgaactggccatatcccttatataggggttggttttgccctctacaggccctcctccacgtccaactcggggtagaaaccaaaggaaacccgaaacatgccttcccgagcaaggaaaccttgagacccgacgaaacacagtcggactcggacctgccggtcagaccggccacatgccgccggtctgaccggcccgaaaccggcagtctgacagcccaacgcacggcggtcagaccggccctactcggaggaaaccggcagacttccaaactttggcaatttctcctatttaatctctaggtgccaaatttgggtgtaaacagggtttatgtaaatcttatacgtttggggcatttgcaaacttgtccattgtttttcttaatctaacttacaactctggtttttatgatattttgcaagaatgctattcgaatgtggtagttttgcaataacaatttaaaattgtggcaaatttgcaattgccccaatatatttatcagcccattaccggaacactaggcttctttctgcttcctgaaactccaaaattattaaagatcgaagttaccaatgtgattccgattcagaagtacatagaaaatatcgtagtacaagaaaatatctccaaaattatttgtgctgcaagaaaatttggagcagcaccaaatcacaagccaaagtgcacaagcattacattagtgttccaaaccattgctgcgaagaagaacaaaagttccaaacccttacagaatgaaacattatctagcatcaccagtggaaatcctcaacagtaccaagttccagacttccagcacaaaaagttcctgtgtagattatgggtaccccatactcacacggcatgtttatccgactagttataggggataactcatatatctatgaaatatgtaatagatcatgacttgggtattacgtttccttgtatattacggaacggcctaaagtcctggttcgataagattgtaaagtagatttaggaaaccgataccgtattggttaaggtttctatcttgtaatcctgccctccatcctatataaggtgggcaggaggccctctagggggcatgagcacgtatgatcgtcagatctatactacacccggcagattcaaatccccaaacaggagtagggtattacctctcattgagagggcctgaacctgtctaaatccttgtctccgcatccatccacttttaggtctcgtgcgctacccccttttattattgccgaattcatgtttcgacagttggcgcgtcaggtaagggagcatcgagtttcctgtcacgagtgtgatggaaccaatgtgcgacatcaccagattcatcaagcatgtctttttcatctcggattcaatccagccgaagggatcaatctcggtgatttcatcgattcaatctccaatgtcattggctttgtcgtttcactagttagattgttctctaactgcagactaatctcctattacctttctttttcttgttttcacgcaccggctgagatcaagacgaagtcccggtgtgtcttctcgtcgcccagtacgatctgtataggtaccggcgtaaccttcatacgacacgggaacaattcatgtccatgggatcaacagcaattgagtgcttcacatgcagatcaactgatatgcacggcttaatatcaaaccctagcttgatatatgtattacacagttaagcatgtaatattttaaggctaatcaaattatatttgtttattttgcatgtatactggagcgatgcatggttggtcgcatgcccaggatggcaattgagatcaaaaaatcgttcattaacgagtgatgggatttggcagtgctgcggttcctgacctccttgtaatttatatatttagattaattactaacgcatattaatcttctcatgattttttattgcatgtatggccgtcggtgcaatgcttcctactgtaaccatgttgccgagaggggtacgccaggacatagtgcgtggctcgactactgatgttgatgatgcagcgttcgctcatgccacacacaacacctctaaggccggttggctgcaccaagcccatcatgtcaacaaaatcagagagacgaatctacatgcaaatcagcctcgcttacacgattggcctattatgtcgccgttgttgggcgtctacgtcttcaccgccggcctgcctccgtctgccgccgactggtgtcctcgcctgcacggcaggcctattatgccgtcgttgttgggcgtctacgtcttcaccgccggcctgcctttgccgccgccgaccggtgtttccgcctgcaccgctggcctattatgccgccgttgttgggcgtctacgttttcaccgccggcctgcctttgccgccgccgaccggtgtttccgcctgcaccgctggcctattatgccgccgttgttgggcgtctacgtcttcaccgccggcctacctttgccaccgccgaccggtgtttccgcctgcaccgctggcctattatgccgccgttgttgggcgtctacgtcttcaccgccggcctgcctttgccgccgccgaccggtgtttccgcctgcacggctggcctattatgctgccgttggtgggcatcttcgctttcaccgccggcctgcctgtaacatcccggcctagggcttaataggattaatagaatactcatatcaacaagttgcaactttttttccggaagccaatctccaaagaactccagttgcaacttcttttccggaagccaatctccaaagaactccagggttaagcgtgctgggcctggagcaatttgggatgggtgaccgaccgggaacccgggtgcacatgagtgaggacaaagtgtgcagaaaagatatgtgttggtctgtgagggcagtctatgacctatgaaagctatcagatataagcgggcccggcctgggggaaggcgggacgttacaaaatggtatcagagccgactctcgcggtttcacgggcgcgtgtgtcgcagttgcgcaggcatggtgcgcatggctggtgtagacccggagtggttacacagcatggcacatgcgctggcactggacacatggacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgctgggcctggagcaatttgggatgggtgaccgaccgggaacccgggtgcacatgagtgaggacaaagtgtgcagaaaagatatgtgttggtctgtgagggcagtctatgacctatgaaagctatcagatataagcgggcccggcctgggggaaggcgggacgttatatgacctatgaaagctatcagatataagcgggcccggcctgggggaaggcgggacgttacactgcctttgccgccgccgaccggtgtttccgcctgcacggctggtcttttatgccgccgttggtgggcatcttcgctttcaccgtcgaccgcctcgttcgccgctgactggtgtcctcgtctgcacggcttatgaagccgttgttgggcgcctacgtcttcaccgccggccgcctcgtctaccgctgactggtgtcctcgcttgcacggctggcctattatgccgccgttgttgggcgtctacgtcttcaccgtcggcctgcctttgccgccgccgaccggtgtttccgcctgcacggctggcctattacgccgccgttggtgggcatcttcgctttcaccgtcgacaacctcgttcgccgctgactggtgtcctcgcctgcacagctagcctattatgccgccgttgttgggcgtctacgtcttcacctccggcctgcctccgtctgctgccgactggtgtcctcgcctgcacggctggcctattatgccgccgttgttgggcgtctacgtcatcacggccggcctgcctttgccgccgccgaccggtgtttccgcctgcaccgctggcctattatgccgctgttgttaggtgtctacgtctttcaccgccggcctgcctttgccgccgtcgaccggtgtttccccctgcacggctggcctattatgccaccgttggtgggcatcttcgctttcaccgtcgaccgcctcattcgccgctgactggtgtcctcgcctgcacggctggcctattatgaagccgttgttgggcgcctacgtcttcaccgaccggctgcctcgtccaccgccgactggtgtctccgcctgcacggctggcctattatgccaccgttgttgggtgtctacatcttcaccgccggctgccttcgtctccgccgactggtgtcaccgcctgcatggctagcctattatgccgctgttgttgggcgtctacgtcttcaccgaccggccgcctcgtccgccgccgactggtgtctccgcttgcacggctggcctattatgccgctgttgttgggcgtctacgacttcaccgctggcttgccttcgccaccgctgactggtgcttccgcctgcacggccagcctattatgccgccattgttgggcgtctacgacttcaccgccggcttgccttcgtccgccgccgactggtgtctccgcctgcacggctggcctattatgccgccgtcgttagacatctacatcttcaccgaccgaccacctcgtatgacgccaactggtgctatcgtcttcacggctggccacgtcgccgccaccgctaataggcgtcgttatcttcaacacaagttgtctgcgtctgctgccgactggtttcttcacttccatggctgcatgattatgatactattgattggccttatagtcttcaccgccagtcgtcttgtctactgattgactggtgtcctcgcctctacggctggtttataccgctaccactactgatggacgtcatcgtcttcattgctggctgccttgtctgacgccgactggtttgttcgcctccacagctacatgtcttcgtcaacattgactggtgtcatcgtcatcaccagtttgcctttgccgccgcccatggcgtcttcactttcatggctggcctattttgccgcggttaaagaacgtctttgttttcatcatcactctacttcttcgagcaacttcatctttattatcttcggcaccggcaaactctattgcctttacttcgcaagctttgctacttcgccgaccacgacgtctacaagagcctcaacatctcggcatgcgtcaacaagtataatgccgtgttattttactataacaagtggtgttccaatattcaagatttttactcggacatcttctatgcgtatcttcactcaagcaatgactactcgacgacaagaagctacaattctcgactctatgttcagttgtttctcaactaaccaaagagtcgggggctacacaaatacaagactctcaaaattcgacaagctttatgtcaagatgaagcaatcaatcaatcagccaacgagttctatggaatctacttcgggagtcatcagtttggtcttcacttcagagcagacgttctacttcagcaactcttattattacaccggcaattttggcttcttcacgccgccacaatctgctccaaatttttccaagtatcaaagtttgagattctatctacatgtccgggagtttagagttatcaaccaatcagctcagttttgatgagttggataacagtatttacttttcttcaagtgaagcatctgcaacagctacaactccaagttctactaccatctttacaaatcaaggggtgttgcatcaatcttcgttatgcacacatcaagaaaattacttgagctttgatatcttcttaacagtttgatggattattgtcactgacttcatcaccagcacctctacttcatcggccctgacatctctgtcgttgctaatggatgactacgtcttagcctccggttgcttccgtcattgctggcttgttatttcgccttcacggttgacctactatgcaaacgctgatgagcgtcttagtcattatcattggttgctacactgctattgactggattaccgacatcgtcatcttcatcaatatcctgtcaagcctcttcaacatagcctattctactgctgtttgatgggcaacttcgtcatcatagtcgatcatctttgttgctgctaatcattattactgtcggttgcgtttgtcgtcgccgactattttcttcatcttcatgattggtggatttcgtcatcgcctttgatgcgtgtctacatcttcaccctcggcttgctttcgtcaccaccgaccgatatcctcgccttcacggatgacttattatgtcaccgctaatgggcatcttcatcttcttcaccagctgcctcgtctgtcaccgactgattattttgctgccatggctatgcaactttatcgctgggcgccttcatattcattgctggctgacctgactgctatcgactagtttattcgcctccacggctgtgcaacttcatcacttttgattggtatcattatcttcactaccaccaatattttctatgctcaaagactggactatttattattccccgtaagggttatcaaccgaatacttacgccagtcgggattcaattattatatctatttgggagtatcccataagggataatcactcagatcataagctattcatatgagctacacttggtctatatcacccgaaagatttattactcgggagcatgttacatgcgtcatcctttaaaggatgtcgaaggcatattttttggcctaggcctaatatgtctgcagcccatattttcaggtgtgacctgtcacgttcttttagggacttaggcactttttgcttaggccaaagtgcgcgtgatcaagtgcccaataccttaaaatctttttataccatagttactcaactttttaggagttggtacaatgcattttaaaaggtgcccaacagtgaagttttttatagctaccccgctgacttttttatatagtcaaggcgctatttgggtttatcaagcaattgattggatacaatatcattgctttttgccacgtaagtgtgcatttttattgaccaatattatggcttaggctgattatatattgtggtcattttccaggcggttggtaaatccttatgagtttatttactcggatgttacaccacatatgccgtatatttccaggtgtggtgaaaccatgtgtcttttaaggacttaagcacatctgttaaagcagtgtgcgcatggtgtatgcccaatactttggaaatttctttattcactgcattcaagcttttttatagctgttttgctaagtgaattttcaatgatgtagtcaactttagattgctcgcatcaatttttacaaagcagtcggtatatcacttggatcatgttatttggggattcataccgcatatgctatatattgatatcaagtcacttggttaactataatgatcaaaaaccactcagttggttggattatttattccctgactgtatgcttggtttattcaattaaccacatagtcggggctacacctattaggtgcatctagtcgatgcacctgactttgtttttcagccctccacggtcttctgattcggtaaaagtactcgggagatcatagcgaagatgattgaagcactcggctttggaataatctagttcgtgagaagattatcttttcgactgcgaaggtcttaggggctactgtggagattatgggtaccccatacccacacggcatggttatccgactagttataggagataactcatatctatgaaatatgtaacatatcatgacttgggtattacgtttccttgtatattacggaacggtctaaagtcctggtttgataagattgtaaagtagatttagtaaaccgataccgtattggttaaggtttctatcttataatcctgccctccatcctatataaggtgggcaggaggccctctagggggcatgagcacatatgatcgtcagatctatactacacccggcggattcaaattcccaaacaggagtagggtattacctctcattgagagggcctcaacttgtctaaatccttgtctccgtatccatccacttttaggtctcgtgcactaccccttttattattgccgaattcatgtttcgacagttccagacttacattatatagctgacaatgttatgtgacgcatgagttgcacaatatatatatatctttaggctaaattgtactatgaatgttgttgagagttgtttcatgattgacttcgttagcggaacgccttggcattgcaatttactttaccttctcttagcgatcaagaaggcgcatgatagataggttaacactagtttccagaaccgaaaatcggacgatcatttaatcatgtcttttgctttagtaatggtttactaactcactgaaattttattagtaaactcttactaacactaacactaatgtgtcatgtgtgagtacatccctggaatcctgaatgaagaagcgtcggcttgcatcaaccagtgatctatctatcatcttcgttttgttgtcatcaagtttttagccatactgcttgtgtgatttaactacggtttattgactcggcataaatggattcctcatgaaagcattgttccctgaaaatttgccttcttttttatactggtcaggaaggcacgtttatctgctgagcgatattattttccaaaacctgataaacctaaaaaaactggcgacacatttagcaaatccgttgcaaaatactataaatcattaatcaggattcaaaatcttttacaaggaataaaaaaatctattgctaattactctgaataataatgtctttaactaataataaataaacaaggaaaaggctatacgtattaacattttcttactaaaactgacgtgtcacgctatgagtgtacgttgattttttataactttcatataactaaattaaatggttgagatgattgttaatactccctccttccataaatgtttgacaccgttgacttttttaaacatatttgaccattcgtcttgttcaaaaaattttgtgaaatatgtaaaactatatatatacataaaagtatatttaataatgaatcaaatgataggaaaataattaataattacttaaatttttttaataagacgaacggtcaaacatgtttaaaaaaatcaacggcgtcaagcattttgggatggagtaagaaaattattttgggatggagagagtaagaaaatttagtctgtgtagcagtgctaaattaaactagcctcgtagtcacgctttgcgtgacttttaatctgtttaagaacttttctatatggtctattagtttaggtaagctttgaagaaggctttgatataataagttaattttattttacaaagtattgatttccaagttgtactatatggttataataagagaaatcactagaaacctcatctttcttctctctttatccccactcatttttatcatgtgtctagaggaggtaacagaaacctccggaaatttccatatgtttagcccatttatgttttttttaatacatgtatccgtttgatccaatggctatagtttacccaaaccctttatctgatggctattatatttgtgatgatgtggcgcattctcgtgtaatatagcttgctgcttttactatatatactatataataagatggttgagatgattgttaataagaaaatttagtctgtgtagcagtgctcaataaatgaatgtatactgtgaaagccgtggaaggggacgttctccggcgacggctccggcggcttgtcctagtccttgatgagctccgccgtgcgctgagcatgttctccacgcccatcaagctggcctccagcctgagtatgtccgtctcctcctcgtcgctggactcgccgtctaatacttcctcttccttaccttgagcttcgccggcggcgtgcttggcgcagtactcgaccatctcagcgaggggtttggcggcggcgcagccgtcctcgatcagttgccgcaacaggctcgccgccctctccgccattgatgatatctccccgtcggagctcatcatcttgttgatatcttcttccgccattgatgacgacaactgtccagcgagctagcgaccggtttgcacggagaaatcaattaattgcatgaaaccgatctaatccgagtctaatttcaatgcgaactgttgcgatgaatccgtttctgaaacatgcacacgcgtgcagttgagtggatttgatctttcttttttttttgcggggagtggatttgatctgatcgagaggggtttatgtaaatcttatacgtttggggcatttgcaaacttgtccattgtttttcttaatctaacttaagactctggtttttatgatattttgcaagaatgctattcgaatgtagttttgcaataacaatttaaaactgtggtaaatttgtaattgccccaatatgtttatcaacccattaccggaacactaggcttctttctgcttcctgaaactccaaaattacagatcaaagttaccaatgtgattccgattcagaagtacatagaaaatatcccagtacaagaaaatctatttgtcctgcaagaaaatttggagcagcaccaaatcacaagacaaagtgcacaagcattacattagtgttccaaaccattgctgtgaagaagaacaaaagttccaaacccttacagaacgaaacattacctaccatcaccagtggaaaagcaacaactagttaactacacttgcatccagtgcagtcacaccctactatcagatggtaatgcagctaataactgaactacaaaacgactgcaagtgttaaactagacataaagaccaccatgaggatctcctagatttctaggccaagttgcacaagtctctgctctacatcacaagggggcaatttcagaagaagctaataagagcagagcactcgtgcgtgtgccaatcactggccgtctccgtctgaatagaacatgcttggatacacccagaaggcctgcagctgactgtaccagtttcttttgaacacaaggttatcatcagtggtaggatcccacacagcatctgcatcatcacccaacccatgaaggctccatggctgggagtagtgagcatagtacaagcagttgctcctccctccccagcgctccgggttcttgaaagcaaacggcgggcttctcgcatcacccccgataaagagtgcccagttctccagcttctttacctccacccattttgcaggcttggctgacatgtccaggcggtacggtctgtagttgactggtgctccaaatgacaaagttatgtagtggtcaacaatgagaagcatgccatcgcaaaccactagccatggtctcaaatatggacattcactcatgtcatcccaccacagggttttcatcttcttcaggcgaagcttgggggccaactgcaaagtgtacagcttgtattcaatcacggcgatgagctgaccattgaattccacaatctgatcgacccgattaacaggaagcttgagctcagaccaggagtcacttccaaccggccaatcgaacagagatgaccggttgctgataaggagatgtgagttgggtgacgtgataggagccgtcagagtgccacaaaagtagatctcctcatggtccttgctgaatggaagacgtggtggtgaaacctcagcaccggtgaacacatcaacaacgagacagtaaccactgcggcagcatatgagttgaccatgagaagagcctgcaaaaagcatcttctgcagagtttctcgaggaatctggcagcggagcggggtgtttcggttggctagatcaatgacctgacatgagcgtagtagcttgtgaggaccattgctggtagaagggatacaaggggatttgacgcggacattgggtcggacgaggagtggtgggagtaaggtgcgaaaggcagattttgatgggtatgatgagaaggcagcacgccaagaatggcaggtgccagcaaaggcgagaatgtcgacgaaggagcccaacagaggaacaatggagtgaagcagttcttcttggaacctttgcgcacagacgtggcagggggcattgagccagaggcatcagagatcttgctggggctttgcatgatggcagattgccgaactccctgcaacacataacgaatttgatcacaagttagaaggatgaaactgactaatctggaagcctgctagaatttcagctaccaaatacatgcagaagacatctaaggctctgttcgaaagagcaggttgggaacgtttggctctggcacgaaaaacggaacgatccattagcgcgtgattaattaagtattagctaatttttttttcaaaaatgaaacaatatgatttttttaaacaactttcgtataaaaactttttacaaaaaacgcatcaaaatagtagtttgaaaaacgtgcgcgcggaaatcgagaaggagaggttgagaaccatcacaaacgaactgagcctaaatcgtcattatacaatgggaaagaagatttcaattcaaccaggtgcatttttatgttcagggagatacaaatatacaatatcatagaggaaaagggctagtttttttctctaatcgaaatgttttcctgcatagtacagttttgagcttttctatggagcacttcagtactgtgtaatcaaataacgcgcataaaaatgatctgagtgtatttttgcgtactgattcctctctccatttgtacatcaatcaactcatgcttggcttccaaatttctattaaaaaaatcaacaccgctcatccaaagagtactatttttctattaaaaaaatcaaccccaaaagtagaagaggcacgttgatttacatgacacgattgataaacccacctaatcaaccatatcaatctagggttgttactttgttagcaagcacatctaacaacaaaaatccagtggaaattccaaccctagcgaacgcgcccgtttcttggttagggttggatgacacaagagatcgagaaatttatcaagaaaaaaaaaagaggaacagggtttaggcgcgagaaggcgggagggtagagagagcgcagaccttgtggaggaggtccgatctccggcgacggggaggacgacgatgccgccggcgacctctccggcgatgtcggtttgccctctctctccccttctcctgctcgtcttatggccttcaacgtgggccagtttggtctctccatgtgggccgaaaattatgggcccaactcaatatttgggccggactgcgaagttctacgggcctgcggattatttgggcctcccatgggccatggatcatggcctcgccgacgcatccatatccgccgcttcttcgcttcgcctcgcctcggaggctcggacgcgccgccgccggttgcccggtctcctcgccggccggcggatccggtgaagctacggattagtgagtggtaggagcagcagcggccatggacgggagccgccaggagatgccgccgccaacggagctgagcgctctcggccacaggtaatttggtttccgttcttgcttcaattttgcttagttttgtagatttctagttgattataggtatatagttccaagaagtttatggtacctgacattcttgtatggtagcatttgacactgaatcactgatggctgaagctgcgttggctgccaaaggaaccaaccagatctattaataaattattaatcaaatgcactatcttttttccagataaatagggtgtattgccgcatattcatactgtcaaaataaacattttcattaattttgggagggtggaatacgaagtaccattttgtcttattttgaagggaagggaggaaaaaaacaaaaataggtttggcacaatataaacagattattacaattgtggtattgttcaagatatcaaagctgtaggtggttctggcgtatattgttttggttggcatctaggacgttgatgcacatcttattctgggaatcgttagttcgttacagacttacagttcaatgaaatggtcagttttatttgcctcaatgtgtcataactcataagggtcactgtaatgactcaagaagctgtaggtgaagttactgctttatattgcttcactgaaacaacacagttggatcaatatcactccactctatctctcaatctttactagtaggaagtagtaattttatcttcgaatgttttctctgctccagtaatctctgaatttttctttgtttgacagggaagttgctgctgcagaaaggccctttaagaaaacctgccactcatcagtgcctacatcttctaccttgtgtgaaccccatgtttggccaggtctcctggaaagcctccttcaccaaatcattgctttgcttagctcattccaggacttgcttgcttttagtgccacctgccactcttggcgagctgcgctatcttcctttccatccgtatatactttcaacttcccacctctctgcctcaaactaaatacacctaatatccgtccccttcgcgtccttttgaaggacaatcttttatcttactgcaaatggcagcttgatgatccatccaagagaaacatatcccttcgttgttcagctccgccagatgctccaaatcgcatgcgctatttgggctgctcatatggatatctcatcttctcctatcatgagaagaactgcctctttgttgatgcttacactagcactaagctgaagtctcccaaactcaacttcatgggcgacagggatatctactacggcatccttacggctccacttaattcacccaactcacatctgatactttgttcgaggtcttccatattctattggcaggttggaacaaactcttggacaaagcacggttatggcggtgagcacattcttcagattgtgctcttcaaaggtgagatttttgcgatggatgttcttggcaggcttcacaccatgcaatttgcacctgagctcagcatacaggaagtagcggttctgcgacgagaagaaatggttacaggcccacgttctgggccatggctggtggcctgtggtgaaatgcttctcatggttgatttgtcaacagaccgcgaccaattgcctcgcacctttcaagtctttcgtcttgagttttctgctgaaacagttgagtgtgtgaagatggaaaggttggaaaatcaggctctctttgtcaaccttgatgggagggaccctacattctcttgcacgagccctgaaagatggggcggaaagagtaactggatttatgttgcgaaaccatctggagattctggtgaaccttggactgcggtcgagctcggtcagccagttcctagtagaatagaccgcgtcccagactttcaagtagacaacatgtgggtggtacccagtttgatttatgatgtcaaccaatgatgttctcatcaagttttagccagcgttgcacaagccatatccgtacttgctagtgtgatttaatggtttcttgacctgtggcatatgtatggattcttgtaagagtacactgaagttgtatctgtagtatgagaaatgcaggttcttgcatgtactgtgcagggttggtctatgttctgtgaccatgtgaatgctgccttaatattatattatcgttggttaatggttatgttgtgtgacgccggagggatgtcgctgagagttgtttcatgaatgattatgccctttttcttttacatactgatcaaggatcatgtccataaaatttctcctgatgttgctacaccagcctgctgagtgcagtgtactgaaacatatgttccctgcattactgaagcatcatatatatgcaaccaagacgattaattaaggtgaattagattgtttatgattgttctctggggaataatggccatgtctcagatatcttggcgccaaaacatgcacatgttaaattgaacaatattgcaaaaatgtaactaatcaaatcgattaggactcgagaacatttcaattacaaaagatactaccaataattaagcaaaagcataaacaaaaaaaatctattattactaattattattactacgcctaacaaattattatgatttactgtaaggcccacgcgttctccttgatgatctcctcctcctccggcgtgaagtcgttggcgatcttgaaggtgtccctgatctcctccggcgacttgcccctgatcagctccgccgttcgctggacggccagctccaggacaccctccacgcccatcaagttccccgccatcagcaggtggtacagcgtgtccgtgtccacgtcgatcaactcctcgtcgaacctcttcagctccgccgccgccgtgctgcggccttcgacggcggcgtgcttggtgcagtactcgatgatcttggagagggatgccggcgccgccgtcggcgcagccgtcctcgatcatgtggaggagagtatccgcgacatgctcgccgccgcctccgtcatctcgaaggtctccccgtcggagctcatcaccttgatcatcttcttcttcttcttctcttctgccgccgccatagatgacattaactgtcaagcaagctagcaaccgatttgcacggagaaattgttcgaaagtcctactgagctattgatcgctagcggcgatcgttttttttttcttttcctcttttattaagtttatacacctaaattttacacatctaaagtttgtatagcgaatatttataagtcaaaagtttatatatccaattaaaatttgaatttgaattcaatatttttatatataatatttctatacataaatttttctaactttatttttttaaaaaaatttatggtgtagtagaaagagaagaaggggaggcgagctcgccgccccaaccgccgagcgctgccgccgccgcagctgactcgacgccactccgccccaaccgccgagcgccaccaccccgccgagtgccggcggcgccactgtgcgcccccgccgccccaactcgacggccccactgcacgatctgtggcgctgtggctacacaaacatcactgtgttagtagctttgcatgcatcgctagatgctaccatgccgatgaatcttgtcactcactcaccatgctgctgctaaagctaaaaagcttagctagctatggaacatggaaaacatggcatgttcttgtgaaggattactacgtttccatgccatgtgctgcctaatagctggggcggctggaggtgctgccgcacagtgccggcgggggtggtggggcggcgctcggtggtggcgcagggcagcgggtcggtggtgacgcgacgccgaagaagcgcgtggcggcggcggtggcgctacgcctggagggagcgaatcgatccagacccagagtatctttctttgatctgacaggtgggcccaggggtaaaaatgtccacaaatcttgaaaatatatacaaataaaattaagaaaagaaaattacagtaaagatagataaaaagatagataaaagtggtaccaaataaactaattagcagtcctaatgacatattataaagggcatacggattgggtggtaaaaaaattgaggcacgcgaatttgatggtaaatagtctaaattctcgaggggatcgatcgcccattagccgtccccgaaattgttattgaagaagctgatcgatcgatcgatctcagacctggattaattgccaatgatcagtaggtgatctgtgcttatctatttatttgcatgaattgaatcgaatcgaatccgagtctaatatctcaactgctattccgaaacgattgctttgcttgttaaatcgaaacggaatccaaatgtacgttaagatgaattcgtttccttgtgtaaattcgaagagaagaatgggtgtttcttcataaatctggatcgcttatcaccttgttaatttgttaccgactcaactgcgaccgtcagatgagaggcgtgcggttcggattggagcgcaaagaactgaagaaaaaaatctaccctcttctcggccgccttattatttatccaaaaatgctaatctctgatacattcggttggtgaagagggccagattatttaatttctttatctaaaatgcttaatatctgatcaaacttccacacgcgccagggaagatcttcttggggtttataatgttggaaatatctttcagtaaattaccattcaatttaatccaataataaataatgtataaaccatgatgattataacatagaccattggcaaattgctcttgatactaatagagataaacaaaatagacatacaacagttgtaaaccatagaaacaagcatgtccagctcatttcccccataaaaatagaatcatcagacaagaacagaataaaatagcacatagtgatacagctttagttgcggaacagaagcacagttgccagaagcaaaaaaacatttgcatttttgtcagcgtagtgaaagaaaggcagcgacttatatggatatttattactgaagcataataatgccttataatggaaccaagacgatttattagaactgaattccctctagtagttcctacagagacaattaagtgtattagattttttttccttatactccctccgtttcgaaatgtttgacgccgttgactttttaagcacatgttttatcgttcgtcttattaaaaaatttaagtaattattaattcttttcctatcatttgatttattgctaaatatatttttatgtaggcatataattttacatatttcacaaaagtttttgaataagacgaacggtcaaatatgtgttaaaaagtcaacaatgtcaaatatttcaaaacggagggagtatatgtgattgttctatgggggatatataatggccatatattgatatcttggcgccaaaaacatcaagagctacatttcccatcggatacgggtagtggtgttcccacgttcgattacccggggtcacatgactccgaataatttattcaatcctaactaaaataatttattcgatcggcaccgtaaaatatcgatacgaaggcgaagaagctgtccgatctctataacctatgttaatttggtgattgattgccgatcagatgctacgtgcgcatccttttttttccatgaattcaatcgaatatcgagtctaagtacattgcaaatacaaattaggacaaggtaattaagcaatggcaatgcatgcgagtgataaattgcacaaaatcaattactaattacttctgaataataactactaactccatcccaaaatacttgtccctttaagtttttttttaacttttgatgattcgtcttattcaaaaaattatagaattattatctattttatttgtgattttctttattatcaaaagcactttaagtatggcttattttttttatatatttgcaccaatttttcaaataagacaaatggtcaaatgtcgcaagaaaaaagtcaaagcgaccattattttgggacggaggtattaactctactatagtttgtgaattgtatgatgtactgccttcatcctaaaatataataatgttggctataaatttgaacaaatacatgtctaaattcataattataaatatttatattttaggatgaagagtgtagtaatacgtagttagtaagtactactaaaaggcagggttcaatcttttgttttcggcgtttctagcaaagggtgtctatataccgaaatttccaaaagttcgaacaaaatttggtcaaatttgaataaaatattaccaaatctctactattataaaaattgaaaatgtttttgccaatattttagtacgtcatccgtgtttgagtcggttttcaaattcgttcacttttgaaaatacatatttgtgtttgagtcggattttaaacttgtttgcttttgaaaatataaaaggagtcgtataagaaatattttttaaaaaaatttacatactaacttgagattaatgtcagactcctaatgattaatgtcagactcctaattacagctcatgattttctaaaaaaaatatccaagcgaatttccacagtgaatttcacgctagccaaaccataacaataataagattaaaatatcattcacctgttgtaacgcacggacatcttttttagtacataaagagaaagaaaaaaaattaaaatttcggccgaaataatatcatatcggaggggtcccctccgataaaactggaatttcgttccacaattttaaaccctgatagcctagaaggcccattcatactccttgcggatctgctcctcctcctccggcgtgtggtcgttcttgatcccgaacatctccctgatctgctccggcgacttgcccttgatcagctccgccgtgcgctgcgccgccaggctgagaaggccctccacgcccatgaagttggccgccatgatcaggtcgtacagcatgtcgatgcccacctccatgaactccacgtcgaacttcttcagctcctccttcgccttgcggctgctgctgctaccttcggcggcggcgatggcgtgcttggtgcagtactcgatgaccttggcgagggcgctgccggcgacgttggggagagtgatcccggcgccgccgtcgccggtgcagccgtcctcgatcatgtggaggagtatccgcgacatgctcgccgccgcctccgtcatctcgaaggcctccccgtcggagctgatcaccttgatcatcttcttgttcttctcttctgccgccgccgccattgatgatgtcacgcgagctgatagatgtctaaattgatcgacggcgaattctgaagctgatcgatctctgagacgacccacgtttggtgattgattgccgatcaggtgccatgagctcatatatttattgcatgatgaattgaattgaatccggatctaatttgaactgttattccgaaccgattgcttccttgttaattcgaaacggaatccaactgttaagttgaattcgtttcttaaactttgcgtgcagttcagtggaggtttccttatgtaaattcgaacgggaacaggggtgtttatgcataaatccactatcaaaccgggagttggtctatttttttaaaagtccctacaattatctcctattgtattgtttagtcgcgcaaggggaacccccgccttcttggatctccggcgacgagcagcctccgtcgctgccttctccggccatgtctgcatatgcatcctgcatccacgatgacgtaagccggccacctgatcgagcagtatgacgaatgcagatgtgcagtggaaaaatatatttctgacgagcatatgacattcaggtgtgtgttcatcagtgggtattcctttttttaatttcgacagatttgaaattcaggcactcaggtacctacctatctcgtgagatacagttatcgaatttaatttccacgggccatgatattgtttatgcatgcagtttgggttagggattattttgttgatatttttagtctcgatttcactattagttatctccaactctacatgctccttctgaattatcatatggcctaaataaaattcatgacttatgcatctctgatcaaattttcagacgcattagggaagaatatatacgctaggagatcttctctgggggtttatgctatctatgggtcatcagttcacatatctgaaacccatttccagtgaaaattcttgcaatggtatgtcacactgatcatgtatataaatgcagaatgtataggtgctctgctgctccttgtacttatctgagcttcagttgttttacaatttagattacaagagaaaagattgtctagtaaaagatttcttattgaaatttacaagacaaatcgttggcagcagagtagaccactggtgcagcctagccagtttctggttattccatctgggctatttggctacatgggctgggcctaaagctcatatgtgttggttatgttgggctgggccaaaagatctatgtttgtagcatctgtagttatcaggcttcaagtagcagacaattctcctgtcctgtgtccatcctctcactttcagcttcttttttaaaataaaaaaaatcacaaacaaatcactgagcacttgtgctagtcttctaaattaacccactatgatggctgtcctgtcctttttattggcagtaatcaatagtacatgcatatccactctacaatagacaagttcgtctcttttactaactatttttaatctcaccatccagacagcttcataaagctaatcatttgatgttcaccacctgttcttgcaagcccaactaaaatttgctacagtattacctgtaaccaacatgacctcaaaatgatggttcactatcaatgtttacagttcatgtggacaaaaaaatctcactgagagaaaaaaaggtattcttgcagccaaacatgtgtggtttctcagaccaaccacatgcctagttcatcagcaagatttttttcgaaggcatgcttttaaaaaagatcactccaattatacatccaaagtaaaatgtactccgtaagaatctacaactcttatcttcttttacatgtagatgtgatcactttgatcccttttttgggtcaaaaatggcttgatgctcacctagttgccaatatggaaaaccaaacggcacacctagccggccagttgctgtttaacaatgactggaataaagctcatcagcatcatcttttgtcctctcttttttttttaccttttaatttctctccagcatgccccatcatttggagccctgtgaggcctcaacatcttgatgatgttgcaacatttgcatcaagtgagaaaaaaaaaagagaaatgacaaacagggcaagtgttcatatggaacaagactagacttgagactttgaagataaccttgtggccttctttggctttggtgtgccaagaaatcaacactggcccagcggttgtacttccagacccagccagctgaatgtgaccatcagatgcagcttctatgtcgtcatgagttggacaagttttgatttttttcatggaaaagattgagagtattgaccaaattgtatgtagatatgtacgccgggtccaaattcaagtctagcctgcacccggatttttcatcgtatttgactaccactagatggaaatggagggtgccgcttttatgttttggggtcaaccggttctagaactgaattaaatattatgtgacaaggtttggagataccatgtacgaaaagagtatgggtaactaaatggtttgtcgtcttgcaggagctatttttttcgattacatggaagacgcatcatgcaagggcctttttatggttcttgtgagtgtgcactcagatggtaagtaagatcagtgaatcccaaaaaccctggctaccttcaaattgataacatggaaaaagtacagatcataatgaacaaaatatataggtgaaatccagtaagaaaaacacacacacatattcctaaatgacaagttgacaacacgacagggagatcgctgttgtgtcaaaaagagagagttgaacggtggtgaaaaaaaaagagagaaagaaaatgatatatttgcagtgagaatcgtggtctctgagtctccacacatgcacacacaagagtagactttgcatcgctcacaggaaaaccgaaaatgatgtgaggaggagcagatgagacggattggagtttggaagatgcgaaaggatcacataatttcatacctagacgtttaaaagacttttatgtgcacttgtcacctcaactttaattttctttctttttctcttttcttatctagattgcagagagatggctggctgctgcttacataatctattttggctgaaataaatggatttgttgccatgtccttttttttcttcatgatacctgcacttctagatggaagatgtcatgtgtaagttctcttactgttcacactgaaagctactgcatgagaaagttttttttgtaacctccaatcaccttcaaaataataatcatgtcgcacataggaaaagtttataaactattgtcctacaacaactatagtttggacagaaaaaaagtacgtttttttttaatttttgcaaaacccatcaaaggattgctaggcattaatttgagctaatacaagttagtagaacagtaaaataaatgaagatatgttaatcatttctacagtacctctgaattcttaggacatactcatgttgctgtttactgctcctacaccaactttggcactaaaaggaagaaggattagggattaggaattcgtggcctggtgtgatgtcaaccaatatgtctaacattatccagccattgttggctgtcatgggtacacaaatcttatgcatcaagtgacaacagatttcagttagtgctcaggataggtgtcctatgtgacttcaaatctaggctttttgggcactttgcattcacatgacttgttcttgactccacacctgaaagttgaaaccaccacaatctaattcaacagttaatctgatttttttttacaaaaacaatataatagtttgtatggacaaatctgaatatcatcctggtcttcagagatttgcagggtcgccccaatttcagcgacaggtaaacgctggaggattgaggaatgagttcatcttcctccttcaccttttgtgctggtttttgtttcttttttccgccgttcaaaaagagttggcgcgctcgctttgactgttctgtcctttaatttgctttcttgtttcttattttcttttgttcgtgttggtgatgactttgcagtactagtatcagtttagtttggattgattaatcaaaaggacatcataaagcaatctgagcatggctggccttttgaatcagagcagctctagaacttttgctctcaaggtcaggtgtgagcttacttgttaaaactgtccttaaccaattgtattattattatcacttactttttttttcttaccctctgaaatctgaccatgatctgaaactatcttttttagataataatatcatgatctgaaactgttggccagagcattgacaaacaggagaatttggcctcagctgatgctgctgctgatcaactgaaacttgttcttaaactacaattctgaactgaacctgatgcaggaaggaatcttgccggctcaagtttcgtcattcttcctgaaagaaacaacaaagcaagcagggcttaatgcagataagagaacacgcaggctttggttgggttagaggcatcttgattagttataatctgatgtatgaatgactccaaaacatcagtttgttgtctagtgcagaaattgcgctggtcaactccttaatttcatatctttaccttccaaccggcgatcagagaacggctattatcaacttgcattagttaacactgactagtaataacctatggtgattaagcttgtaaacaagaatgcaatggagtaaagtaatgaggatggcaggtgaagaagagaagaggccagagggatggattaagcaagaaaagacgaggtgattgaatgattaaaacaagaagaagacaggcaattgccggcatgtagttcagtgttgttgcctgcaacggtagcttttcccgccttttaagcgacgtttactgctactacagctcactctacagtattagtatctatacgtgagtgacctgtggtaaattcagcgtaacggctataacaagcaatagcagataaaacggtaaaaggacaattgcttgttatagaaagccggatacgaagtgtctgatcggttgagcacttaagcagttaagctaggctggtatgtcatagaaaaacaaacaaagatattaaaaataatttatagataaagcttttatatttatattcgtggtttaaaagtcaatgctaaaaaaataaactacggtgaaatacaataaatcaaaattaagtttaaaaattctttggtcactttgattttagaaggcaatgccattaaattcaaatacattttagaaattgacatcatcaaaagatctttatttctgaaggcgttgttccaaagtatagcatataatcccgatattctcttcatgattgtaatagagcaaaatatcgctagacaacatgacatgttcatgttacctactacggtttttcatctttctttcacttttatttttactgcatgtgtgcatccttgatgagttgatgtaaaggtgtaggatgtttttattgactaatgaaacaatccattatctataagaaaatgatttatgtacatctcaatttaagtcatggttataaatacttaatcccaccatattaatataagtgcaaccttgtatattactgctctgttaaaaaaaaaaacctaatcctatagtccgttgtatattaatattggaatgtgggggagtagtacgtttttaggcatcgacgtgaagtacggattatgtacttcggagtgttagacgggcggtttgatggagtgatgtagaaacaggagaaaaacgtttgggacgggatagcaaagcgtagggcaagtgccagcgtggaggtcaaagtcaaagagactttgcttgaatagccgtgctggcaacggtatgaaagaagagctccccttgtctgtttcttctcaacttgcaagaaaattcttacagtaaagactgcacaagtgaagaggatggcacaagtgaagtgcaggagatgacactggggccctgcacctgcactgcacatgtgcaatcatcatactacatgctctccttctccctctttctctttctgaatttcttctaatttctctgtttcatagtaacaattctcaaaatttaacttatcattgttttagttcgactactcttgttttataaataaatctacaagtaatattagtaaagtatgttacacggtaaatttaaatatattagtcccatccaacttgatcgaacggtttaaaagatatcagtggtcaattaaaccatttgtttgttagttagttagttaatattgccaagcactattatgaaatggagtcagtagaaaaaaacactactccattggaaaataactcatggccattttattctttttttcaaagaaaataataaagaacttagggtgatattttaaaaacaagaatactccattcttgaggtgatgagaggaaaacaagcaatggtgtgcaacccacagaaatcatgggttacctactactggccactggcagggccagggcaggcacattaggaaacaggggctcatcatcatgcccaacccatgctgcttgcctccctgtctccctgcctctaaatatgtcatgccaacaccacataaatatctactccttgagtaggttaaccaaccttaccatcataaactagtataattattctcaactcaacaagtggtccatcaacacatggctaaccatgtttcttctgtaaagctaatgcttgactactttgttttaagttgaagtgacaattaatatgagttttagtccaaggctttgtttggaacttagaaattttcaagcatgatttcagcttcgaataatacaaattctttgtatatatctttactttacttgtagttagtacatatgtagccgggtgtatatatgtaaaaagattaaattcaaattctattttcaaaaaaaaaacaaatcctgataataggggggaagatcaacttgcctccctggcttatagtttagtctttgccatcaataattgttttattgggtaggaaaaagtcacagttatggacccccaaaatcacaattaatcttctctaatacgcccccataaactttgctcttcacgcatccaaagtctaccactaaataaaattataaaaatgcatggatgatttcatggccactcaagcatctagagcttgcacaatagtccactttattgatggcttttggactatggaattggcacaaattgtcaaatagagtattttcataagcaacttttggactatatatgaactcccataaatcatagtgtacttttttttctaaattctccaaatgatctgtccaaatagtaattaattaaccgagttgaccatcacacccttcatgcgcaatgagaataatgaagtcattagtagtagtactggtagtatattaatgcagccgacgagactaattactcatgacccgatgtgtacgtcgagacggcttgatatggacggctccgtaaacctcattgtacgtatgcttcttgacctaatcaccattatttaaatttttctctttttttgttgttgtttttattgttaattctgccgtagatggactgcaacttgagctaaattgcagtcccatttggttgttgatttggataagtcgtctcctggtttgtgatgtgtttctgctgttgatgtcttgatgaggtgagagattctttgagcaggtacattttctttaattgcaagaggtagaagaacacaacacaaaaacaaactcttttatgattttagagaaaaaataatacaaactatttaatgtacaaagctgatttcatcccaacaaactctgaaagagaaattaaggcttcattttgccatgaggttgttctcttaaacccttcattaacctgtcatgcaaaggggatgtgtcaggtgatcatcattcgtaatgcacatagaaaaaattatccagagcttttaagtaagaactagtaactgcttgtgttcaactatttgtgctgatgtttacactaaacaaatggttggaagtacaatgttttgtgcaatgatcagctgataaagtcagaaggattacatcacatttgtctggaaataagcccggatgcatccttcgacaaaggtatggagggtatcctcaagggttcgacagtttacaacggctactgcaaaccttatcatttggcagaaaagtcattaggatggcatcacaaatgatgccaaaatccatgtgtctctaacagttgataatatctatattttcatccgaacaacaaaatagctaaaatttatggataatccgactcctgtgatagctatttgaggatatgaagtaatgaattagctagttgcaaagttggaaagttgctttagaaaaatattctaaaaaaattatatagaaaattttacacaaaacatgacgtttaagagcttgggaaacgtgcaaataaaaattcagaatagagatttactgaaaaagaaaaaaatacataggatgatataattactgaaaaagaaaaaatacataggatgatataacatgacctatccagcatacctagcataagtttttttttttatgttttatttgatatagagaaattatatagggattttatgttttcttgtaaattcttgctcttgcgttctaaaagagcccttatccaggtttcaagaacacgaaatcagtttaagcctcagtgctctttcagtttaaccctaaaccctaaccctaaagaacctgctgggcaaagttgaaaattcaaaggtaacttcaaatagagtacagggaaaaaaaataatagaatttgacccggaataacaatgttgcctggtacaccggtcagtttccagctcccggacttatttttaataattcttgttttgacaggaaatagtgacaatagtatcttgcatttcaccctccagaaatcaggtgacaagattgcgcaaatttgtttgcacaatgcaatagaaatattatataagggttttatttcactttgacaatcacattttcaacagaaaagcaaccacgaagcatgactgccagagagaatttcggtggcgatgaacaaagaaccatatcatcagttacaattgtcttccaagcaaagaataacacattaacaactagcacacttcctctaccactatgtcatcatcatcatgcatccaaggggggcaaagcaccgaattaacagtgtcactgaaacatgaacaagaaagaaacaagaaagaagaacaaatccctctcacaaacacaacctccacagcaattttccaatctttccttcccacaagcccatttaatcatcatcataccctcccccttccctcgccggaatcggcaaccgcactcatgccttcccctttctccatgcccagcctcttctcgtcttccattcccttcagatgcccagcagccttcagcgccccgatgttgctcacattaccaaagatcagaacaatgatgccgaggaagctgcctaggaacgcagcagcaaacgatcctccagcacgcccaggcccagcggatgcagcagcgaagccaatcatagcaccaatgcagcgtacaaatgcataccacaccgcaaaagcaccctccttccctggtggcgaggcatcgagcagcagaatgcgaccaaatgagtacagcacaccattggctgtgctctggacaagagcgatcacaatgatgtgagcggctctccacctgtggctcttgaagtagaaaccagcaccagacacaaataggcagatgatgaacccaagcagctgcatgcgaacagcatcagcacggatgatgatctggattgggtgcagcagcggaagtgagatcaacgggaacaggaagtagagtatccagagcacgagcacaaggactggcttgatgcaaacaccaccaatagcatacaatgtgccactggtgaagatgcacattgtggcgaaagatgaaaggaacactgcaaccaagcttccgatggcctgtgggtatcgcacaagggtcatgctgtagctgagcttggtgaagaagttaggctcaaatgctgtggtgggcgatgagctgctgggtcggtttgtgaagagaccatggcagataccaatgaaccagataaggccactgaagatggagacgacccaaaggcctgtgagctggtcagtgcgccgaagcatgtggtacatgaaagcagccatgagcgcagccccaatgccaccaatggcagtgcaatacagggtgagctgactggcagcagcacgacggcgaaggacaaggtgcttgccagagtcatgtgctgcaaggccacggatcatgagtccaagattgcgtgtatgcacagcctcagcaacaatgatggatgcaccaatgaacaggatgtagaagaggaacacccagactgtcttgaagaagccagtgaggaggcagaagaatgagccaaacgatgtcgcggcaatgaggatgagcgactgatactggccacggtcaaggtggtgtgcagcctgggtgaggatcggagccgcaatgaggattccaatcgcccatgataggccactccagcccaacggggacagccgggatccatcaatggcaatcgaatgcttggtcagcctctggtacctgccaacatttcacaaacttggtgtgaccatgatggtttggttgcatcacatgaacatgtacaggtaaacattgcatgctatgaaatttatgcagtaaaagcttccagggtgtacaaacaatgcgtgaacataaactgcaagaagcacatgcattgcctgctgaaagtcaccgtgctagaattccaggggttcataccagattaacccgttaaaagatggtaacttttgtgtgttgaggtgtcaacgttgacacatttaagtagcatcaacaatctcccttgcaatcaagggcagttagttggcctgatgcaatttaagcatgccatactgtggtgcacctaccagttggctggtcatgcggctagccctcaacagcatttggggttaaaggcaaaattgcaacggtttaggggcctcttttcctgttcaaaagagaaaaaaataaaagggagggaggagggcaggccaaagagaataggcaaaagcatggccctgcttttgcgcactctttttcttggttctatcaaaagtgagacaaaagcaatgtaaccctcagctacacaaactagatctatcagccaaggaaatgagctactaccatctccaggggtatatggcactgcatggatcacaaaagaaattttgcagtactactagtagttgaaatgaaatatggctagttatctgaagcatggaagcaagtttcacaggccatatttaatgagacacacaggcctcggcttggggtacctcataaatttcatacttatggcttccactgtccattcagtactacattttcgatctcaccacctaatgtttctcaacgttcggaagatttttaaaacaaatttacaaaggcacccctagggatttcttgtttgaccttatcctcctcccaagaaatcttgtctctcacagtcacaagagcacagctagtagtagtacaacaaaaagaaactgacaaaaaaagatgcagttcattacgtgtctaggtagagaaaatctcaggaaaaacgaaaatatattaataaaagagaaatgtgggatgtgggaaatagcctcactgaacaatatctaggaccaaacagtagcatcttttggagctttgcacaagaatctcttatctgctaataatggagagcaaagaaacatggaatctcaggaatcacgggctatttctttttaggattttgcatatacgccacatataaagtgcagcccggaaaaatccaatctttgaagtactatacaccagtttattttcacatttggggtaccttgaagatgtgtgggtaaaagaggttaaaaaaaggtggagtagagaactacgagtacagatcacaagatgaaggacgatgtaaagttaaaacgagctcaaaactttcaaaccaagaacaagagcagagaagagactagcaagaaaactacagagaaaaaagagtaagtttttttttcctaagtgcactatgcctgttcgtttgatgtacaaaacaagaagcatattttaggaagacatcaggtggaaacttcaaaaagcggagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32129 - DNA, 984 bp, Oryza sativa
ggtggcataataggccggccgtgcaggcggaagcaccagtcggcggtggcgaaggcaagccggcggtgaagtcgtagacgcccaacaacaacggaataataggccagccgtgcaggcggagacaccagtcggcgacggacgaggcggccggtcggtgaagacgtagacgcccaacaacagcggcataataggccagccgtgcaggcggtgacaccagtcggcggagacgaaggcaagccggtggtgaagatgtagacacccaacaacggtggcataataggccggccgtgcaggcggaagcaccggtcggcagtggtgaaggcaagccggcggtgaagtcgtagacgcccaacaacagcggcataataggccagccgtgcaggcggagacaccagtcggcgacggacgaggcggccggtcggtgaagacgtagacgcccaacaacagcggcataataggccagccgtgcaggcggtgacaccagtcggcggagacgaaggcaagccggcggtgaagatgtagacacccaacaacggtggcataataggccggccgtgcaggcggaagcaccggtcggcggtggcgaaggcaagccagcggtgaagtcgtagacgcccaacaacagcggcataataggccagccgtgcaagcggagacaccagtcggcggcggacgaggcggccggtcggtgaagacgtagacgcccaacaacagcggcataataggctagccatgcaggcggtgacaccagtcggcggagacgaaggcagccggcggtgaagatgtagacacccaacaacggtggcataataggccagccgtgcaggcggagacaccagtcggcggtggacgaggcagccggtcggtgaagacgtaggcgcccaacaacggcttcataataggccagccgtgcaggcgaggacaccagtcagcggcgaatgaggcggtcgacggtgaaagcgaagatgcccaccaacggtggca

SEQ ID NO: 32130 - DNA, 7734 bp, Oryza sativa
aaattttgaacagagaaaacatgctacgtattactctgtaggaagtacacaccatagagggtttgaggtgaaaaaacaaaattctttacatataaaggtacatgccagttctaatcttaaattaaccctagaaaaaacctgaaagataagaagcctaattctagcatgcatattctcaagtgataaaatccatggcaaaatgatgcaaccatgtatgcctagaccacactcaatgaacttgaggaaaaaataagtatccaaaaaatttcaatcacaagaatagtctctaaaaggtgaatttaaactaaaaaaatctgcacataattatagagctaaaggaagtgttaaactcgttggagtgcattaaaccatattcacgaaggtgttgtttgtatagataatttaaagcaagaagtaactaaagtaagaaaatatatctcagctacaatgataagtgataatttgaagtattcagagctaggattacttgaagatactctcttgattcaacgagtagaaagaataaatgccaaactctagcataagtttttgtatattctaatcttgtagttctctcatgtaaatattgttctttatatatatattaatataggacagaaggagtttctcctgctgtttttggtcaaaaaaaaagggatatagtaacttgtatatgccttccagtaaaggtaacaacttgtaaattgtaacttgtatatgccggcagtagtaatatataaatatgttctcaaatagaatgaatagggcaagaaacatggtgatgcatcaattattttgacctttcaaatacaacctgtaagggtatcattcaatacatagaagtccacaaatttggtaaaccagagagcatcagttagatagcatgcacatggatctcacctctaaacctaagaacatttacaattcctgaaacaaatgaagaaaaatgtttctcgccttaagtggagatgatcagcgacatacttgtcccatactttacccagcttctacgctgaaatgcttcaagttatttaacccaaaaaaactatgagcatgccatgtggcttgtcaattactgattttaataggcgacactccgtagaaggcattgaaaagggcaggtaaagccatataatcaggatagaagtacataccaaatatgcatgtgttagcagatttcatgtggaacaattgccatcatatcttgtctgaaagcaaataaaatatgatgcagtgaaattcatcaccagccactgctaaggaaaaccaacaatttctataaaattacaaaaagaagttggtattgattaatcctttcctgttctcagaaagagtattgattaatcctttcttgttctcggaaacatgccattgactaataagaaaccatgataatggttatttccttgtaatatacaaagtggtagcattttatgacaaaattacagaaatacaaaaggcacaatttttgtgtgagaaggaatgataataattggggacatacaagaaaacattattatctggttaacagaaagaaactgtaacaaggatgatggacctataaatatatgcagtgtatgtatcataccttgaactgtagatgaatactcacaaggataccataccaatttacgtaagtccaaatctataatctgtcaccagtgatatatattcatttttcagaagcgctgtagaacatcataaaagagaattgttattaatatgaggaggacacgaagagtagaactttcatgtgaaatcgacaaatcgtggcacggaagatccattacaaattaatcttaacacttcgcacatgacgcctgtatactgactcaaaggctcaaagcacactgctaccaatgcaagaactctctaggattcctaatcacgtattatacatcgtttagataaaagcaacatgataaggtacatcgattactcattaacacagcacattacaaatagcatgtactgacttgatgtaacctgtatgattaatacttttttttgttttcataggtcaactggatggttccacttcctaaatcccttttgtaataaacaggatgaaatagtaagacatctcattccactttcatatataaacctttttgcattgctcaattaaattatatagctttgccacctctgtatataatactactttatacagcccttttgctttacacccctgtataaactgtacatctacataatgtgcatttctctatgtaaccgtacttacagtatagcctttctagcttctacagctctggcatgactatttccatatataacttatggtactatggaagaactatgtattgcactactcaatccccttaaatgaccttttttatttgtactaaatacttgaatttgaatactacatagagcaaattgtgtttgttgtacaattcttttattataggaaacccatacaatatatccacataattaggttacttgtgtttataatccttcaccatgtaatccaactcaactatgtgaaatttattttatttcatatcgcactgtaatacaatccaaacatatataaacatgtatagtacgaatcaagcgaattcgatagaaccaaatttagtccataaatgcagttataatacctcacaattgtcttgtgcagctgctttttgcaacaattttctcagaggaaacactgcatcctgaccaaactctatttttcttcgcccaatcaaccaaaccttagtgtcatgttaccactgtgaatgttgtactgcctccgtctgcatcaccactgagaatctcgcctgcacgcagaggtcatgttttctattttctgcaagtatagttctatcaactattacaccagttcttgaactgtcaaataagataaaagctgaaaaaatttcagatcgggtgagctcaggcttttgtcgttctatattgcggaataataatggtaaattggaaatggtttatggtttattcttgtaaaagaaactctccctttactattgtccataacagattccccaaagtacatgttttccttgtactatctttctcacctgttgtaacataggaaaacaatatcagctaacattttttttcatgtggcaacaaatacggccgtgaaaaataatgcaaaccttgaggaagcagcggcgatggcaatttccgtaggcgggatgctagtatctccttccccaagagcatgggactatggtgacatgagcttgctctattgctgccagggctggagggaagataaagacagtcaacgaggagaagtggttggctggacgcttttctcgttcacctatgcacatcagcaaagtaaagaacaaagaattcacctatgcacatcagcaaagtaaagaacaaagaaaaaggggaaaaaatcaaggaaggcagaggattgagaagccgagaacgaaccagagactcaccggagtgattcaaatcttgcagtcgcgtgtgggaacgtatgaggaggcatgcagcaccagacaagggcgtcactggggcgacccgattctaggacagtgtgatgacaggcttgccttgtgagtaagccatctagatcgatcgtagcgccagttaaccgagcttctccccgttgaggtcgatcgtatcatcaccggatcgagcaccttaccacctcgaacgccccggaagatgttggggagggaggcaatgctcgacgacggcagcggctcgtgtatcgcaagagcagaagatagagggacgtggcgaagggatgctggtggcatgggcaaggatttcgccccactgctccatcaccaccatcccctccatcatccgtcaaaccaccggattggccggccatgaacttgccgccataagatgcgacggccttgagggcttggccatcggatccagcttctccaacggcggcgagcaaccacatggcgcggcggcggcggcggaggcggcgacgcgaggggaaggcggaggcggcgacgcgaggggaaggcggaggtggatatggacgcggcggctcgaggcgacagggacgacgatggcgacggcgcgaggcggaggtggcgtcgcgaggggcaggcggaggcggcggcgacgggagagaaagaggatgagacgagagggaggaggggacgcgtgccgcggcggcggaggtggacgtggccgttgcggcggaggtagacgcgctcgcgtcggcgagaggggaaggcggagacggaggcggcggcgcgtggcggcgacggtgggagatggggagggagagacgagagggagaagagaagggggcggcggcgtctagggtttggttaagtgggtggcattttgcgaaaaagcccctatacttccactttttacagcgcactcctaatccgcaatttttccctccttcacatgcaatatccagttttttaaagggcctccaaataaaaaatcgcctcagagcgactttcatgaggaacctactccgaattatggacaaatctaagggctttttttgcaaaaaatacacccgagcactgtagtactgtagcaaatcgctgacgtggacacgccgagcggccgcccagcccgccgctcttaatgatttttaatggtaaagagatgcctttaggaaaatatctattggggccacgtatcaacttctgcataaaacaacaagaaaattgctaactggcaagccgataggatgtggagggcctcggtggtttgtccaactttggctcaatctctatacagttcaagttgctaatcgtatgtccaaccctcgaagaatatgtatttccaacgatgccgatgaaataactcaccaatgtatgtcctttagagaagcaacatcaatctaccctagattaggaccattggatgaaaaacttcaaatttggtttgaacacttctataatggtttcccagaagcactagaatttggtactccaacactgatttcagttcctatgagctcccaattgatttgagattggatgaaatcaacagtgacaacaagtccagagatatatttatatcagttgtctcaccctgcatcctttcgactggtatatctaccggccgttactctgaggtctcttacgaattctatcatttaatggtggcagcccgacaactaggatatggccaactcccaattggtctatacttcttaagaaaaattcaaactaggggaatagtgatctcaactctcttatttgatcggctgctaaaccttgaaggacctatcttacgctctcctgccgatatcgatatccatcccatgcgcagccgattgtttgattaatggtggattgagtggatgaaacatctttacgtcttgggatctaacttttacttaaccatagtcaatccttcaattagcccttgcaattcataaacttctctaccgttaatccatttttattgtaggccgccgatgtccttccacaattagtgatagtaatcagccgatagtatatgctcaagctttattaccatatagggaaatagctccgactatcatcggtttcagtgccgccatggaagatatcgaaaatgttgctgccgatatgggcgatgaacctaccaatgttactaatgaagatgaagatgccagcaatatccctgaggacaaaagcagcaaagccagtgagcaacctcctcctctacctcctcgtcgtcggccaaccccgagcaagagtaaatattgcatccttccactctatctggacaacattcatatcttctaacactttattatctttctgaagacaaaaaccatatcagcttctactcatcggcaaccaactcctcgactgacacctcctccattggcaagttctctttgaactctccatctttcattttgatcaatactatcaattctaacatctaacacttttcagcctaaggctccatcggcttcccctcattagcggcactgaaaccgatgatagtatattagtgagggcgatgtcatttcaggtccgacgagcaagactgtaccaccatcctatttagcatgacgatgtggcacccggctccggaggtgagggaccgaatgtcatctgtttcacccgccacaccttcttcatctttggtgtgacttgtggcttcttagcaactgatttcacaggctttctagcctgcgcccctggctttactggtgtatttcttggacgaggcttgctcatttctgcttccttctcgaggaagttcttcatgaaagctgttaggttgttcgtcgttagcggcttcacttcaacctcttgtatattatgtggatttggcccgtacttgatcttcaccatagagcaccactccgtcctaggtcaaaactcaaacttttcctccttcccgttaatgcggagccggatactcctagctcccaaatcgatgttagcctccgcagtgctaaggaattgacgccccaaaatgagtggcgtatccttgtcagagtccatgtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcctaattttaatcatacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcattgattaatttaattggaaaagtaataataatcctcttcctagtcttgggccctttccagcccatctccctcttttgtgtgcacggccgtgcagcccaagtcagcccagccgagtttcccccttctctttctttcttttctttgttttcagccagcccaagacgaaaagtctaatttgcctccctcgacactgtttatcttctacctctagcagccgaactgagaccgatttggctcggtttttctcctccaaatctgacctttccccttgtgtttatctaaaattagttgaggggaaatattcctcttatcctcctctatctttacccccaaaaatcggagctaatcgttgagtatcttatccggatcgaactcgttttcgagtttatctccaaaactgagtttttgatttcccggatcgatttcttgcgggaggagtccgatctctttaatccaaggctataaataggaccccctagtcctcctctttcgtttgccccctctcccgtgatctcccgtgcctcgtagcgccgccgccacgtgctccaccccgccgtcgtcgccggccgagctccatccgcgtcgcgccgccgcctccgtcgtcgccgccggtcgccgtcaccgccgtaaggtgcgccgaggtgtggagaagcccggccgctctctccccgctgtcgccggtcaccggagtcccgtcgtcgccgtcgaccgaagccgcgccgccgttagacctcgtcgccggccgtcgtcgttcgtcgtttggttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttcttttt

SEQ ID NO: 32131 - DNA, 10888 bp, Oryza sativa
tcctttgttatggcctgtttgcattgattactttattccttgataccttgggttattataacttgactagttgagctttatatattggttgagctagatattagatatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttacttttcgtatagcatggttcattgcagagcaccagactgagaagtggcggagataagcccacgggggtcgctggggagtccatgcctctggtttttgagggggtgattatgatccaggaaaggtgcattgtggtgggttgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgtttagtctcacacctctcacaataattatggatgttatacctggtaataatttgcttagctcctggtttggagttagatctgtacagcggggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgctgagtatgtcatatgctaaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttagcgttttagttaatttgatgaatctgtatattaaattgtcagtttgtgtacctcggctgattcctggacgaggattttatgcacaaataagttcggaaattattagtgaatttccgggcgtgacaccatgtcaagcaccacaaagtctatcgggatgaagaaatcccggatcttcactggtacgtcttcagcaatacccactgggtagcggaccaaagattcagctagttggagacgcatcggtgttggtgccaacaccgcgaagttgagtttttcgaagacctcctttggcaagacgctcaagcttgctccaaggtcacagagggcttggtcgaaatgctgtgtcccaattgagcaggtgattgtgggacaccccggatctttcttcttctctggaagtcggtggagtaaagcgttgctacactccttcgtcagtttcaccacctctgtggttgctacactccttggtcagttcctcctttgtcagtctcttgttgtttagaatgtccttcaggtagcaagcgtgtgtgggtacttgcatcacatccaaaagtggcacgtttatgtggatcttttgaatgacttcaacaaaacgagaggactgctcgtccacggatggctttcgatatcattgaggaaatggcagcagattggtatcacgatattcctgaggtgctatctcctctgtccctgctgtgctagattgagatgtatcctcgctgttcctcctagttcatgcagtgttaagatacggtggatcctaagtcgattttcctcccctcatgatgattgccttaacattttctatggagggttcgggttgccctggaatcctcccagtctcattagcagggactagagtagctagttgcgtcagctgagtttctagcattttattaaatctcagctggttttggaaagcggaagcaaagccatctagcttaacatttatgttttctaagatcttgtcattggcagctagtttcttgcttagagcaccggtagttttagcctgaataaaaacaagatctttcaaggaaggctggttgttgaatgtatcgttattgttgtcgctgcctccttggtagttggagcggagctggttccacccctgacctccttgtggacgagcaaaggttcaagcttgggggggattattgacagtcgttatcgacaagtttcgaccatcaatattatccaatatatgaagactagctatgctcgcaatgcataattcccaaataaaataattacttccactatatgctttgctactaacatttatgcaggagaagcattcataaatgaagagaacgaggtggaaatatatcgatcaatcagtcaaaagtctgccggtgatctacaattacacgagaaggcccaaaagtccaatttaataatcacaaatgggcctagaatgtatgtcactgattcaggggcccacatggaagtctcctgaaggaagctgggggctagaagagccatagggggtcggccgaccccttgttgagcccaatccagtcgcattttggccaggacaaaagggaggccgaggagaaagcagcaggccaaaaaccaggcctgttgggcaattcccctttggcgtggacgctccggatgaactcctgatggcggttgcggggcatttccgacaattcccatgctctacaaccgtcattgggtgctataaaaggacctcacctccttcactttcaatacacactcaagcaaggataaaagctctctacaaagttagtattagtgttagtagagtagagttagaatagttccaagtccgtggaggcttcggggagttcggtaaaggttctatagcttttcctttcttctttgtaagacttccatttatcaatataatattcttctttgtacaagttcggtactttattccaatcatagagtatgagtatcagtcttagtttattcataagtagtataatctgtgtggttaaaccttctgggatttccattgatgctggtataatgtctgattactgggtcataagtctgctctggctaggccgagagctatggctcggggactcagatgctctgcaccgattgcaaggctgtagagtaataagtagtaacttaagcatagggtttaggttatcacttatcattatttggaggtatattctttgggtgatttgcatgccgctgatggtgacagctcagtacgggcgtctcccccgcagtttatattcctacatacaatttcctggggttggatacaccgccgtatcctacttcgattggagggttatgacaggttgtcataagaaactcggcaacccggggtaactttgcgatgcatcgggagggcatagctattcttgggcttagttatgttgcattgttaaaggggttatactacatagtgtatactagttagaatatactaagatgttgtatactagaagtataggaatagaacttatctaaattactaccacttagctataattaggagaatgtaggagttagctaaatccttagctgtgtgtcactcaacccttaagcttaacttacccctgcatagaccttgatgtatacatgtaatatataaactattaacatagtactctcttatcatatcttcccttgggataaaataaatacgataccttggaatactcccgggtgaaatgctacaatggtatatccgtgcgcttgcagatcacatctgtaaccataatatacctaggttatttctagtgctattgctgggaattatatttccagcagtgtcgctaagaaataccaatgagtatttctagcgccgttgccggggaagataaaagattaagagtttactacatgttaataattttatatgttacctccgtatagttattgtcctttgttggcaaaccttgtttgttttctcttttatatgaaaacagggtagtacaggactggttctgatctgccgaccaatttcatatctggagtcactggtgaagtgaagccgaccccgtgtcgttcatcctcaaggttactctatcggcaaccagaccagccaattccgcgccaccagaattgcacgatacggctgagaagtgtggacaccctgagtattataccatccagtgtccaacgcgaccaccacatactattggagaagtgggatccatacatgcataaatagccactcgtcctcaatgtgtccatgatcgcggttgacaaccttctgttataataaccgaaatgtcgagtagtgagtgcaagacataaccgtaagatagcttgccagtccaccacgtcatatgcccgtcaaccactcgaaggtggcgaccaaaagcataccccagtgactcgctatccccaattatttcaagcgatcaaaacccgttactcatgcttagctagtccccaggaatacgactatcctcacactttcatcgcaagcaattaataaacatagcaagtaccataatagggttaaagtgcagcgagatacatgacacataatagggtccgaggtcccaacatacaacacataaatatagcagcggaagtctcaaatagagttcataagcaaaagataaaaccggtggtgccacaaccccactagggcaaactaaccgggcaagagccaagttgcaagagatcactccttgccctcgccgccctcggcagagcaatgaccacacaagaagcataactcaaaactggattccactcctgaaattgcagacaccgggttaagtacaagattgtactcgcaagtcttacccaaaattatatatacataagggagagagaagcatgcaagctttctagcctacagtgggtctctaggttcaacatttgcataatgctaattttattgagcaattaatgagtaaaataagcaaggacaagtaaatctagcatcattttaatttatggacagcaagaacataattctgaaatgtataagcaaatgagcccaaacggcgctctcatcatcaaccatgttccaccaaagtccataccaacatggcacaacatgccaacaccaccatcaaacataatcccatccataaaaatccacattttatgctaacatgagtgagatacacatcaagcaatgtccataaccgaggacgcggctattcgaatagattatactctgaccagaggtgtacaactggtcccacatgaaatgaaaaagatcaaatgctacacaccccgtcgagtgcggtacacaagtgattcaagctcattacatgccctttcttagccccaccacaaccacctataccacgctagggttcccgacgactcagtcacgtgcgtgcgtgacgtgaccaaggcgggcgcgccacgcgggaggcatccctggccaatataggcacccgaggccctccaaagggctacctgccctcaagtctctccaacgtggtataaatgatcacagtagaactagtaaaggacaagccggtcccaaataaggcatgtggtaagtacgaagggtgcttgaatagatgtcaaaatgttcggtccttaacgactcagacggggcttcttgcatcagaaggaaaaccaacctcccttcatcgccctatcacccgtccaagtccaacatatttcatcaaccattatttagtgtaagtgctcaagttttatgcccaataatgcaagttgtctatatacaacaattaatagcactgtccatccctacagttctattagcactaagcatggctaagcattaatgaataagacatcccaagtaatcccaaccagtggtaatagggtataaggacagcaatattacaagaactaaatgcataaataggttcttcccatacaccataaaccggcaatattaatatctaggaatgcatgcatatatatacgtatagattgcaaccaaatcatttttagagaaagcataggttctatatgtttaggtgcttgccttgctactgagggtagtcactatccttctcgggatatggctctttactctccggaatctctgaatctatcgaaaagaagcaatatgcgaataagagccaaataaacatgcacatgcaaaatgatcaataaattatgaaataaatacagtgggtagatcatattttaacttgaatttaggtgaaagaatcaccagattatcacttatggtttgggagatatgaaaatgacaagctcttaggtgctgaaaatggcagttctgtaaatattaacgtttcctttagtactttacaagtaaaatgcatttcaaaccaagatttcataataatgattatttttagagtaaagtacatcactcacagctcctaagaaaaattatttcacagctatatgtgttgtcattatttatttatggattttacaagttaaaaacataggaatgataaataaactcctaaacatgatttaagaggtagttttgccaaaaacaacaccacaacagaaaagagtactaaaatataagctcaacaaaattggtttcacaattttagcttttaccaataatttcttacgaatttattaagagctagaccactcaagggatacatatagctatttatatttttactgggaaaaccagtacaaaagttggtcatttttattttacaacatagaagatcacatttttcttaatccacagaaatttggttcactgaattcagagttcatatgaattagttatgaatttttaaaacgcaaacctctttcagctcaaaagctatctcagaaatcgatttctattttcgctccccttttctccaacttccaccggacatccctcacatggcagcaacctggacgtagggtcatgcgaggctaaggcctcgggctgatggcaagagacagagcaaggcctcggctgacggtaagagacgttgcctagggctgcttcaaccgaaatcaaaagagattaacaccggatgagctgcagccacctcctagctgcaataatggagatggatgacctgttgaatgttgctataaatgttcaacatggagagaattcaaaagaggcaccatggatgaaaaggaagctcaccaaatagaggaaaacacaatgctgctgctgcagccctacaggctgaaaccaccactctcttcttccttctcgatctctctcaactctccatgcatgtgcaagatgttgggatggattgaaagcttagatgatggggattgttatggtctaacatgcagagcttgagtttgggttctttgatgggatttgggggaggagaagtgagttgggagctcagcttcagaaggaaaagaaagaaagcaagggaagtgaaaggggaggaagaaggggttttcctttgcccaccttatgtcttgaggtggggagaacacccaagggtgggttttgggctaaaaaggcacccaaggttagtgacaagtgggcccaagtcgtggtggtctaagaggtaagggctggaatagaggtggaacaagaatttgggtagatttccggaattttcagcaattttacacctcttccaatatgacactcagttagttcaagaaataatagtgatataattttatcctttggtgtggagatagacctggacacctagtttccatttttcaaagtttcactcaaaaattcaaaatattttaattctggtgaaaagatgaaattggttaggctgaaatttttaggaggccaaaacagagagtaaaaattccacaaaatttatatttgttggtgataaataaactagtatttgaataaattattatacatgtacatttctgttcaagttattgttcaaatagaagtggtttcaattttaccgattagagttaactttgtcatcgcctatgatcaaattgcaatatagtaaatatgaaatctaaaggacaacaaaagcacttctaaatacctggttatgatcctagggctgttacaagaagtccctttgcaagttcgctgctcgctctgttggtaacatgctagttgcaacccaagtcagcaggggagatggtgactttgatttaaagaccagctaaattaacgatggcgtaggcttgcttgttccgtggcaaggctaaggaggatgcaagtgctcattttcagtaattcgtggaaagtcgtagcacgtataccgtcagaagaatcagactccaattattgccgttctccctcctcgagagagcagaacagcggttctacatcaaccgtgcaacagtgaatacccgaaacaattgctcaacggccttcctctcaagattcttcctgatgggcaaggccaacgctcttcgtggaagaatatccagcttttagcaaacgagggatgaaaccattcttgaagcctgggaaaggctgttggaatgcgtcaccgcccgtcctcatcatgggatggccgagtggctcatccaacagagtttcttgaacgaattaacccccttgtcctgggatcacctggatgctgctgctagagggacattcttctcaagtacagtcagatgccaaccgattgagaagatgctctcaaatatggggtggagcgaggaacgactccaaactcgtcaatgcggcatgtacactatcaagtggatggaaatgctagcagctcagttggatctccttatgaatagagtggacaacaacgagaaggaatccaagcagggtaccgttaatgctctgggctctcacacgacatctgaggtttatggcaatgccggtcactctgggacggatggtccgaaaacccgtaaagacgtcatgctcatgaacaacagcaacgggaaccgtccacaaggagaccaaggatggagcattgctccatggggtagatcaagaacggaccgaagcacaaggaggtcaaagtaaaaccccaaaggacggatagcctcaacaccttcatgatgaacttccgggaacagggagaaacgaggaaccaacaataccttaagctggcatccaagaagtcgggaatacaggctggtcaacctgagttcctagttacgaagaggccgcagcctacgcctaagacaaagaaggtgtggtgggttaaggagaagacacccattcctgtacctccggaactgggtgcctcatcgagctaaaacatcggaggtacggtcgtgctcgtcggacctgaaacgacgtcgcccttgccaacaggtaaattggtagttatctcatatttattttccattgcatcgaaacatgtttgaattttcaaaacgcacattgagatttgaatttgaggaaaattattcaaatgaatttttgtgagcaaaataaaataaattttttggcaaaattctacacaaccaccttcacactagtcgttggaacccaacaggtacttgtggggccgattgggtccaccaggggtcgggccgaactggcctagcaccggctggctgcaaatttttgcagggtagtggctagtggggcccacatgccatgactagccgttatccatgcactatatatgtagctcggctgggagagggaagtcacaccactttaactcattttcactccctctcaaaaccttgctctcaaaattaattcattcaaagttttgcaagtttgcctcaaattcacacaatttactgcatttagtttagacactttgcatgtacaagtttgctttagttcggtgcaaggttaatcggcgggtatttgcttaacccccgtccgagtagtcttgtattctttctctttgttatagctatgaagaaacgactttcgggcatattcaagagacgatcaagctcacggacaagtcgacacaataagccaagtacaccttcttccgtggatgcatccatggaggaggcgtatgttccaccgaggctgtacgacaactccgatctcgacctcgtgggcgaccgggaattgcaaagcctactacatactgaaaaaccgaacgtgtgctcacacctgagcatacgactcgaccttctgaaaatgataggtacggatgctgagtttcatactatttagcgtgctataggttgggataaatttgcatgtgtagacgagctgggttcccgtttgcttaccatgcagtttcatgtgccttgctagaggtgggcgatggtgttactttccggttattccgcaaggaatatcacctttcttggaaagactttagcttgcatctaggctttgacaaaacatgcaaaattaatttcaggatgcatttcctgattttaacaagcgtatgttttggcaatgtatttcgggtctgtcatcctgtaaaaagcctggaactagggacatccataatcctaccttgaggttgttgcataggttgcttggtttcgtgctgtttcctagagctgatatccagatagtacgaacttatccttttgcatgccatggatagaaaaatcaagtttcacccgttcaacccatgatcaagcaatggttagaaaatgtgaagttgtctggtcctgttaagtgtatttctttggtgactcatttagcatgaagagttgggactatgcttgatacgcaagtatcttgtattcctgttacccgctcttatgttgatgaggcctatctgattcaaggtcacatactgaaacatggtctaaatgattgtcacgcccggaatttctatccaaaattccaaacgcttacatgtgtgttaaaccctcgtccaggaatcaaccgaggcacacaataacaaattgataatagagtactattaaatattcgcaaataaaaaaaaattattacagaggtagatagttcctctcaaagaataacattcta

SEQ ID NO: 32132 - DNA, 23162 bp, Oryza sativa
ctaaagcaattaaacaaaaaccaacaaaacagtacaacaacaagcataaacagtatatgtggatatttttaacatgtagatcttgattttagaaaaatttagcaacttgaaccactcgaaacggatctacggttatttagttatgattttccgaagttttaatctattagaaaattggaaaaaaaggaaaagaaaaggagatgatgacgtcagcatgacgtcaccccacggtagccggctagggttggcgagctcgccggagattagatggtcggccgcggatttggagggcacctacgcgtagaggacgacgaggcgaacccaacggtactcaccaaagtgccaaacggcgaacgatgacggccggcgactaggaagcggcggcggcggctcgggttggacggcgacggcgagctacggcggtcggcggcgaagggggacgggcggtgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcagaaggaaagaaagacaacaggagctaagccttgactaaactgcagcgggaacaccactccacaggcatcctcgacggcacggacgaagcctactcctcggagaaaccttcatctgacccgaactcgaactctggggttgggaaaagtagagcaagactgagtactacccactgtactcagcaagtcataccggaatagaggtatgatgcagggaatcatcaaagaaaagctaaagtggttcatttgcataaagcgggcatttataaacagagattgaaagatttaaacagttgtaaaaattaagcagtattagtcatccactgtccaacgctacaccacgttgcaacaggcccaaccatccacctaaactatccaaattaaaggattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggaccctctagccaagcacaccacacctcaggtttcacccccgtccccggcgggcaacgggcagtcccctctcgtgcctaggtgaatccggaagccgcataggccgtcgcagggcccatccaaactccatcacgcccacccttgcctggatgcgtcgactagagaaaagctacactacaagcccagccgttgcccacgctggcttgtggtaagtacgataagttcttccagggcatcccgcgaaccggtccttaattgccatgggcgcgactagcaaaaccatgcacccacagcccaccatgtgatacattttatttaaccaacaccagcgcggtggtactaatccaacattatcatgtaaacctatagtctaggttttaaattgagatttccccattgtgtgctagttgaactaagcatggctaagcaattcctagtccaaagtctaatcaagttatgacccaagctaacaaaggagcatggtatccaaaaggcatggctgtaacaataggtaaccatccccagtaatattataaaacaatgcaatatttgaaagaaaacaatagagcatttgcaatatagggtcaacatgttcaagtgacaagcatgacttgccttgctctgctgctggaggaacctcggcgactatctcaaagtacaccggagcgtcggaagagccggaatctagcgacatacaaggcaaacattgcaaacaggctataagactactgaaacagggaacaaaaccatttttaatggattctacacatttttcctgatttactgagacttgaatggacttaaacggagctcggatgaattagttatgaattttagaagattcactgtgtttattactataaccaaaatccttaaatactttattgcgcaataaattccagggctgacgtcagcacgggtggcgcggcgccgacatgcggggcccaccggtcagcggcacggggaggagagaggaggcgtcggcccgcgggcccaccggtcagcggcacggggagggcggtctaccgtggaccgggaccacgcgggtgatccaccgccgatccacgggaccgacggcccggatcgccctcgggccgatcggacggacggcggcggcggcagcccccgggctcggatcggcatcaaagccgatcggccgacccggggctagcggcggcggtgcgtgcgcgtcgcgtcgccggcgacggcatccggcggcggaggcgacgcgaaagcggcggcagcggacggcggcaacgacccaaagcgacggcgagcgcgggcggcggcgacgcacggggaaatggggaaggagaggagaggagatgcctcaccgagggtggccggcgcggaggaagacgatggcgaacggcgacggcaagccacgggaggcgacggcggccggcggacgagcttcggcgtgccctaaggaaggagaagagagggattagagagagggagatagaccccggcgaccggcattcgaggccgaaagcggcggtaggggttaaacccaccggagcgcgaggagacgggtgttccggcggcgaacctcgacgggggaggggcggccgaggtagatctcgaccccgcgaacccgacggcgacgacggcgcggtgcggcggcgaccctagcggcggctagcggcggccgaagtagcaaaaacggcggcggcgggtggttgcacgacgcgggagcgatggggagctcgggagaggtcggcgcaatggggaaaaagtgagagggagcggcggtgaagcttaaataaggggagagagggccggacgtggccgggagaggcgggaatcgccggccgacgtggggagtggggagggagagagagacgggattcgaaattcgaatcccggccatctcgggcgcgggcgcgagcgggagagagaggggaatgggcgcggagagcgcggcgcacgcgcggacgtggccaacgtggcccggagaaggcggaggcgtgggcgtgacggccgttacgagcgaggcggcgcgagcgggagaggcgggaggtgggagacgggtctgacaggtgggtcccacctgtcggcgaccccgggagggagggaggcgggcggccggctgggcctcggcctgcggccggcccagcagggaggagggggaggaaaggaggagatgggccggcggcccatccgaaagaaaggaggaaagagagaaaaaggaaaagaaaaagaaaaaggaatttttttcctggaattaaaaattgcactttggtgatttttaattggttacaattatttctagggctctgaaaattccactaaaaatcctgttagtgagtttcgacatgtagaactcaagaaaaattccacatgccaaatccaattattatttgcattgattttcaagggtttactcttgctttgcaccggtatttttcttagggtcatttataaattcaatttttggcttaggaggagaactacagggtgtgacaggcggccgagcttcctcacctccgtgcgcacctaacggcgacggcggcaagcggcggcaacggcggaggcgatgcggcggcgcggctggagaaggaagatgagtccgacatgtgggccccacatgtcggtctccacaggagagaggagcgggcggcgtcggctgggccggcttgggccggttcggccgcgcggagagagaagagagttgggccgaaatcggcccaacggcttaaaaggggttttttgaacttttttaaataaaacaatttgtgaaatgttgtttcaattattaaaaatacttcccttgctcaattaattcccagaaaattctagaaaatagaagagcaagcataatatttaataaaattttatctagctcattttcatgttgaaaaatttcctagaaaattagggtttagcttgtaggcttttaaaataatttctaaaaatgatttaaaatatgcatttttaatttagtcgatttttagggcgtaacaaacctaccccccttaaacagaatctcgtcctcgagattcagaagaactgacgaacagatgaggatgagctgacttcaattcatcttctcgctcccaagtggcttcttcttctgaatgattgctccactgaaccttgcaaaaccgtataacgcgattcctggtattcctctcgcttacttccaaaattctgactggcttctcaacataagttaaatcttcctgaagctctatacgatcaggatctgcttcctccgtaggtacacgtaaacatttcttcagctgagacacatggaacacgtcgtgtattcccgccattgacggaggcaactctaactgataagctacttcacctcttcgactcacaatcttaaaaggtcccacaaaacgcggtgccaatttccctttggtttggaaacgatgaacacctcgtaatggcgtaacccgaaggtatacataatctccttcttcgaaagccaaatctctgcgacgattatcggcatagctcttctgacgtgactgagcaacgcgcaacctttcttggataatctttactttttcttctgcctctcgcaatatgtctgtcccaaaaacttgacgttcaccggtttgatcccaaagaatcggcgtacgacattttcgaccatataatgcttcatacggagccatttgcaaactagcttgataactattgttatatgagaattccgcgtacggcaaattcttatcccaacttccaccaaaatctagaacacaggctctcaacatatcttctaaaatttggtttactctttccgtctgaccatctgtttgagggtgataggcggtactgaaattcaaacgggtacccatctctacttgtaatttctgccaaaacttcgaagtaaactggctacctctatctgacactatcttcttaggaacgccatgcaaacataccactctggccatgtataactctgcaagcttattccccgtataggttgttttgacaggtataaagtgagcgacttttgtcaacctatcaaccactacccaaatagaatcatgtcctgctgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgctttaagtcttggtacatcttggtgcttccagggtgaatggaatacaaagtttcatgagcttctttcatgatagtatccttcaactccttattttctgggacgcaaattctttctcccaaccacacagttccttgctcatcttctacataaccgatggctttacctcttctcatgttctttttaatttcttgtatgtcaggatcattcacttgagcttctctaacttgatcaaacagagtaggttgagcttccaaagtagccacaaaacctttgctgactattcccaagttcaacttttcaaattcttggcataacttccaaggtaaacgtcgaccttctgacatattacagtagcttttcctgctaagagcatcggctacaacatttgctttccccgggtgatagtggatttccatatcataatctttaatcaactctaaccatcttcgctgacgcatgttcaaatcaggttgagtgaaaatgtacttcaaacttttatgatccgtatacatctctgtacggttaccgaaaagataatgacgccaaatcttcaatgcatgcaccacagctgccaattctaggtcatgcgttgggtagttattctcatgaggacgtaactgcctagatgcataggcaaccacctttccttcttgcatcaacacacaacccaaaccgtgtcgggatgcatcacaatacacttggaaacctttcctcgaattaggcaaaattaatacaggtgcagtcactagccttttcttcagttcttggaaacttcgttcacaatcctctgtccacttgtacttcacttccttctgaagcagacgagtcattggtctggcgatctttgaaaagttctcaataaacctgcggtaataccttgcaagtccaaggaaactacgaatttctgaaaccgtcttgggttgcttccaacttaacactgactccacattgcttggatctactgccactcctccagacgagatgacatgtccaagaaacttcacttcggacaaccaaaattcacatttactgaacttggcataaagctgatgctcacgtagtttctctaaagctagacgaagatgctcctcatgttcttccttcgtcttggagtaaatgagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcacctttcaattgatcaaagaggtcatcaattctgggtagaggatacttattcttgatagtgacctcattcaacgctcgataatccacgcacattctctgagtatgatctttcttctccacaaaaatgactggtgctccccatggcgaagtactgggtctaatgtatcctttctgaagcaaatcatccacctgtctcttcacttcagctaactcattagctgccattctgtatggtctcttatggatagggttggttccaggtaccaagtctatccgaaactctatgtctctcttaggtggcagacctggcaaatcctcgggaaacacgtctgggtagtcttgtactatgggaatctcttgtagagcaacttggtttaagttcacaccatgagatttaggagaggacacaaagaaagaaacggtttccccattgctactagttaaagtcaccttacggttgacacaatctataactcctctgtgacgagataaccagtccatccctaagataacatctagatccttggattctagcaagataagtgaggatgggaaaggaacttcttctatttctatagtagcggaaggacaatactgtgtcgaaaatacttgattgcctggggtgttaactagtaaaggtctcccaagactaacaacttccatcccatgattgctcgcaaaacttttagacaaaaaggaatgtgtagcaccggaatcaaaaagcacagttgcgggtatagagttaacaggaaacgtacccaaaaccacatatggtgcattctgagcttctgctgctaccacatgattgacacgtgcctttggtactggaacattggagttgttcggagctggagcgttcttcacgcgccgaggcttaggacacttatcagcataatgtcctggatcaccacaattgaagcacaccactggtttgcttccctgttccttcctgacaggctggttctgagctggagttgctgcaggacgagcaaccacgttgcggttgtcattgccacgattaccagtattgttgttgtagaactggcgttgggggcggataactgatgaagatcctccttgagggtacgatggagcttgaggtccaataacgagacgtggcctctggttactgccctgttgtgccttgaattgggcagccctgcgcttcttctgctccatccggttatacttgtcttcctgacgaatcgccttgtccaccaattgctggaaatcccggaaatccgtagacatcaaggcataagacaactcatcattcagtccctctaaaaacttctcctgacgttcttcatcagtgcgaacatcctctggagcatagcgagctaaacggttgaaatcatggaggtactcagtgaccgaacgagatccctggttgagtgctctaaattctctcttctttagagctacaacacccgctggtatgtgtgtcttcttgaaagcagccgtgaattcctgccacgtaataggctctccttcagccctgccttggcgaaaatgatcccaccattcggcagcaggtccatgcagttgatgcgaagcaaaagaaactttctcctgctcagtacactggatcaaatccaacttcttttccaccgcatgcagccagtctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagtagctccactaccacttccacttccacttccagtgcgcgtgttcaccatctggcgataagcagagacaacaggaaagaacgacagagagacacccttagaacggagttatttaattaatttaaattctatattgctcttaactgtgtatgattacatttaagttgcactaacactatctcaccaactatcttacactccgacaagcaaaagagctagactcatgctgttacatcccaccaatgatgtaagcaacaactaaaacccacacactcacaagcaaacttaaacaagcaaactaacacagcgaactacggcaacgatctagctaagcgactaaacccgccttgtgtcggaacgaagcgatggatcttcttcctctggagtagctggctctctttcttcagggtcttcctcttcttcctcatcacttatgatgtcgatgacaggttcagcacgatcgggcacagcttcgcccatcacacgaatcttcgaggctaactggagacgaggtggcggacaggttctctttcttgcgacgaggcgaagcttgggtgttggcggcggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccacatgcatcagagtggcactctcttcaccatcaggacagatataggttccatagtcttgaccatgaggcttgtgaggatgatactagaaagctgatgaatccaactcttcttcaaagcgttgacgcaactctccaatggccaccaaagctgcttcttgacaagcatggctgtacgatcttcctccagcttcgaacttaatagacggaaggtcttcacgatcactagccaacgtcacacgaacatgacacttctcctcgtcggggtcatgggaaatttggcgatactcgggagcaacttcataacctacctcaaaaaccatcaatcttagctccctgacgaatcctaacacctcgatcaaatttctcggtgaatggggcggcatctaaagaaacatagaagggaagaattaatgcatattttaagttagctgcaccaactagacttaactgattttgaccaaaaaggaagaaagataaaagaaaagaccgtacaaagctattatataaatatatttttagaatttaacttttttggacagagacaaatattttttttttgacaaataactaaaataaaactaaaatacttatgatctattataagcacggtacagtgtcaccacaagaaagatgagtagtactagtgctatcatgattgtatcgataccataatagatgtacagtgccgactaatcaataagatttggtaaagagaaaaagaaacattttgagaagaacaactttttgcttttaaaagaaaagaaattgaattaaataaattttgtgcataaccttgcatgtgctgccaacttatttaatttataagagaatagagaagagcagttctatattttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaattgataatagagtactattaaatattcgcaaataaaaaaaattattacagaggtagatagttcctctcaaagaataacattctacgcagcggaaaaaaaaaactataacaaactacggaacagctatggcaactccactccacaggcatcttaaccaagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagatcatttgcagaaaacagcatttaataaatatttaagagaataataaaaacagttgaataattaatcaacattaaataaacaccatacaacacacccgtgttgcataggcccaaccacatttgaacaaccaaccccagttgaacaaattaaacctccaaaccaggaattatccattccaaaccaggagtcaaattaattatcacattattaacattgatgagtagagtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccatggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcgcacgattaaccatcgtgagctaccattgaatataaccttaattaataataataataataatttatatttaacccctttagttagctaatgtttctaagcaaggctaagcaaacttacatatagcatttagccgaaccaatccaatatataaggttcatgctaatcaagttataacccataggaaaacaaagtcatcttcggccattaattaattgggaaaggttcaccacccgattgacattcgaaaacaatgcacagtggaaataaaataatagctttaaacgggatcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtacaacaacaagcataaacagtacatgtggatatttttaacatgtagatcttgattttagaaaaatttagcaacttgaaccactcgaaacggatctacggttatttagttatgattttccaaagttttaatctattagaaaattggaaaaaaaggaaaagaaaaggagatgatgacgtcagcatgacgtcaccccacggcagccggctagggttggcgagctcgccggagattagatggtcggccgcggatttggagggcacctacacgtagaggacgacgaggcgaacccaacggtactcaccaaagtgccaaacggcgaacgatgacggccggcgacgaggaagcggcggcgacggctcgggttggacggcgacggcgagatacggcggtcggcggcgaagggggacgggcggccgagcttcctcacctccgtgcgcacctaacggcgacggcggcaagcggcggcaacggcggaggcgatgcggcggcgcggctggagaaggaagatgagtccgacatgtgggccccacatgtcggtctccacaggagagaggagcgggcggcgtcggctgggccggcttgggccggttcggccgcgcggagagagaagagagttgggccgaaatcggcccaacggcttaaaaggggttttttgaacttttttaaataaaacaatttgtgaaatgttgttttaattattaaaaatacttcccttgctcaattaattcccagaaaattctagaaaatagaagagcaagcataatatttaataaaattttatctagctcattttcatgttgaaaaattttcctagaaaattagggtttagcttgtaggcttttaaaataatttctaaaaatgatttaaaatatgcatttttaatttagtcgatttttagggcgtaacaatgattctcttatgtttttgtttcccggcaatacaaatgagattccgttatctaacccggagtttcatttgtataactgctgagaaaactaaccatttctctccaagcggtgttgcctcgtgaggtcccatgcagggtaacatgacgaatggcgagagaagcacctcaggaggcgtcttcttcttcaccaccagtgcagaagtatggagattgttgggacccgaccgtgcatgcccccggttggacccaattcctgcaacatgatgctggaggttcgtcctggcagagtgctagcgacagccggtggtatgagccgcaggagctgcactggggttattcgcgctccttcagttcaagtggtctacctccatcctcttggatgcattgctcaatctcctctcgaggggatctgggaaaattcatccgggggatggatacacttgaactgcaggcagggaacatgcagcacatgctggaagatcatgtggtacagtcacgggaatggcagcagactgttgatgcacagcttgcaaactttaacactatgatccaacaacaacaagttgactggcaagcgtttcaccgctaccagggatttgatccccgccatgagccatagcaagaagcaagcttggggggccactaaggtaacttgtatcacattgcatatttcccttttcaaattgcatgtttaaatttttgcattgcatttataaacctaaaaataacataaaaatttgcaaaactaaaaataccaaaaagataggttagatttaatatgctaggtaagacatgcttagttcttcatgttgaaatgatgaatagttgctctgttttatatctctcatatatgggttcatggttaagtactccctcaagaattgaataagagtagccaacaattatctgggaacctgaggtaagtgagctgcactttgctgatctgagtctagtgttggtatttgatacggttacagataaaatccgcaagcgcacggatataccgatgtagcacttcccctacggagtattccaagggtatcgaatccaagggaacatgtgtgatcagagcttcctccggttcatccaaggacaccaagcaattgataggccaggatagagaggatttactagtgagaaacagtgtagggaaagcttaattttaatcctcacgcaatacttcaggcactggcaacccgctgttcctagatgtcgctctacttcgtatccggacagggaggacttaagtgctctcgagggctgtcaccacctctacacccatctcaacgtactgtgggatatgcagcaattactggataataattacctaaacaccacgtctaagcaattaatatctactttagtgtttataactcaccaaagcaatcactatattttagttgattatagtgaacaataatcctgtatgctaattaggaactaaccaagaggtaattctcacaagataaatctaaattactcaagaagaatattatattgaattcagagtaataaacagaataaaagaaataggagaagattaccgacaactccggaattcttccgactccttctactctactctcttcctattctagtatacaatatagtacaatagagccttttataatttagctcaagcttggaagtgtgtgtgtgaagtgagggagtgaagcctttatatagaggtaggtataacggttggcgaaggggaaatgtccgaagtgccctccaaccgccatcagggagtgatttggagcgtccaagccaaaccccacatccaacggtggagatagtggttcggccgaacctgggctgggcccatctggcctggcctttggcccaagtcctcccctggtcctcctctatccatttcttggtattttgggctgatttactgatgttttgatgaagttcacaacccaaccttgtatggatacaaaattttcctcactttagtctagatgtcctcccaacttcagggtttattacctgcataaatatacaccaacacttgtggaatgtgtgagattaagcacctatcactatgttggatgttttattatctaaactttatgcagatgttggtggtatagaatcgacatttaacaaccaccaacatctaggttgttgcgagatatgagatagtaaataagagttgctatgtcgcgaccgagaaaatttccttttcccgaacgctagtgtattaatccccatcccaggagaagccggggtacaccaaacaaacatgatacaaaaggcacatctttattatatcgataatatttacattattacaaaggcacttcaggcctgacaaacaaaaataaacagcagcggactagcgggcctacggctccatcttcacaggcgctcaactgaggtataagccaggactccacctaggacttcttctccaaagcttctcttactggaggggggagagatagagcaagaatgagtacaaccaccgtactcagcaagtcacaccgggagatgcatgattaatgcaagggggtacaaggagtaataatataggggttaagtttcgcagtaaacagcatttaaaagtcacttagttgcccaaagctattttataaagactatcctagagctacacagtattattaatcaacgccgtggacccgcacgaacctgccttaacccaaggcctacgatgattcagaccgaactggcaacccgacctgggtcccagctcgtcccaagccaacccaggccaaccattccatattttagttgttaagcaaattttaagaattaaaccactaacttgggtacattgctaggcttgcccatatccgagggcacggctattcgaatagatttactctgatcagaggtgtacatctttacccacaagacacatctttactccacattctatggccttggaacccgtcataaacatgtgacataacccttcacccatcctagccgtgaacaaaagtaccgacccaaccctgcctacggccagtatcccgggacaggcaggccaggattgagcccctagcaacaggatctagaccgggtgcgccacacacataggggtgagaccacccgcgtactagtccagtgccatggcatctcgactaacaggcaccgacccgtgtagccttcatttgcctagacatctcgattaccaagccgcagctcgtgtagccttcatttgcctcagagatatccatcgtcgcaacgacttcatccatctctatccgtgttcttttgttcaggactagactgagcaccgagttaagccttacccattagacatgtggttagtacggtagtgctttgcaacagaggcccgagcttaatccttatattggccggggtgctacttatagagtacccactagttgggggtttatttgcctagggtaagcaaggtgataataacaatagcaataataataaggtcataacaaaggtaaataggcatggctaaataaaacagtgataacgcgggaatttaaataaagcgatgatgcattaatttaaatcaaaataattttataaactgggattcaatatgctcaaggatgatgtgacttgccttgctcagagagaacggccttccgaaccttcggcaacgaccgcaaactacgcttcgagaaccttcggaacgacagaagctacgcgaagcacacaagcaaagctacaagcctataaagaagcaataccaatacataaaaagaaagcaccccggttctttatgttataacaaacattaggagacttgaatgggtcgattcagggttcgtatgaccaagatatgatcatccgaagtttaatgttgttacatggagatttacggattattgtgattaggttttgcaattataaaacatgtgtaagcgctagcctggaaaagacaggaaggctgcgctgttgacatgcagaccccacatgtcaacctaaaggaccccagtagaccgagtacacagagacggtccacgggtcgacggaagcggaccccgtgtgtcaaccgaggcgagtggccgacaaacggactccactagacaccacacgggctgcacacgtggaaaccacgcggctaccgagcgggcacactaacacggtcaccacacgcacaagcgaacgactacagacaccagtacacgggtaccggggtcgacaaccacacaacgggcacgggacgacaccgaaaggacgaggacggggcagcgagaggacggatccttaccatcacgcgacgaggcgtggggacgacgatggcgaacgggcgcggcggagacggtttggagacgacggaggcgaacggtgtcacgcccggaaattcactagtaatttccgaacttatttgtgcataaaatcctcgtccaggaatcagccgaggtacacaaactgacaatttaatatacaaatccatcataataataatgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacctatgctgcacaggcccaaccatcctgaacagccatacccagctgtacagatctaactccaaaccaggagctaaacaaattattaccagttatagcatcaataattattgtgagaggtgtgagactaatcacgaaaaatattgctcaacccgcccataaccacgggcacggctattcgaatagttttactctggccagaggtgtaccactgtacccacaagacacagcctcaacatcatgtctaccatgcgtcgcgatactggaaagtacccgaacagaggctgtgacaataccctctgcacaacacaactcaccacagtgcaccattcctggatcataatcacccccttataaaacaaggcatggactccccagcgacccccgtgggcttatctccgccacttctcagtctggcgctccgcaatgaaccatgctatacaaaaggtaaagccgttgcccacgctggcttgtggttggcacggttaatgtttcacaacagtagctcgcgaaccggtccttaattgccatgagcacgactctcgaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaattatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccgtgcaataatcggtcttcaattaatcttcttgaatactttcggcgcactcacgaaccttcgcaacgacggaaacgacaagctaacatgcaaaacgaagaaaaagactaacaaaaaccaaataaacagtacatataaagtaaacaaacatgtagatcatgattttagatgaatttagcaacttgaaccactcaaaaccgagttaggatgatttagttatgaatttccgaagatttaatctattagaaaaacaggaaaaagaaaaacgatgatgacgtcatgatgacctcatcaatggtcggaccaagatggcgacctcgccggagattggatggtcggctgcgactttggaggacatgaacacgtagaggacgacgagacgaacccaacggtactcaccctcgaaccaaacgacgaacgacgacgcccggcgacgaggtctagcggcggcgcggcttcggtcgacggcggcgacggggctccggtgaccggcggcttcggggagagagcggccgagcttgcccacacctcggcgcaccttacggcgatgacggcgaccagcggcaacgacggaggcggcggcgcgacgcggatggaactcggccggcgacgacggcggggtggagcacgtggcggcggcgctacgaggcacgtgagatcacgggagagggggcaaacgaaagaggaggactagggggtcctttttatagccatgggaggccgggatcgagcccacaacgacgggaaaaactcgggaaagtttagatcttcgccggaaaaaggaaaggttgaaccgcgaaattggaaaggatttccatataaacttttggggatttcttggggaaaaggaagaggagattgaggggattccattcccgcaactaatttggagaaaggagcaacgatgtggccggattggtgggaggaggcggcggcactgtgcacgggctggagagctcgggctccgtctggaggtagaagaaggagcactgtagcgacagggacgaaaaacagacttctatgcgggctgagaggaagggagagagaagggggaggcaaattagacttttcgtcttgggttggctgaaaacaaagcaaagaaagaaagagaagggggaagctcggctgggccgacttgggctgcacggccgagcacacaaaagagggagatgggctggaaagggcccaagactaggaagaggattattattacttttccaattaaattaatcaatgaaatgatctttgaattgttaaaaatacttcctatgctcaaataattccaagaaaaatcttgaacatacttggacacccaaagtatttaacaatattaaaaccagaccatttaatgattaatttaatatgtgggtaattactgaaatgctctttgtatgattaaaaattaggaattgagctccgaaaaatccgagaatattccagagagtataattaaccatggagaatttaataaaaaattaaatccatccatgctttaaattaaggaaattttatttcccacatttaacttcacttgtaaattaatgaacatttaatataaattctaataataatttattaaataatttataaatcctgaaacaaaaatcaggatgtgacaaacggcgagggagcgactttggcggcgatctttgcacgaaagcgagacgcgaccggcgcaacgcttggcgacgcggaggcgaggtcgaagacgatgacggggctacggcacttgacggagcgaggacgacgaacgagaacggcttgacggagggacgaacgccacgacgagtgaaaccgggaacgacgagaggacgacgacgacgacgaccggggccggtgaggaggcgacgaggcagttggcagcagctgcacggaggcgaggacggcgcggaacacgccgctgcgaatccgacgacggaggcggcaccgcgagacgatgagccggtgaggaggaacggccgaccggaagaggggatggcgacgtcggacggagacgacgacgatgaacaccggcggggttcgggtggaggggaggcgagaccgagggcgaccttgccgctgcgatgccggcggcggtggtggcgcggccgacggcgcacgggtggagaaagggccgaccggggaaattccggtgaggcggatggagaggccggcgcggcacggcggtgttccggcgaaaccgaggagtggccggggaaggagacgatgccgcggtatcgaaggaggagacggcggcgtcgatcggcgtaccggcgacgaacaggagccggccggagacggtgtagtggcggcgacgccactgaacaccggcgggaacgcgtctccggtgctctccgcgctaaacggaggatggcccgggggagaggaggcggctgcgaggctgctggtggcgacggcgcgaccggacggcgctccggcgaggagggagaggcggctggaggcggccggtggcatgggagaaagaggaggatggtggggagaggtggtgaggccacgggagagtgcgggagggggctaaaatgatagaacggagcgagggggttccattttataggatgggggagggagccgagcatgggagagggcggaacggcgacgggaaacacggtcggcggccatggaaggcggccgggaatggcgcggccgttccgggcgtcagagggcacgaatcaagggggaaattggggggaattgaagaggaaggaaaggggattaattccctctaatcaattttggaattcctgttttgaatcgcgtggatttgggggagcaatggcgctaggtttccgggaaagggaaaggaggccgtgcggaaggagaaagacgacctgggggtgtgacccaccggtcaggcacgtggtcagcgcgcgtgacgggcgcgtgcacgcgaaagggaggggcggctcgggcaggggggcgcggcttgggccgggcggccagcctaggaggagaggagggaaaggcggcccgggggaaaaagggaggaggagggagctgggccgaggggaaggagggagggcggcccaagagagagagagggaaggaaaaagagagggaggaagagaggactttggccgcgggccgagagagagaaagagagaggactttgggccagacttggcccaaaggaggaaggaggattatttttaggtttttctttttaataaactttgataattgtttttgttgcttaataaatatttccggtgctttgaaaattcaagtaaaatttgagggctcattttagaccaaggagaatttaacaaaaattctccgggccacattcgaatttttcttgtacgtattttagtgttaaccaatttctttttgaattttaattaattctattattccttttagagaatgatttttatttcgggatgaatttatcaggacgtgacatgctacgaccctgttctaaatttgacttgaattccggatgttttatttttcaaaatgataaatttggaagttcctcatttgatatgaattcctactagagccaaaaatatatatattgattaagccatatacattatggttacttgtaattccattgaactttgtcaaatccttgtgacttgtgtagatacttttcatgctttatgatcaagatcatacacccacatatgcacacatatgctaagcttctacattggaagatagcattcatatcatccaccatatccatgtcatcattatccacaaataagctctccatccatgctttctttccaaagaaaaatcctttgcaaaaattaaaggaaaaaaatagggaaaggtatggctatgagaaaaataataaattcttgctctcccaaaattggagcatgaaagaaaaaaaaagaaaaaaaaaagagaaaaactagccataccctctctatgaaaattaaaggatattttggaggaaaagcataagcacaaatgagaagcattttctttatccacattttgttttccatcatattttccaccatattattcacacacactttgcacgatcttgatcttgagtatgattagtcatctattttagtccaagttttttgacttagtaataaatgagaatacaagtatgccatgtttgatccctaccaagctccacatatcaaaccttagagtaggaatcataaaggcaaatctagtgaggaattcatattcaaacaatttgagtgatctagagaatcatttttggaacttggctttcttttgcaaaaaatcatttgaaaacctccggaataaaagttgaataaagattgggtaactagcgctctaattgctgttctgtctctcaaccgctcaagacaaggaaaggcagtgtctcgtgggaattaggggtaagggtaagccaccgtgccaaacttatttaatttgagagagagtatccataccttgcatctgtatctttgagatatacaacattgcagcaactcctgatcaacaaccaagtctttgttcctttcgtcctttactcgggacaagcaaaggttcaatctttcccaaataaaataattacttccactatatgctttgctactaacatgtatgcaggagaagcactcataaatgaagaggaggaggtggaaatatatcgatcaatcagtcgaaagtctgccggtgatctacaattacatgagaaggcccaaaagtccaatttaataatcacaaatgggcctagaatgtgtgtcactaatttaggggcccacatggaaatctcctagaggaagttgggggccagaagagcccataaagggtcggccgacccttgttgagcccaatctagtcgcattttggccaggagataaaggaggccgaggatgaagcagcagtacaaaaaccaggcctgttgggtcagtctagggt

SEQ ID NO: 32133 - DNA, 2820 bp, Oryza sativa
accttgatgtatacaggtaatatataaactattaacatagtactctcttattatatcttcccttgggataaaataaatacgataccttggaatattcccgggtgaaatgctacaatggtatatccatgcgcttgcggatcacatatgtaaccataatataccaaggttatttctagtgctattgctgggaattatatttccagtagtgtcgctaataaataccatcagttatgtacttgtccacgtccaaagtttggttcacctttaataatttgaggatttttgtttataaagcccatagtagatggtttttgatttgaagtctgggcactagtactttgacgattggggcattgtcgagcaaaatgtccagtcttcccacaaacaaagcatggtgaatcttctattctcatgcctggtctttgaattggtggcataccaggtctagtattaggtaaagatggctgaaaagagtaagtcttccgaatctgaaatggatttttagtaggtacttgtcattgcagatttatccttcttttccgaaatccttcaatcatcttttgatcattttctagtctaactactttgttgactagactttgaaagttttcatgatcctggccgatcatcggtcctcgtagttcatcacgcagtccttcaataagtctttcaatgttttccttctcatcttgaatatctgaagcagcatatcgggcaagttgtgtaaatttatttaagtattcttggactgtcatgaatcctttcctcaatctccgaaattcattctttttcattctaattattgcattaggtatgaaagtatttttaaaagctgtacggaattctttccaggtaataatatgggcagggtcgtctattgatgcttgataagcttcccaccattcattggctagtccttctaatcgatgggtttcaaaggttaccttctcttgttcatcagttctgaccaaggctaatttcttttctattgcccgtagccaatcttcggcatccataggttcttctgtttttgaaaaagttggtggtctgaccctcataaattcagcatggttaccttgtcctttattcccttgattttgagcaatggcttctaataattgagtttgttttgccattacttctactaaagtagtaggatctggctggggaatttctcctccttcaggattgccatcattcggattcatttggaatttctgctgtcttttcaaaggggagtcaacatccttaattatacatagaaaatattatacatgatgcatacaaaagtagcaaaagagaaaacaaaagaaaaagccaaaagaaaacaagaaagaggtaatttcacacaagtggttagtgaggagtactaactaacttatactaatgcgtttatttatctataagacccctagttatacacattctatctataacttctagtcatcaagccaccctcccgtgccttctgcaggattaggaaataaagacgtaggtgcaaactgtgaaaaaccagcattatatgttgtagctatatccattgtattggtggtagggcatgagtagggaatcccatcgtcatggtcttcacaagtcttaggatgaacagtgatatgttcctgtgtttcaaaaatccgttcttcaggatcttcttcttcttgagtctcaacccaaacaggaggaacattcaaatcattaatatgaaacattcgggtccctcttgttgtttctggttcttggctagcttcacttatgtccatagctgagggtgttgcttcggcttcagcttcatcatcagagtggataggatacaacggtgatggtgatggtggaaggccttgtaaaactccttcacccatatcttgaggattgggcccctgtggctcatccccatgtactggtgataaatgtccaccatcatcctcatcatcgtcatcgctatctagtccgggtacttgatgaagacaaaatgatgctccagcgacacaaatatggagtatggagttttgtttctccttctcatcatatagattttgtagcactcggtatttgtatcttatatcggcttccttgcgttcagcttcctctagacgttggcgctgcatgtccatatgctcaagggcttgctcatacatatcgtctgcagcttccatccacagagacatgcatgctttcattggttgctcattgtagtctatattctggatagtgcaataatcctcgccaggttcccgcataggatgataacaatagcgagaatgttggagtttgtcttgatagatatgattcaggcgtagaaaagcctccctagatgcatcatataaggctgctcgtattgtatcccgcctatgacgagtcctgaaatagtacatgtctgtttctccccttggtggattgatctttatagtcatgtcatactcccagcgatctcccttttggtaaggatgtgaatagaattccggtacttcagctatttttagctttaacattaacttgatcaactggtcagcacaatcattgttatgtatagggatcgttgtctcaaaacgctcatgcctttctgccattgacctgaaatacacaaatgaaatatatagtgtgtgttcgcaagttaaatctaccccccttaaaacaataagcttgaaataaattcaaacttaactgggttagtaatccttaaggttcatcctatagtcaaacatatgctctgataccagttctgtcgggtcccaaaactaatgacttggatccgaccatgattaatgtatcaagccctggattagtaaataattcatacatataatacagctggttcttcat

SEQ ID NO: 32134 - DNA, 2334 bp, Oryza sativa
taacgcaatacttcaggcactggcaacccgctgttcccagatgtcgctctactacgtacccggacagggaggacttaagtgatctcgagggctgttaccacctctacaccaacctcaaacgtactgtgggatatgcaacaattactggataataattacctaaacaccacgtctaagcaattaatatctactttagtgtttataactcaccaaagcaatcactatattttagttgattattgtgaacaataataccgtatgctacttaggaactaaccaagagataattctcgcaaaataaatcaaaattactcaagaagaatattacgttgaattcagagtaataaacattttagttgattattgtgaacaataataccgtatgctacttaggaactaaccaagagataattctcacaaaataaatcaaaattactcaagaagaatataacattgaattcatagtaataaacagaataaaagaagtaggagaagattaccgacaactctggaattctcccgacttcttctactctactctcttcctattccattatacaatatagtacaatagagcctcttataattcagctcaaacttggaagtgtgtgtgtgaagtgagagagtgaagcctttatatagaggtaggtattacggttgtactatgcgaattgtcggaaatgctccgcaaccaccatcacgagatgatcaagaccgcccatgccaaaacctgggatcaacggtgatcaccagggttcggccgaacctaggctgggccctcctggcctggccttcggtcggtagactcctaggaccttcctctgtctctttctcgaatttttgggttgatttactgatgtttcgatgaagttcacaacctctccttgtatggatacataattctcctcactttagtccgattttccttccaacttagggtttatcatcttcatacaaatatacaccaacacttgtagaatatgtgagattaagcacctatcactatgttgaatgttttattatctgaattttatgcagatgttggcggtatagaatcaacatttaacagccgccaagaaaaacccccacacttagccctttgctcgtccctgagtaaaggttagtgtagaatgaatttcttcaagatataaatcaagcatataaatcattcaaaaccatacctgcacctgtgaactttatcagtggctatcttaccatcttgagtaattgataaatggaatgatctcgatttcagtccttcttgcttctctgtcagactcatgggatttttataaattttcgcaaactagctcttttcctcatattgactttctttcttgtctctcaaggatgtatattttctttttggatcctcaccaaggcaaaatgtgccagaattcattcctattctaaggctgatatttgtagcttggtagggataaactgtgacatacctgcatcatatatattgcaaagccaaaaatacggactcaagaagatcatcagttatacttctagatcaagggtctttatttgtggtggaaaatgaaaaagtaaaatattttgtggaatgatggaataaagaaatgaatctccctttttcttatactttctctcccctttggttttctcggcatgaatatagaaggggcattactatatgttctttccaactttgctcaatgttttgggagcaaactttatttccttctcttttctatttttttcatagccatgcctttccttcccctttttttttattttggcaagaatttttccaagagaagaaagcatagtctaatgtaggagtttatttgaatggaatttttttttgtggaaagccatcttctagtgtagaagcttagcttaattatatattgtggaaaaatggaaatggaaatgacccctcgatcatgagagtatgaaagatatctaacacgagtcatataaatttgacaaagctcaatataatgtcaagcaatcatttgcataataaggttgatcattaatgtacttgcatatggccttgtgtcacgcccggaatttctatccaaaatttcaaacgcttacatgtgtgtgaatccctcgtccaggaatcagccgaggcacacaataacaaattgataatagagtaccattattactctaattaattaacgaataaaatgtcattacagaggtagatagttcctttcaatcaataaagatttaagcagcggaaaataagattaatggcgcagacggctccactccacaggcagcttgaccagggctacacctaatcctccacaccatcaacatcattgtagaactcttcctttgatgaatgattgc

SEQ ID NO: 32135 - DNA, 663 bp, Oryza sativa
cactatttgtttcaattttttatcattatgtctcatcagtatctggagattgttcttttcgtttggagaaatcttgagattgttcttaacacctagaatttatttatggttgttctacctgttcactatacaatgggtgcttaactatacttttcagttttctcatagctttgatcatgcatgttaatatctatactgaaagaacatctaatctactatgcttaacatcttaagacaaaattaatatgttcaagttacttgtgagatctgctttcaaccttttattcaaagaaggccttaggcttaagtttatataagatttcctaaatgttgcacttagcttgtcaaagcttaatgacctcgtgttattagttaaaactgcatgaatacctttttgttcatcatgaataaaaatccaatatactaatatcagcacgcattcattcgtagggtggtcttggctacataagaatgatccacgatattaatgccagatccattgatctatagcaattgtagatcagttggcagtggcggagggtaaaattaatcagcggtgagcagcttgatgctctcaggtatgatccactatccagttttgttgctgatgctcaccagagcaacgttgccccactttcttttttacagtcctctcatgttaga

SEQ ID NO: 32136 - DNA, 9597 bp, Oryza sativa
ttcatacacttctgctagacccaaaatctcatggaacagggtgtgatcggtattgcattggtgatcattgagcattgataactcaattcatacgctagctacatgtcagatatttgcaattacttctgctttgatctaatagaggaaatctcagcacatgatgtcttaattgtcaatcctctaatcattatcttcagcaagcatcaatttatatatatttgtttttcttaatgttgaagcaggatcgagagattatcagcattgctccctgatattggtgcaatacaaaagcttatctgacccctttccatcggtgggatcgagaaattatcagaattgctccctgatattggtgcaatacaaaagcttttctgacccctttccatcggtgggagacaatacttagccattgtgttaggctgtgtttagatctaaagtttagatccaaacttcagtccttttccatcacatcaacctatcatacatataacttttcagtcacatcatctccaattttaaccaaaatcaaaactttgcgctgaactaaacagtcttagtctatttcactgctagactgtacatgtgtttgttatgctgaaactatttcgttgaattttatgtacgtatatcggaagcatgcgaggatgttggcagggcagttggaccaaacagtttagtaataaaatctcagaaatccactggattcggtaaccttgttgcgtacggtcaattatcagttatacacattggatcagcaaggtgtggtatagtgtgccggtatttcatacaggcggcgcgcgcaacggcgccccatcctctagtttaccaagggtgtgtttagttggggaaaagaaaatttttggatttcacatcgaacgtttgaccggatgttggaaggggttttcggacacgaatgaaaaaattaattcttgaactggccttaaaaccgcgagacgaatcttttgagactaattaagccgtcattagcacatgtgggttattgtagcacttatggttaattaggtttaaaagattgtctcgcgatttccttcataactgtgcaattagtttttctttttatctatatttaatgctttatgtatgtgttcaaagattcgatgtgatgtttttgggaaaaaaattttggggaactaaacgggccctaaagcaacggcatattagctgttggtccacaacttagttccacagaaaacaaatctgtccagccaaagattcaagaaggctacatgctccttctcaataacagccctagtgttggaatcaagttgttaggatcggatattaggtagtatcgttttgctcaaagtagtattgtatcgtaggatcgtatcatagtatcgggatactatgagattttcttttttgaaaagtttaattaatatttatattaattatatatagccattctatataaaaatatatagtaataatatatattatgcaaatatagacatttatcatgagaaatcacattggttttgatatatttaactgatttctatatatacttgagcatattcgtttacattatttccaaaccatcttattttaaataatattttggaatatcgtagggatcgtagaatcgagataccacctaaaatttcataggatcgtgtagtaatgaatagtaggatcgagaagtgggatcggtatcgtttctgcttggtaggatcgtagtatcgtaagatactagaatacgaatcgggatactgacaaccttggttggaatgtttggtgatataccctgaccaaccacctccaccttggtgtccaacttatagttgcactttgttctcaaacttacgatgttgatgaaagaggttgtatctaggccggtcagcatagagatatcaagtaatgttggagtcatcgacccatggttcaaaagaagcattcaaggtatctgactaaaaataggaagctgatggcattaaaggttcatctaagagttcagaactgccctatgggccgaagaagttctcagttgcccatcgagtaacgaacaatgttaagtggatgcggaggtaagttggtacacacttggggccggatcactccgagcaatgacccaagcgtcctttaacttactaggcagaaaaaagagagatgtggagcaatattacaccttgttactttttagcctggtctgctgtgggtatcgtgtgggtaaaaagctaggtagacgttgcagagtcatagagtatttgaatgcgttgtgcttcccggttaatggagttgtgtctatgggtggattccagattatgagcacaagttaaactaattggctaataattaatttggttaattttgttattagctcatgttctgtttaagttattagaaacaattactccctccattccaaaatataagaacctaggactggatgagatatttcctaatacaacgtatcaacgttccatttggtcctagtttcttatattttgggacagaggtagtatattttatgcttattaatattgtttaaattaaatgtttaattatgttgcttatattaaatgtgtattaggacagaccctatgaaataactgataaggtttgggtttaaacctttcaacttcttatattgcattttattatgttattataagcatgttttgctgagtaccttttgtactcataaatgggttcagatcatgaggagaaagatgctcgtggagatcccgtgactcgttagagtgggacgattatgatttctaggtcattctatgctcaggcagttcctgtggtggagttggactgtttatttgtttataaggttttatgggtaatatatggaatgatcatatatcaaagtttatgattttatatcatttcatgcgtaactgaacttcctaggaggttatgtattcgtggggcaccttaactttatctggtgtccccacaaaaaccgaaccgattaaattaggaaaaccgaaagcccacccctagggatcaggatcgagatgcataggaggttacgtattcgtgggacacctaattttatcccgtgtccccacaaaaaccgaaccggttaaactaggaaaaccaaacgcctacccctagggatcaggatcgagatgcataggaagaggatatcaatattggggagaaggcacagtctctggaacaggacagaggacgatgcatacgggctagggcgtgggtcggtaacagctaaagcagttcaaaggaaagatattattacaaagtagatatatttacgctgttactgcacacgagttatattgttactatattgatttcatgatggtactacaggtctcaagtaacacataatacaattggcacagtaacgtgtgagtaaaggttagttgtattaaaatcaatcaataacgtggtggtagctcctactcataggaactaaacaatggtgttgtctcatattactacagtaatatataattctaatggtgattttattgtacgcataataatataataatagatttgtgaatatgcagtaagatggtttgaagtgtacagtaacaaacatcgcattgtagttattacatgttatgccaaattctacatcaattacaacggattttccaacaagccgtacgagatctagttgtttgaatactagttacatttccatacgatttgtgctaatattagcattctcaggccatggcatgaaagatttgaattagttaggccttaaacttctatttcctttagaatttaggcattattttttccccttgcttccaaaaaaaatagtaaagaaacactaatgacaacccttcgagttttgcgtgaaggctattcgcattacaacagtcgatccatgcggcaaactttatttacctaaccatactgatattggcgcacatccatgctatggctgtggcctgctttgcactataaaaatatctttcccaaccaggcaaccttccacatcctgtgcactcccgaacttctgctccagatactggccaatcgcagccagtcgctgaccaaactgcttcctaaaggttgtatcaaccgacaatggcttcttgctgtaatcaacagtaagacgaattacttctccattggcaggaccagagttgtgcaccaccatctcctcactgaaatttgaaaaggcaagagtggcaacttttccatcgaatttgttacatgacagcctccacggggtgccacgggttcctgaagcaagcgtttcacccagcccaggggcgacctcagcctggacaaccttggggtcatggtcagcggggcaaacagtatgaagcacgaaggagagatctggctgcagtatttcttggacaagaacagccattgtcgcgtctctctgataaacaccagcggctcgacggcttaggatggctctccttgtgtataaagaagcccaaaccttcccaaccgcagctccaaaggcacatgggtccatgagactgacattgggaattgaatcatagagaccagcagctgacataccagccaaatcctccacattagcactagatctaacaatcaaccggacatcctgtgggaagattcttttgagaaatataatagtctcctccggtggggaaagatgtgaaattattgcttgtagctccaacgccaggctatcaacttcaccattttcgactttggctgtttcaatcttttctagaaggcttgtaaaggattccagtgatccacttttcttgagcgcatcctccattgatccaaatggtatcacagcaccagaagggactctaaaggctgctggaactccttgatcactatagactacacagcagtaaaaaaaatatcagaaaataataattagaagtcttctcttatgaatttatcacctagaagttttccattcaacaaacattagcagtaaacaactctataatatcaaccctgtactagagtcactacaattgttttcctgtgaaccatatgtacactttccatcagttaccaacttaccatggatagcactacattttaactgtcttggcaaactgttttttttaataaagaaaatacaatgatacgtgcacttggatgatccaccaaattatgcacagaattgtttaccttatactttgattacatacaaaatcgtgcagtgtaatatatcctagtattttctgttcaaaactttcgacttccccattgataataattggagcttatttaaatacttgtttaaacttaaagtccctcgatatcttgcaaaccttgtaaagttccatttgcaaaagaacttagacaaaaaaaaatttaaatgaaaacttgatacctttattagacaatgaagcaagaacagaaagagttctgcatgcagcagcttttgcaccagctgattccactgaagcttctgaaagctcaagagcagcaaaactaccattcactcctgatttgcttttttgctgtggcaatgcccacggaatgaaaaataagtaagagcaactgcaacaagaatgcaggatgcatctttctggatgatccctatcaaagataagaaatgaagcatcaccttagacatttgcagtggcatctcgatatccgatggtagagagaattcattttggagtttctgttgaaatggattccctgtactatttggttctgtagagacagcattgtcatttttttctgaaactattgagagattgacattgatggatgatgcttctaatctgtaagaaactaagttaatttcagtccaccaaaagggaaaagagaagtcctagagatatactgttgagagaacaaggccaattaattctcattaaggacgagaaagcatctatggaatttgctaacccaaatacacaagtgaattttaaatcgcaagtctgttacaatggtagatgaaaattcagagttcaaagttcaatctgatttaaataaaaactgaggccatttttggaagtgatatttctcttagatttagtttatgcttattatccaagaataaagcctaattcatggcgtgtgctggaatattcttctacactttattcctgcaccttttctatccccattcgttccttttggcacaactcagtaagttggagagtcatgacatcttatgtagttagcagggagggaagcaccattggcccacaatgaaatggatatgcgcatccctagttggagaggctgcaagttatccttctttggaggaagcaccaacgttgcagtggtgcagtccttcacccactaggctcgcagttggcacagtaaccagaaattatacttctattatctacaaaacctgtagatcgtacaactcatgattccctactgtcatatttttctataaagattactagcaaaatgcccatgcattgccatcggagaaaacaatttcaaaagaagtgaaaaaaaatgaagtatcaataatgcatgtacatggtagtcgtcatcacaagacatgtgtgcttggttgatgaattacaatgaaaaattgttatcatttgtgaatggtatttagttttgaagttacgaagtgcaatgctttgatgtagtggtgcggtggtgcctgtgttgactaacatgggtcagcttgtgaagaatctattcccaatatggttgtttggactattgatacgtaggaggcttggagttaaccttgctaccggtattacgctaagagaagagccaaaacacattggcaaacaaacaccttacatcacgattgatgtgatgggtgtaagtcgatttttataagtggcaaaaaacgagaagaaaatatctagagaaatggaaagagaataggagaagaaatcaaattttcaaatcacaagggacatcatatgtgctttgtctgcttaggctactgttcctgtggaactattcaccacatcatgcatgggagaggtgatgagatcttggcttacggaagtaggctcatcggccttggtgggtcatggccagctgaggagccagccatgtgggggcagggaggagtgaggctccctcacacagtgtaagggcatctcccagcgattgagttgtgtttgagaccagcacagctacggaggtgacggaccaaaatttctggcagaaatgctatcaatttttataatagtggagataaagatatggattacatcatgatataaagcatttatgagttagctggtttaaatagcacaactagatattcgaaacttttaacaagatactgaaaacattcaaccacacaagtcgagattaaaatttcagcctgttattcaatcaacgattcaaaatttctagcagagcaattttaaagtgtacaccacatacaaatctaaagtcgcaaacaaggtcatagttgtcacttaatcgtctctcatattaatatttgcacaacacacaggaagaatcatgggcatatttgtcacttgaacaaataaaacagaaacttcaaaagatcaaagcaaaagaaataacatttccgatgagaacaaatcattagaacagaacatgacctgatatattttccctcaagcaaatacacatctgtaactgtgtcatcatattcacaagttacaaatacaacattctcctgtaaatatatcaaaagtagctttcagaaacggcaccatcataagtaaaaggaaatgagtgtagtaagactaacttgacgagctctaacaccaagatgtgaaaggtgaggtagttcctgaagaagaataacaccaactatattatccccagcagctttgacctatcaaataatgagcaaaaccatggtttatcagttatgggggtgataagatcagcaaataagaacttggcgctcccaaagtaccttttcatctccatcagccttatctacaattagaaccacaggttctttgacagatgaaggtaatgatccaggaagaattctttccacctgaataaagaaatcgtttccacaaaacatagacaatcagaccagataataactcaggcccaggaaaaacttctagttggactgaggatattataaccattccttatttagtaacctgaaggaaatgtctcttgcaaggcactggcccaagctgatctaatttaattagaaatgaagcatacaataatttacatgcatgtttatgaaacaaataaacatgtactatctccaacagaaaacaagaacctagagagtagaaaaatggaaacagtagaaatttctatatgtcactaatgaaaattgaaggcaccaaaaacctagatctagttacttgcctgtcacaggaaaataaaattctactcagaatgccactctgacaaggataaagatcttggttaatgctaaatgagtcttatactcctcccaaaacatgtgacgtccacccaaaattccaaatgtgtaataaaacttcagagaataatgcacagaggaagggtggactgtgatagatggagtggaaaggactaggagactataagctaggatgatgaatatttgggagaagaaaacatatatacaaacatgtctttgtccataaaaccacacatttatggtcatgatattgcacttcctgtctgaagtgccctaagctaaggttcccttgctctattgtaagtaatcaggttggtgcaacagaagatgtcaaggagtgtttcctactgcagcaacactacaaggaaaaaaaaattgaggtctctctctctctcccccttgaccagagagaactgagggcaaagcaacctaccttgccaaattaccccaatcagtactcgccctccctccctccctcctccccccccctccttcctctctctctctctctctctaccagagagaactgagggcaaagccacctaccttgccaaattaccccaatcagtccctgggctgtgtcaatggatatgcacaaaatttcatattaggattatggtggcaactcaggaaacaaggcaatgcaaacagaaggaagttcaatgcaagaaagtctgctgcttagtacagaaaatacccgcatcagagttccatgggccactccaggaacaagaacatcccagccagttgatccaagtacttctcgaattgctttctgaagtactgtgcatagtttagatacctgaaaaacaatgctagacatatataaaaggttaggttcagaataattagattgattacagctccagaaaaccacaatttccagactctgtacagaaaaggattacccagcacgaatttctgcctctgtgtaagttctcacactgttatctggtattccaagggctttcccaataacctattaacaagacagccacacagaatctaagtttgaaacataaccaaacaagacaaaaagtctgagtgcaaaacttgtatggtcaaatatcacaaaaaaaatgtaaatctttaggaacgaccatctgagtaaagttgtccatgaaccaattttccatgcttacatgccactgaaaatgtctgatcccagatatgcccctgaaattttggttcttccagttttaccactgctttttaattcatgcctgaaattgcaatcattgtcaatgttgcgggatcagctcagctgacgtgccaacaattgttccgacatggcagtcctacccttgctttactcaacatgtgaaaatggattgaca

SEQ ID NO: 32137 - DNA, 942 bp, Oryza sativa
cagtatccaggatttagctcacacaacacaggtgtttgagctgagtgggtttggggtggcgaatgtgtgttgccataatggcagtcaaccacaccaacaggttgtactcagcagcttattatactatgcgtttaagtttgttggataataatattgacaacattgtatcttcatatttgtttcatttaactgcatgcatacagttgtgcatgctgatcaggatatatgcatacttgcagcagaacatgaagaagtaagatgtgattttcatgagtgcaaacagagcacaaacttgtcttaaactcttattttctatgtgatatttttaacaaatttctgcaacatgtgttagttttaatacaatggcgtaaatgcgagtaataaacctaacatggtgacagaacaggaatacgagacttccctcacttgcaaagcaagggtaaatttggcatttcccacctctcacaccaagatttaacaccagttggtcaacagtcacattttcaggcaaggattaaaacctcttgtaggctaccgattttatcttgttagactaaagcagtgacaaataaataatcgaaatttcagtggcatatctaggacaggaaaatttatatggcattaaggaattttccatacgaaggtttggtttgagtctgaagcaggttgtgataatctcgttcagtttagcagttaaaatgctattaatttcccgtgtccatctagctactcttttttttaatcaagttgcgaatgggtttatttttttcagaccatttaagatgaaatgtgacaagaaatggggaaaaaaatgatttatctaactataacctgacttaccaagcagtaatattacacaatggtttctgttttgaaaagagcaaaccataccatgataacagcaaactaagcctacgtcaaacaatatgaacatagttgtat

SEQ ID NO: 32138 - DNA, 652 bp, Oryza sativa
tttaaaaggatccccaagctctcctctacccgtcgccactctcgccttcgcctctcgtcgtccgtagcgccctagcgtcgtgtaacctagcgccgccgtcgtcgccgccgctcgagccgtgcgccgccgtcgctcctgttgtcgccgtcgccgtcgctgaagaccgccggagcaccgtcgccgtcgtcgagccgaaggtctccgccgtttcaacctcgtcgccgtcgccgtccgctgctcctccgccgttgctttggtcaccggtgagttcgccgcgtcgcccgcttcgtgctggtgtcctccgttcgcgctgcagcgccgtcgttcgccggcgagcatgcgcgcccgagccgcccgagccgccgccggtgatgacgtcaccgctgacgtcatcgggaccgtccgccgtgagccggccgtggaccaatctcggccgtccgttttggatggatcaatctcggccgttcgtttccgtgtgccgccgccgtgcgcccggtccaccgcaaaccctagccgctgacgcaataaatccctttttccttttcaaaaataattcattattgcgtcataattcaattaaaatcaatataagtgttttaatccgattaaatcttcaaaaattcataactaattcatcttagctcggatttag

SEQ ID NO: 32139 - DNA, 1518 bp, Oryza sativa
ccttgagatcatgtgggatgtcattccggtgagcaatatcacgaattcgtgttagagggacagaggctgtaaactctgacttaaatgaaggtaaaaagggatgaattttgcgaatcacgagaacatcctgcacaaacataattggaagttggcaaataatagatataccttttcccaaatgttagtctggcagagccagaatgtgctcgagagtagggctgaactagtataatctacataaatttgtcttttgtcttccatttttcaaattttaaagtataatttcaatgaatatttgggcataggagtagggctctagccctagctgccctactcctatatccacctgaagatttaactaacagtcaagcattacatagttagcagagcaatcatttaatagcaattatataaaagttggaccattttcatgtgcttagcctcagttaattgggataactaccatacgaatgggaccaaggacagcacagagaaatataagggatcttaggtcaaggaggctatcaattgggacgaagaacatgattacatgagagactagattaattatttcatattgcttgcttaatcaaaggatatccttatatagatatgattgggtggagcattaaggggaaaaaataatagctctcactaaaataaagcagcagagtcctgctacaatacgtcgtggacactattcactctactttttaagggaacaaaattgtagtagttcatcttgattaaaggcattgtgatctgactataatcacaatacttgaaaatgctgatgctgatgtaacattttgttactacgatgaaaggggcaattaaccttggctgatgtggttttcccataatacatcatttcaagttcacggaatatttgcctcgatatctcagcatgtttgttaggccgatggtggccaccatcttcaaagcacgatatctgacctgtataaatccactgaaataaaatataaaaaaaatcaaagaaagctatgaataaactgttatacggtcttattaactccaaattatataatcctagagaggaaaattagatttataggaccattgacataaaacaattgtaaggagaaaccttcagataaatagctgagtatacaagggcccccagacgactctggtcatcaaaagattctgacaatatcccgcgaacaacctctaactgcgaaaaggaaaatatgaattaaattaatataaataattaggtagacagggttataatatacctccctacaaaacaactacctacaccggccctaactctcaatgcacaagggggactcccctctgtccgctcgcatttgttcattagattcaaacccataatctccacacatatgtttgctaacataaccaactagaccaacacggaagcactaaagtagagagcaagctaatttacattactaggatattacatttttcatgaaatagccagaacttttgaaaagatttcagtaaccactgacaatcatgggggtacaa

SEQ ID NO: 32140 - DNA, 3936 bp, Oryza sativa
  unsure (1)..(3936): unsure at all n locations
ttaaaataatattgggaaaataatactccacattaattattttattcctttaactttatagcttttaattaaaaggtactccccccatcccaaaatataaccattttgaggttgctaaccaaatactaaggttaatgaaaaagattccctttcagtcacctcaatggtcaaattttgaattgcttagattcccttcccaagcacctgactagctgaaaatgtatggattttcatgcaatgaactcagtgccccaaaaatgcttatattgtgtgacaaaattcaatcctagagagcttacaaattgataattttcacatttaggaataaagatgaatttacatataaaatatgtaggttttcacttttcaatgaaaattaggggagtacaaatgtaggattgataggagaaaggtccgtaaaaagatatcgtcagtttgaaccttgctctcttggatgaaaagcaaaacccttaccactttgttggcattgttttgttgtgaggtaatgtcttccacatcatttttgagtggtgcagaggtcagtgccaagcattggcattgacctctgataacatgacaaactcacagaaagagctcaccagcactgaggcattatagctcaatgcctttgaggctggatctgagcaaagggtacattcctgcaattagttttcccaagaaaccagaaagtgctaaattacaaaaagttcaggacaaagagggttggtagctattctgcactgtaatggtgtattgcattgtcataagataagcagatttttttcctaaactgcaaactagctttaaacatactggctttatggtggctacacaaaatattccgtagcatggcataaatatttatttcaaaccctgaagagacagaaccgatcagagaaataggcgctgcaccacctttactcagttatattctctccaattccatgtcaaaaacagaaaaagcagtaaccaaggtttggatctcaattctcaaatattggtatcaacttttcttattgttttcctgttctttccagccaacatcacctcctgctctagctagcatgcactagctagcagccaaggtttcgatcccagtctatgtcacattttatcaaacatttaaccatcaaatgttctgggccatcaaaaagtttggatcatcattaggcccacatattggctgaatgaaatattgttgcctggttttttaagctaaggatcctggttttttcttgttcaaccgatggtccaggccaggaaatagtaacactatttcaatccactcaactggtacctaaaagtattaaacacttctaagtactatccaggaatggtataaaaaataagtatcgaacttctgcacgtaaataaataaataaatggtaaaaactactccctccgtcctaaaatataagaangtttggttggatgggacactaagaatatggacataggatgtgttccatccaaccaaaactcattatattttgggacggagggagtacatggaatataagacccatttgaaaaggaattaactataaagcaactaaccttccgccaccagttcctggagtgctttatcgccctccaccagtttcagtgctattccatcaagcccagttgtatcccacatcctatcagcctccttattcagatgctcatttgatctcatgaaaacagttttacttccttgccattgcccaccaaatttgcttgactcggcctctggtgctggatcaccattctcaacaactgaaatatcttgaactttttcaggtgcaaaagttacagatgctgaagcatcctcgccagtattcttttcagcttctccgaccaactcaaactttggtgttcctaaaagttctaatggctcttctgttctattccagtggcatactatatcaaacttaccatccttcggcagctcaacaacacggttattaccatcttcccatattttatcttttcctcccaccaaaaatataacaaatttaaactccacaagtgtttctccagggagcttaagctggcagacccaaccatttgtagtccattccagttcaacctgctcctcccatgaaccaagctcctttgtggaaccgataatgcctacatgctcaccaaacttaacctggtgctctagacaaacctggagatgcaccaatggctgctttgaagaatctcttctctttttctcctttgttctgtacaatgtacagtcaaattatagcaactgtaaccaattaattgtccagaaaatttaagtttgtaaactggaaagtaaatgtgtgcaataaaactctttaaaatgaaccttttcaggttcacaattttagttaatcacttgaagccagaaaagaaaaggcaaaccaccattgtggaaaaataataataatgacagacagattgtcaaggaatatggagatagtcagttagtatacagaagtctagataatgaaattacgttacattatctctcattcaaaatttaaatagcaatcaagtgtaaccatgtttcattgatcctgaaggaactataataacttaagtaaacaaataacgaatgcagtctatctcagtttattatgcttttattttctcatataccgctacgttggtccaatatttggcatttctttgattgatcccttggttacattaggtagacttgttgtgttgttgcttactagtttccatataaacttgttctattgggctgtatcacaagtttattagtagcaatttccaatcgtacgatgttgacagaactagagttgcaatggataatatccaacacgaaagacatctcggaacaaactatacaatacaactgcccccaacacacagagcttcgctctaccaggtttattgcacgcagcctcatgaaagcataagagagaggaggaaaaaaagaacaagatatcacctctctgccgccgaggccgcggatctcccgcggcacgcgaagccgcgccgcccagggagcgccatcgctccccggcggagcagcacacccgcaccgactccgggcggcgggaggacgagaccacggcgcggcctgccgcctatggagagcgaggtttcgaggggccgcagcgacgtcattgatcctcctcaacggcaatccgccgaacaggtggcggtcgctcccggaaggcgtcgccgcgtcggtttgttcgagaaggcacggagggaggggaggaggaggatctggggctcaaaagcaagcgagcgagtaggcctcggaccgcgtgcgaggaggatgcgctgcgaggaggacgggtggagtggaaacgagaagaggggcgagacgatcggggtggtgccgtcgtggcagactgacaggggaggggaggaacgagtggacgggccgacggggttcccgtgaccgtttgaccggccccatgcgcgaccaccgtacttatcatatattcggacctgtttggagaaagtttaatagtataggtaattattagcttcaatttatctatagctaatcatatcttatttatataatagttaactataaatatatattatatcatcaatatatagtcccacctctcatacacactcaacgtattggagtccgttctgcagtctgctacaaatatgtagcccgttttcgtctctctcttctcttctctcctccacatgtgcttacagttgacttaggagtccattctgccgcctgctataaatctgtagcccgctttcctctctctcttcttttctctactccacatgtgcttacagctgacttatagcatgttattgtactcgctcttagcatgttattgtactcgctcttagttcacgaaaagaaaatttttggttgtcacatcagatgtttgaccggatatcggaaagggttttcagacaccaatgacaaaactaatttcataacttacctagaaaccgcgagacgaa

SEQ ID NO: 32141 - DNA, 12482 bp, Oryza sativa
  unsure (1)..(12482): unsure at all n locations
aaaatggttaaaaaatcatattgatctattttttgaaaaaaatagcgaatacttaattaatcacgcgctaatggagtgcttcgttttccgtacgcgagatatgtgttgccaacctagctgccgaatacaaccttaggccattcacagttcatcacactattttgaggagccttagagtgccatgtaggctaaagctacgggtccaaaatctggttcatcacagtgcaagtggctctaggagtggctttaattttactccctccatccacaaaagttagacatatttcacatttgagtttttccaaataagttgttcctatttgtagtctttatgcattcaagacttaaagacttaaagaagagataaattaaatgtttgattagaacccaaggagtcatataaatactcattggttgcatggtagcattcgcccaccaatttatcatatgcctctattaatctagtcttagcatatcgatttagctctatcggttgcttcttgctttagggtttctgctagtatcggctaaatcgtcttgctagattagattagcttagacatccaccaccctgaaaatcagtcaagggcttgattgtttagatattgtgtttcttttcatacttagtgctgcatcagttaagtttaatctactaagtcgtacttaaaaccataatctctagcatactttttgattgccaataagggtttcatcagagtttcagccgatgaagtatctagacgtcgcatcggcttgtaaggattacatactgttgatgtgaaaacacgacggcctgggagatctgcttaactccagtgcagttccaaagctaggctcgagtgtgtcaatgccagctgatttgatcctacaatcagcaagaaagaataaaagcagaatcagtcgatcgatagcgtatcagccgacggagttagaccaaatcggctatggactggatatatcaaagaataataaaccctaaacatacccaatcgactgtaatactatctatgagttcaatagattgatttaagacaatattatgaaagtagtcaatgtgcagtctgttgacggtcattatcgatcagttgcgcccgtcaatattaccaaaataaaagataactagttatgctcgcaatgcatatttatgttagaataagttatattccactagcactaggattctaacctcttcaagagaataaatacaaaatggaggagaatcagtagcaaaacatacaatcgatcaatcagacgctatcgagaatcagacttgcggacaagtgggctgagaacaccaaattgacacgtccaaaacagcccaaaattcacaagtatacagaaaggagcaaaagaggaggccaccagccgagacttgcgaacaagtgggctgagaacaccaaattgacacgtccaaaacagcccaaaattcacaagtatacagaaaggagcaaaagaggaggccgctagccaagattgtgctggtttggcctagcccatgaacccgccgtgcaaccgtttgatgcagggctggcgctggacggtctagatttcttccctacagcggttggagggtattaccgcacatttccaactgccataaccatcattactaggctatttaaggccttcacctccttacttcttccacatactcaagcaaggggcttctcatacattctctcaagttcagttagtctctacaatatagtggaatagaaatagaatagagtcttcagtcctcggagttttcggaagaattcgggtatggctctagtagcttttccttcttttgtaagacatgtaatatttatagaattttcttttcaatatatttacgatactttgcttcattctaatcatttgggtaccgacttttcgatatattattcgagatatacttgtctagctagcttactcaggagatgcaattatgtgggtataatgttcatttatatgtttgcttatttcatgaggatgatagtagagtagtatttggtagcataagcgaggtgcttaggctattgaatattattatttggggttatatgctgcagaacagtagaggtgggccgctgatggtgatagctcagtatgggtattcctccatgttagtatataatcctaagttactttcctgtggagggtactcctccatattttgccccatttggatggcaatgaagggttgtcgtaaggaactcggcaaccaggggtggtctctcgaaacgccaggagggcatcgtaaggggggtattggctatataactatatagtagataatattgactaaagttgtatgtatgtatattagaagtataggaaatgattattttcttattcttttccactcagcctagaatcagtatgtatgagaatatcgagtgcttctgctttgtgtcactctacccttgaaatgaattaacccctgcttagattttgattatcacaagtaacatataaatattagcttggttctctctattataatcttcccatgggattaaacaaatacgatacccttggaatacttttaggtaaaatgctacaatggtatatccgtgcgcttgcggatatggtctgtaaccataatataccatgaatatttctgtgctattgctaggaattatatttctagtaatgtcgttaagaaatacaaccacagtccaacttcgaattcagttagattcaacaccaaatccgctttgatcttctttcttcttctccgaatttgctgccaaattccgttgttaacacatacaagttagagttagccgatcgtaacagaggtttcactatttatctaatctcgtggattttatgacatcggacctctagccgatgtatgctataaccttcggatcagtgcttattctatcatatcattattagccgattggtttctactagattatattgttgttttgttacattatcatcagctgattgtctttatatcatttatttactcaagtatcagactctgcattggacatacaaccgattgcttaaaaccctatcggcatcgacatacagccgattgcttaaaaccctatcggcaccggctaatataggcatcggctggaattactccatcggcttgatcagctcattgatctactatttgcatatcttatcagttgcaggatcaaactgactggcacgcccacatctcatcaacttttggacctgcactggagctaagcagatctcctaggctgttgtgttcgtcgacttagttcgtgccaatacatttccggcaccatcaaccgagcgtggatttttcatcaacaccaccccaccgtcggcgcgctctctccctaccaccacaccaccggtgcacctctctccctaccaccccaccgtcggcgccacttttcctcctcatctccgccgggctatccctccaccttccccgtcggggtgtcggcggaaatcgagcgacgagctcggcaccgcgtgcggggagaggcgaccgaagtggcggcgcccgggcggagaggtggtcgaagcggcggtgaccccgggcggagaggcgccggatcccccctctctcctgtgggatgagctcggggatgacgcagcggcttgctggaactccctctctcctgcgggatgaactcgacgacaatgcgggcctactcgcttgtaacgtcccgcctctcccaggccgggaccacttacatctggcagcttttcttggatatagactgccctcacagacgaacacaagtcttttctgcacactttgtcctcactcatgtgcacaggggaagaatttcctggtcagtcacccatcccgaaattgctccaggccaagaaaaagaagttgcaacttgttggtatgagtattctattaatcctattaaaccctgggccaggatgtcacatcgctcactcgtacacacgggacggcaaggacaagcgcaggaacgacgaaacgaggtaacgacctccacaacgtgcgcaagtgctcgctcctcacgccgcttgccctggatttggccgaggaacacgtgaccaaagttggacgcgcggacttcaggtagatgcggcataagctaatgtggcgtggaatattcgttcgggaacgacgaagccgaatgtcaactagactgtcacacccggagtttctcctttttcgtagtttctgattcaccaataaatcgtctatagaaattactttggttaaccaggagaaaacccaaattaacaatgtatttaataattggaaatgtcagggagaatttttttcgaattctctttgctctaaaatcattaataggattttagagcaaagaatgttgttaatttaaattgtaaagatttgacttaataataatctttctctctcacctttggtcatgaatagtgcccaattcactccctcttcgtctgcggtttcgttttgcatgatgagtcgggtccgtttctgtccgcgggtccgtttccgttcttttccaaaaacggcaccgcatttcttttccaatttgggaaagtccctatcctaatccttttcctatttttgtcctcccactccctatcggcagctgctccccctctccccctgccgcgcgccgccctcccctccccgagtccgaatcggcatcctctcccctctcctttgccgactcccctccggccccatctcttttagtttttcccctctcctataagttagaacccctatttttcctattcgattttggtttagccctagccgccggccgcccaccctagcgccaccgcccgccgctgtgccgccgcctcccgtcgtggccgtcatcaccctagcgttgccggtaatccgttttccctctccgtgccatggctatcgccattatctatccagttctaatttatctttgttctaagttttgatctaacatcgccgtcatctctgcgtgttgccgccggaccgtcgtcaccatcatcaccctagcattgccggtaatccgttttccctctctgtgtcatggctatcaccattatctatccggttctaatttttctccgtcctaggttttgatctaacgttgcagtcgtctccgcgtgttgctgccggaccatcgtcgccgtctcctcctcgccgatcatctcggtttggtgaggaatctatccgtaatctcctgttttaggtgttaattcttttagtatcgttgttgaaactctagttttttagccccgcgcaaaaccctagccgccgccgccaccgctgctctcgcgtcgtcgtggtggtttgccgctgtgccgtagcttggtagccgagttgcaaagcgtaggtgcatccctaaattcctaccggcctatcgtttgtcgtaccgagtctttgccgtaaatcgtgtctagttttctgttgtcgttctgagccatcggttccgttcgccggttcggttgaccgtttggatggtcccatgtcatgaagtattggctcgttgagtcattaattcatgaggctcgctgttgatgtgaaaacacgaggcctaggatatatgcttaactccatcgcaggtccaaaatcttgccttttaggttcgtgggcgtgccagttgatttgatcctgcaatcaacaagaaataaagacaaagaaactgtagttaaatccaaaaatgatagccgatcagccagccgccgatgacatatcatttatctccgagccgatgtcatatgtgaatcgatcgatagttataaataagtaaattaaaactaaatctactcgatcggctgtagatgttaacagtgcataatttttatgtcgatatatacttaaatcaagtgattgggatagattggtcgccatgccgagacagtataaatcacttagatcgaaatatatattaacaatgagattatagatgttcacagcataatcgatcagatagatctagcgcgtatcggctaatactccgataccactctatattaagatattaaagcaagtaaaatatatcaaacaaaaagcttaacatatctaaaaagcaataagatctcaatataaagggcagatttagcatatcaattaagcacatgaaatataaggctaaatcaggtaagatcggctgaaaccccgatactactctaatcgacaaccaagaagcaggctagagattatagttctaagcacgacttatgaggtcaaacctaactgatgcagccataagtatgaaaagaaacacaatatctagacaatcaagccattggaagtttcgtagagtggtggatattctatataatctaaatcaacatcggtaattaacctggtcggctgcctcctagtaacagatgttagcctattagaggttaggtaacgatattgccggagattatatagaatatatgataactcgacaacttacatgcacaagattagagtgtcataatgatgcaagcactaatcccgagaacacaagccgccataacaagtcgtacctctagttgaagatcgaaaccgatgcagctcaacccgaaagcaagaactcatcgaaacaaaacgaaagtaaaaggtggcgatgcgccgagattgtatttgaacgtgtgttaattgattacatggggctcgaggtctatttatacccgagattacaaaatatgtccttgtcggacacaactctcatctctaacaaactctaagataccataagtctttgcggcagacttttgcccacacttatctctaaggaaattacataaaatatcctaattaatagatacaattgccttcttaggactcaatccacgtgtggcaatccatatgaagcacattaattcaacccgatgacgtacaccgtgtcatattgttagaatcggctgtatcggctaaccctgttcgactcgaactctgccaatcctgtctgtagccgatttggatcgtagccgattcttgctctgtttccgcaacgatcttcgtcttggattctgctttgatctaatcttcttttccaacactgatattaccaaatttggtcgttaacacatgccccccaagtccgaaatatttggtaatgtttcggatttgccatatgtcgactccgagtgaaaatcgcacttgccgttttccgaccgttactccagcgctttaaatgctaaccgtcaccttcgagaaacttcacgctgtttcctccgttttcactgctgaagcaaacctagttttctctctctccggcgatcccctcggtgcgctcggcgatttcaaggtgatctcctccccggccaagcttccgctcacgatgatgtcgacctctgccggcttgtccgctgcgccatcaaccagcccgtctgttgcgccgtcatccaagtacgcagaggtatgtatccatcggctagatccctttttcccgtgcagtagatcgattttcttcatctcatcttattttcttcttctctatctcttttgcacttgtagcatcttaccaatcttgttgcggttcccagtttgtcgcacgaccatcagtactttctcggcccaattggcaaccttgacccctctgaatttatcattgttgagaccaacagaatcccctttagactggccaacccaaacttaagtcactggaaaaacacctttaaatcatggccatctattgagaaaagtacccccgagaaaagctggcctttgtggttcgaatgggtatcggctagcaaacaagcccactgggatgaaatcggaatcagccaagcgctagcccttactacagcaaatttggctaaggatgagcctctgatggccgctgcaatctacttttggtccaacacccttaatgccttcttgttcaaccaagggccgatgacccctactttgttagatatcatcatgattactggtctggatgtgacctcatcggctaatcccatgagcttgaataccaaaagcacctttgaattcaagaccaaaagcattagggttggtcggggtatattgtagcatacatgggcaaagggccagtcacctctcgagagcatgtagcttttctactgatgtggttggagaaatttctttactgtggatcaagttgtggccctgcaactgtggagattatggataccccatacccacactgcatggttatccgactggttataggggataacttatatctatggaatatataacggatcatgacttgggtattacgtttccttgtatattatgtaacggcctaaagtcctggtttgataagattgtaaagtagatttaggaaatcaataccgtattggttaaggtttctatcttgtaatcctgccccccgtcctatataaggtgggcaggaggccctctagggggcatatgagcacatatgatcgtcagatctaatacacccggcggattcaaatccccaaacaggagtagggtattacctcacattgagagggcctgaacctgtctaaatcctttgtttccgcatccatccacttttaggtctcgtgcgctacccccttttattattgccgaattcatgttttgacagttggcgcgccaggtaggggttgcgtcgaattagccgtcgaaaagtgtgatggattcaactccataagaaacgccaagatcaatctcaccggtttcgacgactcaaatcttctatcgggtttgtcgttccaaataaacttttattagattaattttcaatcattatttgatcttcttacatttattggtttttttcatgccaactgagatcgtgacgaagcagtcggcgacctcgtgaatccaaccgacgtaaatttgatcacgctttgtgctgatctatacgccggcacatggcccggtgacagtcttcatgcatggagcatcgccggttataaggaacacacgtgcttatgttgattcaatcaacaagcacgaccaacttaatcatgccatatatccaatatatatgagtctatatgtttctttgtttaataacagattaatctactaatcgctttcttttgcatgttcgtatatgccgatcaagagcaaccatctgtccatgacagcctttgactgctgccacacgcgcgtcaactagcgattgttctggccgggatccatgtccgcgtgcacccacctgtcatggcgccgtcaatttaatcctccatgccagcatgcaaaagcatgcatctttcgatacatgtacatctgtactttttattactactaatctcagtttgatgtgtggtttattttttgcatgcaccctggtttcccgagtccgattccctatgacttggtttgatctggctggactcggacctgtgacttgtacgtgctcatgacatgcaggagcatgaatcggtttaatgatctgcttgtgtggacgcatctaatgttcatgctacatgagatcaatcggccaaccaaataatatatgcatgcttcatatatgcattgatatatgcagacatacatccacaagattaattttcttgatgctaattagagatttcttttgtctctttacatgtatcgccggccgtctccatcgccgctaactggtgccctcgcctacgcgattggatggtcacaccaccattgttgggcatctacgtcttcaccgaccggccgcctcgtccgccgccgactggtgtctccgcctacacggctggcctattatgccgctgttgttgggcgtctatgacttcaccgtcggcctgcctccgtcgccgccgactggtgtctccgcctgtacggctggcctattatgccaccgctgttaggcgtctacgacttcaccgccggcctgcctccgtcgccgccgactggtgtcctcgcctatacggttggttggtcacaccaccgttcatgggcatccacgtcttcaccgactggcttgccttagccaccgccgactggtgtctctgcctacacggctggcctattatgccgccgttggagggcatcttcgctttcaccgtcgaccgccttcgttgccgctgactggtgtcttcattgttattgatggacgactttgttcccacattggccacctctgccatcaccaaggggaatattacaaagttgagtcatcatttatttcattctttatatgatattttccttttcctctgcctcactatatcaactggttcgccgttgactagtgagtcgggggctacagatgttatatcatattttttaaacaatttttataatatttatcttgattgcttgcgatataatctgagtacaaaagtgcctatcgagttatggagttctatcttcctatgctttttgtttggtttgccgatggatagttgcctttgggccgattcctagcacccgggggctcgttggatggaccgagtaacgcaaggtgctaagtattattcggaataaatcaaaagcatagagataagataaatttattgtttgctcttaacaattgcaaaagtacccgagtagtaaattctgatccgtgaaactttgttccattaatgacgaactcatatcactcatatgcatgtttgggaagtgcctaggccgacacccgatgcttgggggctatgactagtcgggcagagtgtttaaacgtaatgagtcatctgctcggggaaatcaaaattgacaagaggagaaaaacatatttataaacattttaaaatgcttgaattttcctctagtattgtatttacatcagatactactcatcctatatgtttgttctgtaggatccagatccagatatgcacaatagggattcatggctttaagcttatttcctacgcttcaggaataggtcagtcagaacatcaccaccggcttgccttcgccgccgccgactggtgtcttcgcctgcacgattggcctattatgttgccgttgttgggcgtctacgtcttcactgccggcttgccttcgctgccgccgactggtgtctccgcctacacggctggcctattatgccgccgtttgttaggcgtctacgtcttcaccgaacggcttgccttcgccaccgccaactggtgtctccgcttgcatggctggcctattatcccgccgtttgttgggcgtctacgtctttaccgcgggcttgccatcaccgccgccgactggtgtctctgcctgcacggctggcctattatgccgccgttgttgggtgtctacgtcttcaccgaccggccgcctcgtccgccactgactggtgtttttgtctatacggttggttggtcacaccaccgttgttgggcatctacgacttcaccgctggctcgccttcgccaccgccgactggtgtctccgcctgcacggctggtttattatgtcgccgttgttggacgtctacatcttcatcgaccggccgcctcgtatgacgccaactggtgctatcgtcttcacggctggccacgccgccgccaccacaaataggcgtcatcaccttcaacacaagctgtctacgtctgttgccgactggtttcttcacttccatggctgcatgattctgccagtgttgattggccttatagtcttcaccgccggtcatctcgtctgctgctgactagtgccctcgcctctacggctggtttataccactaccactactgatggatatcatcgtcttcattgctggccaccttgtctgatgccgactggcttgttcgcctccacggctgcgcgtcttcgtcatcattgactggcgtcatcatgatcgctggtttgccttcgccgccgcccatggtttcttcactttcatggctgacttattttcgtcgttcaaggacgtcttcattttcgtcatcattctacttcttccgtcgccgactggttatgccgccgccgactggtgtttttatcttcacaactacgcatcttcgctaccggtttgcttctgttgccgccgactcgtgttcacttcatcacgactattcaactttgtcaccatggtggagcgacttcatctttattatcttcggcaccggcagactctattgtctctactttgtaagctttgctacttcaccaactacgacgtcttcaagagcctcgacatcttggtatgcgtcatcaaatatgatgccgtgttattttactacaacaagtggtgttccaatattcaagatttctactcggacatgttcaacacgtatcttcactcaagtgatggctactcgatgacaagaagctacaattcttgactctatgttcagttgtttctcaactaaccaaagagtctagggctacacaaataccagactcaaaattcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcagga

SEQ ID NO: 32142 - DNA, 11313 bp, Oryza sativa
  unsure (1)..(11313): unsure at all n locations
nnnnnnnnnnnnnnnnnnnnnnnnnnnnnnnnnnnnnnnttcggtcacggaaaattgtgtagtaaatgggaacgaccgttcaacgtcatcgatacctctttgcacggggcaatcacactccgcgacaattcaggtaatatattcaaggtaaacagtcaacgcttaaagattttccttgagccaaatgaaactttagatgaagaagtggatgtcattgaattaattgattatgaactatgatgatttcatctaatgcatgcttaaaaccctgtatagttgtcatttttgtgcttagattaggttttaatgagcctagggaaaaattggcagctagctggacccactagggttcgtccgaacctgctggttcggctgaaccagggcggcgcccgatcagccccaattttgaacctcagtctcccccgctcatctatagtctgttgtgatgcgcattcgggggtagatcagtcgtatcagacccagaaccctgtccttcctcctctctcccacttttgcaaacctcctcttcttctcatctcaattccattgcttcatcaccctcaattcaccagtggctggcaaatctttgatcccattcatcggctcttcctccaactccacatacaaccttgacggagagccgacaccggtgaatcaattgatcctggtggagcattacacgatggaaggggtgaatgcactgtgggcacaaccccttgcaacagtgccaggctcccctgcgattctggagctgatcggcaagctccctggttcggccgaacccttctcggccccgttcggccccccgttcggtagtgcgatccctctcccctcgccatgtcacaaggacaaaaattcggggggattcgcttgcgcgacggccgacaacgggagaactcgtcttgttgaaggcgcgacgccttttccaaaatgatgagaaggccgctccacctcccgccgagcgctatgtaggcaccctgttcaccaaggcaggggatgaggtgttccataagtatgttacacccaccgctactccatccactccgaaggaggagcgtttccacattcaaggagtgcgaactcctggtggcgggtatggcaagggtttactccggccgttaacagcatcagagaaggagggggcagcggaatcccatagccctccacctatgaaggtgaagcataatttgacaccccctccaattgtgagggctcctggccaatatcaagaagatgaggtgaagtcgccggaaccctcgatccataagctcgccgcacaagtgaagaaactccgcaaggagaacatagagcttagggatcgcaacacggagctaggggtagagcttgctgaatttagaattaatttcaatagccttagtcgcggtttgtgcgctgagatcaagcgcgcattcgtagaaatgggaaaggaaaataagtattacgctaattagatgcttcctttccatgaataacatagtagtaggtgcttggttttatttttccaatcatttaagcacttgctacgaataatgtggctcattggtgttaaccccaatgtttgccaaaatttgttttgtttcatgtttaataaaatttaggttttgaataagtgtgggggagatatctcagcttcttacgtgcacataatctgaaaattacttaatgtctgaacacctggaaggcactgaactctgcagaaaattgcagaggtattgggcaccagagtggttcggccgaaccaccaggttcggccggaccagtgttggccgtagtacctcccagttttcacaagtaagcaggtgagcacgtcttttatctgtatatctccaccatgatatagtactagagctaaaaatttagaaaacaattggttcaagcatatgtgaaagataaaatttccaactaatgaaattcttcatgtgattaaacttgtatattcatcattctcagctgaacttgtgcttgtgaaccaccatccatgtttagcgaaccttatgcatctaagtaattgctttatgtgagatgattcaagatgaagggaatccttgcaactcttgttatgactcttgggaatttgttttcaaaaataaaatggtttaaaagctcaatcctccaattgacttcatcttatacctaccaaggtgtcacaccctgaaaattcaaaatatataaattgttgcttaattggaatttttagaaatgattttaaaaaaaccctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaatcctcttttggctttgggccgaaagtcggcccaaaacccttttctccctccccggcccaagtcggcccagaccgcagccgccgcgcgcgcgcgttcggtcgctgacaggtggggcgcacctgtcggacccatcgtctacctccggccgccgccgcccgaaaccctagccgagccgcgccgccgtccccttcaaaatccggccgctcctttccttctccggtgaaatcttttgaggggaaacaatctccgggatctcctccaccttttctcttttggaatcatcggcttaatcgttttggaagttcgtggattcgaggtcgaatcggatcggtctctttcctccgaaccccgaggtttccttcgcgtcgccggtcgccgtggtccttcgccgccgcctcctagcccctttaaaaggatccccaagctctcctctacccgtcgccactctcgccttcgcctctcgtcgtccgtagcgccctagcgtcgtgtaacctagcgccgccgtcgtcgccgccgctcgagccgtgcgccgccgtcgctcctgttgtcgccgtcgccgtcgctgaagaccgccggagcaccgtcgccgtcgtcgagccgaaggtctccgccgtttcaacctcgtcgccgtcgccgtccgctgctcctccgccgttgctttggtcaccggtgagttcgccgcgtcgcccgcttcgtgctggtgtcctccgttcgcgctgcagcgccgtcgttcgccggcgagcatgcgcgcccgagccgcccgagccgccgccggtgatgacgtcaccgctgacgtcatcgggaccgtccgccgtgagccggccgtggaccaatctcggccgtccgttttggatggatcaatctcggccgttcgtttccgtgtgccgccgccgtgcgcccggtccaccgcaaaccctagccgctgacgcaataaatccctttttccttttcaaaaataattcattattgcgtcataattcaattaaaatcaatataagtgttttaatccgattaaatcttcaaaaattcataactaattcatcttagctcggatttagtgggttcaagtctctaaatttttctaaaattgagatctacatgttaaaaatatccacatgtactgttcatgcttgtttatgtgctgttttggtgattttgctctttcctgcttagattctgacgttcccggagagtccgttttcgtaggagaagattttgaagagttccaaggccagcaaggcaagtcacacagatcccaaacaaccctttgagcatattgatcccgtttaaagctattgtttcttttcaactattgcatttattttcaaatgtcattgggtggaattaacctattgtttgttatagcccttttgttctggattactttattccttgatatcttgggttattataacttgactagttgagctctatatgttggttcaactagatgtattagatataattgcttagccctgcttagaaactttagcacactattgggataactttatgactcactattatttaatgatggcttattgatagttcacgatggtcaatcgtgattggttaattaattaatgtgccaactaaaacttgataatggtgggttgtgagcacatggttttgagagtcgtgctcatgacaattaaggaccggttcacgagtttcggttgtgaaacattaaccatgccaaccacaagccaacatgggcaacggctttatcttttgtatagcatggttcattgcggggcaccagactgagaagtggcagagataagcccacgggggtcactggggagtccatgccttgtttataagggggtgattatgatccaggaaaggtgcactgtagtggattgtgttgtgcaaggggtattgtcacaactcctttccgaggtaccgtggtggtattgaggcacatggtgacatgatgtggagttgtgtcttgtgggtacagtggtacacctctgatcagagtaaaactattcgaatagccgtgcccgcggttatgggcgggtctaacaatgtctttcgtgattagtctcacacttctcaccataataaatgatgctttaattgataataatttgattagctcctggtttggaatggtatattcctggtttggagatagatctgtacagccgggtatggttgttcagaatggttgggcctatacaacagggtatgttgtatagcgttggattaatattgtttaattattacttaacagtttcattaaattctgaaatgtttattaaatgctgtttatgcaaataaaaccctactatgccatcctttgttatcctgtgcacttgcatgtttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttatcttattttccgctgcttagatctttattgattgagaggaactatatacctctgtaatgatattttattcgcttattaattagaataataattgtactctattatcaatttgttattgtgtgcctcggctgattcctggacgagggattcacacacatgtaagcgtttggaattttggatagaaattccgggcgtgacaagttggtgtcagagcccccttgaccctaggttatgccaaatggttacccatagaagccctctaaaaattattggaaaagtagaactgttctcctccccttctcttttaattaaaccaaactaatggcacatgcacttcataatctcttttaatggttctcattcaaaatctattccagtgttattagtactgtacatctattactgtactaatggctcattttaccagcaaaagttttacaatattgttttatttaatcttgatgcaaggaaataaatttagcatgttatttaatcttttggaacctgttgttcaaaagtacaaaatttgtaaccctgtttccaactgtttcaacttatcttgcaagcttggtttattttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgctcctttttatgctcagattcctcatgatcgtcatgaagagaagtgccgagtcaaagtcaccttgaacagtaatagtgaagatgtcccctcagtgatgttcgaagctagaggaagaaactacaccatgcatgtcaggaggtggcaaggatcgccataggagagctccgcgatcgctatagtgatcagttggccgacactgagtatcgctaccatcctcgccaaccccagggaagtgaccgtggcagctacctagagactgaaggaattgagaatgatgctaccacaaggcatttggttgagatgctgtgggctgtggatgaaacccgtgcggagactgtattagcagctcaagatcgtgaagaccggaatcgtggaaagatttgcaagctagaggacaaggtggatcgtttggagaaggaattagccgcattgaagggagaagcaccaccgcagaaggccaggattcgtcttaccgcaaggaagagagctctttttgtccctcgctaccaattggcgccaaaggtccgtgtggtggaaaaagaagttaccccagttctagtagatcctccggtcatcaacgtaagtgatgatgaaggagaagaatcgaagcacactcattccaagattgagtggagagcaactcaagatgatgaagacgagccgaacgagccttcaatcaactccgatgcccggaagaactagaatgccatgtcaagccgttgtcttagatcgttgtgttagcttgtttgtttaagtttggttgtgtgggtcttgcgtgtaatttacatcagtggtgggatgtaagtgcatgcgtttgtttgcttctgagtgttaggaagttggtgagtttagtggtgtgagagtcttcagttttgtaataatgaaactcacttaagatcaataaaagttaaagtaattctctgtcctaagtagttttccccggtttctcttcttgtgtcctgcccatgccagatggtgctcactcacagcaatgggaatggcccccaacaacaataacaacaacaacaacaatggagagaatcccacacttgcccaagtcctggctcaacagacacaacttatgaacatgatgatgcagcaactccagaaccagcagaaccaggggaataaccatgcacctccccagaacaagttagcagaatttcttcgtgtgaggccgcctattttctctagtaccactaatcctgttgaagctggtgattggctgcatgccatagagaagaagttggatttgcttcagtgcaccgatcaggagaaggtctcatttgcatcacaccagttgcatggccctgcctctgaatggtgggatcactttcgccttaacaggactattgctgaacctatcacttggcttgaattcaccgctgctttccggaagacgcatatagcatcgggagttgtgtctctcaagaagaaggaattcaggtcgctcactcaggggtctcgctctgttacggagtatctgcacgagttcaatcgtctggctcgttatgctccggaagatgtgcgcaatgatgaagagcgctaggagaagttcttggaaggacttaatgatgagctttcttactcactcatgactggggattatcttgatttccagaagttagtggataaggctattcgtcaggaggacaagtacaatcgcatggaacagaagaaacgccggattgctcaattcaagacacaacaggggaataatcaaagaccgggttttactttaggacccccatccatgccacaaggaggttttttgtctgttgtttgtccgcagggtcagtttttcaacaacaatgctggcaacaacatccggtaatcaagctccacgccctgttgcagcttcgacacagcaacaacctgccaagaaggagcaaggcagcaagcccgtggtgtgtttcaactgtggagacccaggacattacgctgacaagtgtccgaagccccgacgcgtgaaggttgtccctgcccagagcaactctaccgcaccagcgccaaaggcccgtgtcaatcatgttgctgctgcagaagctcaaggtgctccagatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtacccaagtaatcaagcactctctttgcaacgtagcccctctgtcagaatagaaattaaaggagtaccatttctggccaatcttatcctgttagaatccaaagaccttgatgtcatcctaaggatggactggttagccagacataaaggtgtgatagactgtgccaatagaaaagtaactctcaccagcaatgatggtcgagttgtaactgttcatgcattgtcttctgagtttttaaggtcgagactgaaccaaatanctttggaagagattcctatagtccgggagtatcccgatgtgttcccagatgatttacctggtatgccgcctaaaagggatatagagttcagaatagatttggtaaccaggaacaactccgatccataagagaccttatagaatggcagccaatgagttggcagaagtcaagaggcaagtagacgatttgcttcagaaaggatacatcagaccgagttcatctccatggggagctccagttatttttgtggaaaagaaagatcatacccagaggatgtgtgtggactatcgtgcactaaatgatgtgactatcaagaataagtatccgttgcccagaattgatgatttgtttgatcagcttaaaggtgccaccgttttctccaagatagatcttcgatcaggatatcaccagttgagaatcaaagaggaagatatacctaagacagcttttaccactaggtatgggttgttcgaatgtactgttatgtcttttggactcaccaatgcccctgctttcttcatgaacttgatgaataaggtgtttatggaatacctagacaagttcgtggtggtctttattgatgatattcttatctactcccgaaccaaagaagagcatgaagaacatcttcgccttgcactagagaagctacgaggacatcaactgtatgctaagtttagcaagtgtgaattttggttgtctgaagtgaagtttcttggtcacgtcatctcagccggaggagttgccgttgatcccagtaatgtggaatccgtaaccaactggaaacaaccaaagacagtttcagagatccgcagtttcctaggcctcacaggttattatcggaggtttatagagaatttttccaagattgctaagcccatgacacggttgcttcagaaagatgtgaagtacaagtggtcagaagaatgtgagcagagttttcaagagttgaagaatcgcttgatatcagctcctattttgattttacctgatccaaagaagggtttctaagtgtactgcgatgcatccaaacttgggttaggttgtgttctgatgcaagatgggaaggtggttgcctatgcatctcgtcagttacgtccgcatgagaagaactaccctactcatgatcttgagttagctgcagtggttcatgcgttgaagatttggcgtcattatcttttcggtactcgtacagaggtatataccgatcacaagagtttaaagtatatctttactcagccggatctgaacatgagacaacggagatggttggaattaattaaggattatgacatgggaattcattatcatccgggaaaggctaatgttgtagcagacgctcttagtaggaaaggctattgcaaagctacggaaggatgacagttgccattggaattatgccaggaagttgaaagattgaatttgggaattgtccgaaggggtttcgttgcagccttagaagcgaagcccactctaattgatcaagttagagaagcccaaattaatgatcctgatattcaagaaatcaagaagaatatgagaggaggaaaagctattggtttcttggaagatgagcaaggaactgtatggttgggtgagagaatctgcgtccccgacaacaaagatttaaaagatgcaattctgaaagaagctcatgatactttatactccattcaccctggtagtaccaaaatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaagaaatcggtatggattttatcactggtttacccagaacgtcaacaggccatgactctatttgggtgatagtcgacagatttatcaaagtggctcatttcattccagtaaagacaacctattccggaagtcagttagcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccggagacagacggacaaaccgaaagggtgaatcagattttggaagacatgttaagagcttgtgctttagacttcggtggaagttgggataagaatctaccttatgcagaatttttgtacaacaacagttatcaagctagtcttcagatggctccttacgaagcactgtatggtcggaagtgccgcactccgcttttgtgggatcaaacgggagaacgtcaggttttcgggatggatatcctaagggaagcagaagaaaaggtaaagatcattcaagaaggattgcgagtggctcagtctcgtcataagagttatgccgacaatcgccgcagagatttgagttttgaagaaggagattatgtgtatcttcgtgtcacgcctcttcgaggagttcatcgtttccacaccaaaggaaattggcaccgcgttttgtgggaccttataagattgtcagtagaagcggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccagaaatcgagttatccgcttttgcaaagtccaatggagtaatcactcggaagaagaatcaacttgggaacgagaagatgaattgaagtcagctcatccgcatttgttcgccagttcttccgaatctcgaggacgagattctgtttaaggggggtaggtttgtcacaccctgaaaattcaaaatatataaattggtgcttaattggaatttttagaaatgattttaaaaaaagcctagaaaagaagatctaattttaattaataaattcccatataaaatggggccagataaaatttcattaaaaactttggttaattctataattcctagatttttctgggatttatttgaaccaaagaaggtctttttaataaatggaattgcatttcatgaataatttaaatt

SEQ ID NO: 32143 - DNA, 1037 bp, Oryza sativa
ccctttaaaaggatccccaagctttcttttacccgtcgccactctcgccttcgcctctcgtcgtccgtagcgccctagcgtcgtgtaagctagcgccgccgtcgtcgccgccgctccagccgtgcgccgccgtcactcctgttgtcgccgtcgctcggggaggtcgccttcgtggtcgccgtcgcatcgccgtcctcgtccgccccttcgccgtcgctgaagaccgccggagcaccgtcgccgtcgtcgagccgaaggtctccgccgtttcaacctcgtcgccgtcgccgtccgctgctcctccgccgttgctttggtcaccggtgagttcgccgcgtcgcccgcttcgtgctggtgtcctccgttcgcgccgcagcgccgtcgttcgccggcgagcatgcgcgcccgagccgcccgagccgccaccggtgatgacgtcaccgctgacgtcatcgggactgtccgccgtgagccggccgtggaccggttgatctcagccgtccgttttggatggatcaatctcggccgttcgtttccgtgagccgccaccgtgcgcccggtccaccgcaaaccctagccgctgacgcaataaatcccttttttcttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgtttggtgattttgctctttcctggttagattctgacgtttccggaaagtccgttttcgcaggagaagattttgaagagttccaaggccagcaaggcaagtcacacagatccccaacaaccctttgagcatattgatcccgtttaaagctattgtttcttttcaactattgcatttattttcaaatgtcattgggtggaattaacctattgtttgttatagcccttttgttctgga

SEQ ID NO: 32144 - DNA, 7775 bp, Oryza sativa
  unsure (1)..(7775): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtacgtgcagccacagtgaagaacataaaggggaacaaacaaattgggaagagatgcggatgcggagaggacgacgacgagcggatgccgagaagtggaagggggcaacgcggatggctcggcgagcagtaaaaccacgtctcggtaagggttggccgcgcaacctagaaggcagaaaacaaaaatcaaaatcaatgagcataggcatggtcagaagaacatcgacatcacaatggtgaaatccagagcgaagcacaactgaaaaagatcaaagcatacgggatgatgcgactagggaaagtaccgtctccacaaaaaacaggaactaagaggaagaagtaaggaacagaaccagcttcgaatgaaagaaagaaaggagcgatgcaggtaccctcgatctgctcctcatgggggtctccgcgcgtatttttagtggagcagccaaccctgtcattcccgtacaccatgacagagcactaccatggatgagagaggggctgctgggcattggagccttggaggtgtcgctgtctcgctgatggccgacacgcggcggtgccgattcgctgaagcggagcggacgagaaacacagccttcgctcaatcctagccggacatgggttggagaatgggcacgcgtcaagacggtagcggtggctcgcggatggctgagcatacagccaaaccacgacgacgcaaggccgcgccaccgatgccacgatggccagtaaaaggccgtcggtcgctgggccaaacaatcagctggcccatggtagcaggaccactgtaacgaaacaacgtgtccacaccgtattggatgcgcctctccaaatcgctaggagagcagctaatctagcacctttaaggcctccttcaatggttgagctagtgcactagctcatgcttgtccacctcatacaagagatagcaaaaagcctacctttttaataggttgtctcatagcacattgttcaaaatgctttgggttccacaacccctctcatattttgtttaggagcttagctcttgaagaagagatagtgcactctctctccttatcttctctctcttctacatcatacaaaagctgatgtggagatttatgagctagctgactcatccttgttggaggaggcctaagatagctaatccagcacctttaagatatttaatatatgtgtcagatcattttcttccggatcacttattttaaactacttcatctatctcaaaatattactaggattcatttggaagtatcctccatgttaggacagaggaagtcattattaaatttattttttaaaatatttaatttattcctatatgcaagtatatgctcctatccgttgcataatccgttcaatgactatatccgtctcaaaatacagtaacttttagctatgaattctaaaaatgattatattttagaacggaggaagtagtaaatctattttcttaaataaaaaaaaaaggaaaagcgagaatgagagaggtgcccccactatgcgattgccagctagcccatcacaagaagatcagaggccttcggacgcggctttttccggcgttccgccaccagtcttctcatctgcgactgcggcgctccccttccctaccggaatccccggttttgctgccccccagcccgcggagtggtcggatccttcttccgtatgcgtgcgtggtgtgcgtggagtttggttgtcgggttcaggttaaaaccctctgtagtttccatctccttttaccacttcccacatgctcgaatcgaagtaaatcgtgtgtagtagttttgagtagaatggcgctatgctatgctatgctacgctatgctacatcgtgtacttccaattgattcacagctcgcacgcttcaatctttgtagatcagtggtctgtttcactgctgtgagaaattgcgtgtggttttgcaattcatcggtgcttttttccccctttctttctaggttttgtgtatctaccgtctacagtcaccatggttggcaagctaatgggggattggaatataaatctctttttggtagttctttttttgtatgattgattttggcatgtctgtttgccatcaccttttttttttaattaggaccaccaatggatagggttgttggtattaaactcgcaccatatcaaatcatcatgttatctttctttttcaagtattctggactcgtggcctgcttgaaggaacaagggaacttctagagggtttcctctctcaaaaagctgttttttttttcataagtgagagcagttaaaccccaaatcttgttgaaacgattaaacttgccaaagctctcctagagactggattaatttctcatggttctgttcagtatcaaagtcttcaactaaaccgtaacactgaacttgagattttttattttttatttatttttctgagtaagagatattttatatgaagttactatgatgtccatcaaatttgaacacatccagacttgtaaatttcttggtctcgtctctacttttagttaacgcagaaaatgacaattcacagttattacttgctttgcaggaattctaggaatggcagcaaactaatcttctaacctcaggcagtccatgtttttgaggtgattctgtgacatgtgtgctaccttaagtaaaacaagctacgttttcccttccgtatggatctcctaatttgttcacttggtagctttaaactggatgttattgcaaggttgccacatgcaaaacttattactctagagcgggagaatacaaacttattgttctttgttattcgattattgcaataagaaatatatggaaattgcagtaggtgcgctctgcaaaatgatgatactttatgatatatccgatttcaaggagctaggaacacaaaaacatcgctttgtaatttaccatctccaatatgttctaacatccacaatttgttgtattgctaataaattgaccagctcatgtagaatacgttaccatttcagagctagtacccacctgataagcattccttttccactaggagataagctctctattaatttgctaccctttctgcatcacggcccttattcccgttgggcatatcttttatgtggttgatataagctcatagcttttgaagtactgcataggatactgactccagaagaaactaccagccaaaataaggcaggacccaccagctttagaatataaatccccatgcttatctaatcttcaggaggattgccacttctctttcctgtagacagtctgtgataattttgttctcttcttgttggggtcttggggaaaggagcaaggaggaggaggagaccaagaacacggagtgaaagggagagggttctgttcttgcttcttaggccatatggagatccagcagcagaagggggttggcaattccaaagttgtgaaggttgagaaggaggagtcatgggatctgttcgtcaatcaagcaagcaacgaaggccaccctgtgggttttttcttccttgccttgttcttcccccacctctttttttttcgccgggcttcccccacatctttcctgctttgtctctcatgatgaatattgatgttgtttattctcaagtcatattttggtcggcccacgatttttgtaattgctgtttgtagattataattttgttagaacgatatatgtataatagtttgtggggatggatgcttcatgcaacctgatttctgtaatcatgttcttttcgttctttctgggtctttctcgtttttctttcactgtaactgtaattgacaaactgagttccaaattgaaaattttcctgatgataattatccgctgcagttgcaccagaaatttctttttactcactcagaagttaacttggttattgacccctcgactttgtgtaggttgttgcccactttggggcttcatggtgtgtgacttcgctgtccatgaactacaagtttgaggagctagctcagacacaccctgagatactgttcctctatgtggatgttgatgatgtccaggtaaccattctctctgttttttttttaaagaaggaaaccattctcctatttttggtctcatgacgtgttgtttatgcatgtatttttggaatacatcccatggtcgtattttctctgagttgttctgaattctgaaagcgaagtgtcttttgaggaatagaaagtagagaaagtggatgcctaaactgataatttcacatagagttgtctagaaaatgtccttagacttcggagctttcatctttgatgttcaattgtttctactgaatatcatggcataaccatttgttacaaaactgctatgcatatatgctcattaaattagtttactgagccaagctgctatatcatataccgtgtgcatgcagagtgtttcgtccaagcttggagtgaaggccatgccgacattttttctcatcaaggacaaggaggtggtgaacaagattgttggtgccaacccagatgaggtcaagaagatggtggacgcttctgctgagtcctttggagttactgctcctcctgatatagtggtggaatagatatatagatgttgcctttatcttcagaaacttctctgtgaccgtgggtgcttcttggtcaggtccggaaaaatgcgtccatgtgtacattctagctttgctcctgtgactctgaatggtgtccctttgaactgataggcttgtgccttgcggtagtttgttctgcaggctgcagctgtggctttaccatgctctatgaaatttacttacatgtgtttccagttgaaaaatatgtggttcagacttcagagtttagactaaaaagatttgttgacagtatctggcatgcctagtagtgctttgccttttcacttcacatgatgatggatggtgtagttccaaagcgtactctgacgatgagctataaaaattgccatgatctctgcagccaccgcagaaagtgcacatccccaggtgtaagcaagtgtcacgagcagctgatttattcattgtaaaatctgcagatcatgttagtaggttgtaccgttatcttgctgttgcagggtactactaattaatgattagcttagcaaaagctctgcatttcaatcaaaagaatttgcatcataaaaggctctaacctaaagctgcatacctaaccacacctaggaatgaacaaaaaatgcaagctggtctttggcccagtgcaacatgtgaccaactatggacatgccactggttgtcttgaggccttccttcatctttgtgctccactattcaatcatccaaaatgagagtattaaaagctaaggggaaaaaagggcaaaagagaaataaaagtaagagaattattggaccaacaccatggaccctcaccacataacctgcaccatccaattctctgaagacccactgtagcattattctgaacttgtacacttcatttatcatcttgtcccagactccagttaattaccttcaatcaattactacctttttactagatgtgtcggcagagtagtgcatctcctatcactaacagcagacaagtttaggtgtgatatgatagcaactattgtttgtacctgagttagttagatcgatgcagagctgacttactggaataaactgcagaaacgagacttgccataatctgaatttctaactttactgtagtatgttttctgctgttcatatatacaacactgactaactgaacagtgagctgcactgactgcaaaagagattaaaatgttcagaaacatgcagtcaccgatggtgatcatttcactttaataatatgatgattaggtcgtgatactaacgaacctctctatatctccatctctctctctccttcacgtgaagcctcgcacgagtgcaaagccgacagccagcaccaccgccaaaaacgcgaggcgagttggagttggagctggatccctctcgccattgctctctctctccagcctcattctcttcccctctcgtgctctctgctgcgagtgcggctgcggcgttgcatcgcatgctctttgtgaattgtgggtgagagagcggtggccggacgagctcgccggagaggaggaagaagaagaagacgacgagcttagctttgcaatgtgctgctacgtggggaaggcgaccaagatcttcctgtgcctcgcggcggcgctcatcgtagtgggcctcgtcctgggcttcgggctggcccaccggacgtggggcgagcggaaggtccagccggactgccggtggcccgactgccagctccagccggcctacggcggcggcggcggcggcggcgaccctctcccggccacctccggcgccggcgacacgccgcccggcgtcccgctgacggagccggccgtggccgcgttccccggcgtcgcctctgcttcgtcggccgcgccgccgacggcgagcatgccgtaccttgggccgcccagcccgttcgcagtgggcctcgccccggcccatgggtgaaagcaagtcgcttcggagtatattttttttcttcttttttttttctgttgtatttttcttcttctgaatttgaaatactatgatggctgtgaattatttctacagttttgagtttctgcattttaagctggtctagccttctgtgccgttgatgatcattttggttggatataaataacgattttgattccaagtgttcttcggttcatgtgtttagggcttgtttagttggcaaaaaattttatccatgcatgtcacatcggttatacaaatacacatttgaagtattaaacgtagtctaataacaaaataaattataaattacgagacaaatttattaagcctaattaatcagtcaatagtaaatgtttactgtagcaccacattgtcaaatcatggcgcaattaggcttaaaagattcatctcgcattttcctaatgaactgtgtaattggtttttgtttttgtctatatttaatactccatgcatgtgtcgaaacattcgatgtgtcagcgtgaaaatttttgtttaaaaactaaacatacccttagtgctcatctttgaagacctgtagtagtccgtgcaaaataagtatattagggtgtgtttggttccacgtcaaaattagaagtttgactaaaattgaaagattgaagaaaaaaattgaaagtttatgagtgtagaaaatttttgatgtgatggaaaagctagaagtttcaagagaaagttgagaactaaacaagggcttattactctaatcctctcttgttttatattgtttttaataatcctcgtggctgtttatatctgcttagttgcaagttgcagcacagcaaaaaatcgatcagtaaaccaggaccgtccgatgttaatgcccaattaactaagatcatgggcgttgataatgatggttagtccgaatgctattgctaacaagagatttttctttgaacggtaacaagataattttaccgttgcaattacttattcgtttcctcctttcaaaatatcagtcgatttttcaggggttgacagcccccgttgcaacgcccaatagcc

SEQ ID NO: 32145 - DNA, 19776 bp, Oryza sativa
  unsure (1)..(19776): unsure at all n locations
gcatcatactttgcgttgagaaaaaaacaatttaaaacacacacgacccgtttccttccaacacaaggcacctccacgacgatttcaagccgcgaaccaatcgaaatttccaccctttcccgctcgcccgcgcccactgacacgtggggcccggcacgtgggccccacgcgtcagccacacacgagcgcgcccccggagaaaccggcgacgccttgataagtcccaggtttcccactcgtctttgcgagagagagtttttccgattcggccgccgcgcggccgtcacgaaccagataaaatctccacgcagttcccctcaaaaagaaatttggttgattttgatttgatttgattcgtgtgctccccgccgccttcgatccctccaacggataatcgccgccgacgacgacgattcggaggaggtaacttctttactactctctcttgcaagactggtttctttctttggggttattagcggttttggttcaaatggatggaatgcttttgtgagatgttttgtttcggggaggtgtgagagggttgttgcgatttgcgggagattttgattgcggcggatcatttttgaggaggagaaggcggtggctttgggcggatttcgcttaggtagggttttggtggattgggcggttttggggggaagttttaagcgatcgtgggcttgattagggttgtgcattcctgtagtcgaattgtttgattgttgtggagttggctttgccgttccttgtcgaaggcgatgcttgcgtgatggcacactcagttcatgttgtgacaattcttccttctttcaaaattttggcccttggattaatagttaatctttcatttgtgattttctttgaatagggtgctgcattttgatcaatacacttagcctaggaatgcattagtgtttacttccttaaatagttttatgtatcagtttattgcacatcactgtgcctggtttaggcaaatattgttcttgatgtaaaaaagtgttttttttaaaaaaatatttttaggtgttatttgcaacccttgtatgcaccaagttgaaattgtatttcctatctgggctattgcagtgccccttgaagaattaaaccacagttactgctgcaaattactgaatgcatcatttgttcagacttctgacttccaattcacaaattattttgcagaagatagtattcaagtgggttcatcaagataatttgtttgcagtgtgctggagatagtgtggtctgaccaggcttgttggggattagtgaagctaagcatcgcagatatctgacaacagagagttgatgcccatgtttgctagcacaatatggatattattgacttgtgttcagacagtgaagagtacttcagcccgtactcagatacagaagacaatcttgattttgacgatcccaatgatggtgttaaccaggtggttttgcacaacacagcatttggcaataatagttcagaactactagtcgggctggatgacgataactggttaaacaacactcatgctttatcctctcatagacctgctgagaatagatcagacattattgaaagcagcagcggtgtcaacactgactgtcagaatagtgcttggcaatacaggactcttccacataccttcatgagcagcagttacaagtctcgtccactttctctaacaggaggtaacaatgttgaaagtacacaccccactgtgaagcctaacactgtgcactataatggaattgggttcccttcacctgctattgcaagtggctacaagccatatgttagttatggccagggtgtttcaattgatgatgatgacggtgagtagaactatccttgattaacttgaaaagtatactgctgtaacttgcgattagtacaactaaagtttttcccttttgaaacctgtcagatgatgtctatgaggttctgcatcaaccatttccgttcagtcattcgagtttaggtgacaagaagatcgaggaagaatccacttggaagtacaatggttttcaaacaagttctgcctatggaatcgagatgcctacatctgcaatgtcaacaggttggaagctacctattaatagcaactgaaaagttaaaactgataatgatgatgttcatgtaccataattccctcaaatattctgatgggtgatcacataaaaatagttttactagtataaaatgcgatattagtaatttttttctctctgtttgaaacttgcaggtggtgtctctgcatatggaggtctaaactcacataggatctttcctccatcagtgccatacaacaattctgttaacaattttggagtcaatggccttggcactcagagccacttaaatatagaaaagaggctttttggccgtgatgagagggtggtgtatgatgaagccctgaaggtatagaatataattgtgtggtgattcaattttattgtacttactgtggattatacctttttaaaacaaaaaaatatattgtgcagcaaatcagtcaagaaacaacggaagaaaatttgcctgaaggtgttatgtcagtatcactccttaagcaccaggtaaagtttatattttgaaaatcttggttgtgtgataattctatttattctactgatcctgttcactgctatgttcttcattattgaaagagaatagcattagcttggatggtttccagggagaatagctcacattgttcaggtggaattttggcagacgatcaggttagttctattttctaccttgataactgttacttgttttactggatcccctatcttatagggacataactttatgtgacgcagggtcttgggaagacaatatcaactattgcccttatacaaaaggagagggttgagcagtctaagttcatgtctgctgatgtgggcagcatgaaatctgtagctaaccttgatgaggatgatgaagtagtgatagtcatggacaagaagcaactgaagggtgaatctgtgaatatgctacaggattcaacactgtttccatcatcagaagcagcaagtgatgccgcagatctgaagccctgggctagtctaccggggtctgctgttgatagaatggtaaatgctgtcaaagttgaacccaagaagaaggctagagtgagaccatcgccttcgtcaactttgaggtctgctaatagatcaactgcgggaacactagtggtgtgtccagccagcgttcttagacagtgggctagtgagttggctgccaaggttactgaaagttctaaattgtctgttttggtttatcatggaggttcaaggactaaagatccaactgagttgacaaaatatgatgttgttgtcaccacatacactattgtagccaatgaggtacccaaacaaaactttgatgaggatatggaggaaaagaacagcgaaacatatgggttatgtccagcattttctattggcaataaaagaaagaaagacagcgaaccaaagaagaaaaagaaacccaaaaattcagatgctgaccttgatggtggaccacttgccagagtgcgatggttcagagttgtgcttgatgaagctcaaacaataaagaatcacaatactcaagtggctagagcctgttgtggactgagagcaaaacggagatggtgtttatcaggaactcctatacaaaatacaattgatgatctgtatagttatttccgtttcttgaagtatgaaccatattctgtgtatggttcctttcgctctatgataaaataccaaatttctagagatgcaactcgtggatataagaaactccaagctgtcttgaagatagttctgttgcggcgcacaaaaggtaaaatagaaaatcatgactgcatatgtgtctgcaactttgtaccttttagttatctgctatatgaaacccacatcccattgcctctgatgcttactaattcctgacaataatcgttggtattactcacaactatgaaaatttaaaaatattgatattgattcattcattatatatgtgtgtgctggagctaatatatatgataatacgatatcatggcaaaatcaacttttacttggaaaaatgcaacctcttatcttggatctctagcattttatggaagtcatgaaatacatctgaaaatctggaatttgtgaaggtgggaaacataattgaaagagtactatctttttgggtggaatcatattgagtaccccgtaacattctgtttatttatatgttgcttgagttgatgttttcagcttcaatacttggttgcatatcttaaatttgtaagatgtgctttcagtttcagtgcatatggctgtttttttgttttcactggttctgatgttgtctaattaatctattttttggactgttcaaatacagaaacactaatcgatggagaaccaatcataaaattgccaccaaaaacgattcagctgagcaaaatagacttctcaaaagaggagcgaactttctatatgatgcttgaagaaggttctagggaaaagttcaaggtatggccacttcaattttgcctctttttttttctatcgaaaatattgcattactatgtcaactattagatcttaaatgaaaaagcgatcggcagttatggtgcatagatagatactgtccgttctctagatactcattatttgaacttagatatgctcggttttgatttattcctaactcagttgttgctgcaaggtcttagaatagcaccatatcaatactccatacattttgttttctactcttgtcttatccgatgaacacttagctgtattgtgcccacagcaattgtgaaggttttacttttaatgaacagaagccaagtttttacatttatcttcgtaagcacaagtaggtttgctagtcaatagtttaccatgttcagtgtgattacttttctttttcaaaatatttgcagtagttcagaaatttcaatgcaaaatgtttatactccatgttcatactacaggaatatgcttctgctgggacgataagagaaaattttgcaaacattcttgtattgctgctgcgacttcggcaggcttgtgaccatcctcttcttttgaagggaaaggaaaaagatttgattgatactggttctgtagaagtggcaaacaaacttcctaaggaaacagtgataaatttgcttggacagctggaaggagactatgcaatttgttccagatgcagtgtaagcaatctaatcacatactgtacatgcaaaaaaatagtattacattatcttcgaatagtttcttttatgaaaaagcaaaataaggatatcagaacaggattgtcatgtgtgtgtgattaaacaatcagtggtttaattttatctgaactgtcatgtgtgtgtgattaaacaatcagtagtttaattttatctgaactgtttgttactccatggatactaagataactacggtaatttgatttctgcgcgttttgcaggacccacctgaggatgttgttgtagcaacatgtggtcatgttttctgttatcagtgtgtgcataagagcttaacaagtgatgagaatgtctgtccctccccttcttgtgggaagaaattaagcgctcaaacagttttttcacctggagtgttaaggttttgtatagctgataaattggagtctggtgcaacaactagtagttctgtagaagcagatggctctccatcaatctgtgaaagcagttacatatcttctaagatcagggcaaccactgacatacttaactcaatcgtgaatacacctgctctaacttggagtgatactatggaatcaagtccaagtgaagtagccccttctaaggcgatagtattctcccagtggactggcttgctggacttgctggagctttcgctggatagcagccgtataaaattcagaaggcttgatggtgcaatgtctctcaacttaagagaagcagcagtgagagaattcaacactgatccagaggtacttttctgacgcccttcatctctatcttcttttttttgatgttacatgtagatggtcaacaaatataactaaatttcattcttcaggtgagagtgatgctcatgtcacttaaggctggaaatcttggtctcaacatggtagctgcttgccatgtgattatgattgatccatggtggaacccttatgctgaggaccaggcagttgatagagcacacagaattggtcagacccgtcctgtaaccgtttcccgcttaactatcaaagacacagtggaagatcggattttagctctacaggtatcattttggctgttacattttcatttcaaaagcatgagcctttcttcttttagatggtatgcacttcattagtcgtctggatgtaggatatgaactgaacatatttaacttcatcagttaaagatgcatttctacaaaatgaaaattttccattcttgcgtatactggttagcatgtatttttttcttgaaactaatatgaggtttaccttttttacaaagtagctgaaatcatgtaggcaatttcatgcattttttttcgattctctcgattgtaagggttgttaaataattggacatgctttggagctagactggtgatcaattcattttagacagtgtcaccatgcttgtgcatgttttcttttttactctccatttttgtcaacacaacttttatgttctcttgccaggagaagaagagaaagatggtccaatctgcttttggtgaggacaaacctggcggcagtgcaactcggctcaccatagatgatctccaatatctattcggaatatgagggcagctcatgatccttttgtggagctagctggtgaattttgtcgtagcaagactgacatagtcctatcagctatagctgatgacaaagccttagcaccattaatttatgcacccgatgttcctcaccatgggtgatgccatgtcttttgaattgctctgatcattggacagagagggttagttagcttttgtaattagattatgttcgccgtcgctggaatgggatgttaggaggtcttacatcagaagcagcctttttttgtgtgtatatatatatggcatgctaattttaatgttggttctctgatggaatgcattacaaagtacaaactgttactcctatgattgtgatggggaagtctttttcgccctttaaggagatgcccttcgtttcttgcgatgttatttaaataattattaaaaaaatgtaaaaaaaaactgtcattgcaggatggattaatatgtgatatttcactgcacaagcatgcaaattcaaatttgatattttttttacaatatgtagaagtcaaatttgtgaagtgctagcgatgctgtgtaaaattttcattagacaagttctgattttgtgtaatcaagcataactactaaattcattcaagaaaatatgcatacaaaaaacaagatcataacaaaagggaatccactgcacattacacaaataggaacaccgcaacgcaaagatctcaaacgacggaaatgctgccaataattcagagacgatcgagttcatgttcagagcgcaagaatggcgccggcgccgactgcgaggcccaccaccagcttggaggcgagctcggcgccgccgccggccgccgcgccgtacgacgacgagccgcccttggacgacgacggcggcgccgtcgagttggagaccgtgatggccaccttctggcccatgctgcagtgcgacccggacgaacaggcgaagtacctcgtcccgggcttgtcgaagacgacggtggtgctgccgccggcgtccgacgagagcggggcggcgaagctgcacgccgtgtagtccgccgccgacagctcgtcgacggtgtgcggcgtcccgtacgtgaacactgcgccacattacacacgccgatcgatcagctcagacgccattgttgccagatgccaagaacggaggaggaatggagaagctcactcaccgacgctgtcgccgacggcgaccgtgttcttggacgaccagtcgccgtagttcccgccggaggcccacttgatggcccacgtcttgctgccggcggcgagctcggcgacggtggccacggccatgaacgccaccaaggccttcaacgacgacgacgacgacgacattgttgcgagctcttgcacaagctagctaggaatggaagaggctgcagagaagctagctaataccagcaatggcgcagctactgcctgaatttatatatcaagctgctggttttgcaccagctggtggttggatcgtggatgacgatgaaaattttgtatagttacctgctcgtgccatgtcccatttaatttgcaatccaactaactaagaggttgacagcattatgccaatgatatggctaatatacaagtaatttaggcaatagttagttggattaatcgcatatctgggggagttcatacatatatgatcacggcactatgactatggcaggtttgattgatcggatcgaaggagttgacaaggtatcaattcagcaattcgattatactcgctccaaaaaaaaaatccaatttctaactataaatctagaaataggatatatctaaattcatagatatatatatacatgggctatactgctatgcatctaatgagaattgtcgatcgagctggcgctcactagctacccagcaagtggtagataattaagttccatctcaaaaaaacaaaaagaaaagaaaaagtttgtatattgtttatgtattgtgcattggggacctaggaagttgttttctgctgtattcggtgtatctaacactcacaaatattactagtaattagcagtgtatgttgcattattgaaatgatcatcacaagcaatctcgatgcacgtcttggttacaaaggttgaaggctggatgttgacttgacatggtgatggtgacgaacacataaactcggaatggaactgggctagtacatatactcccttaacccaatatagaatataatatgatacatcctacctacttctatacagattcatagtactagaggatgaattacattctatactacggattaggtacttggtggtggtttaattgctttagcattctttttgggggaattcttgcataagcatcagggatatgatgacaatgttagttgactggagttgataatcgcaatttcacatataccatatgtatgcagtttacaagtaacattcacatattccttatgtgtgtgcagttatgcatacaccggctgtcaatttgaaccaaaaatggcagtttccgttttcaacaaggaggcgtacttcccttgtttccgccttcatagctcgaacacgtatgttcatatccacacctctcccccaagtacgagacaaggtctcgagaacaaaaccccccaaaccccacggcggcggcggcgagcggcggcggaagaagcagccgcaagaggcagcagctcgcgctggcggcggcatgggtgggagcagcgcaagcccgtgtgacctggacagggagttcgcgccccaaatcgcccagctcctcgccacccctcctctccaacccgcgcaggtacgttttctttttccttcccttgcccatccatcctccgggtctcaaatctatctgcttgggaattgcttgtgctgcgattattgtttttccctgtagaaaggttgggtaatcattgtcgggaatttcgttataaggaagtgatactatgatgggtatatcttactatgattggtttcagttatcttactgagaaaggaggatttctttttggtccgcatggatggttttttttagattggtgagatgagaggcgaattgtttagtttacaacagtaacggtgtagtttaatgttttatttgcagaagtacaatcttaagtttgtcttttttgggtatcccagttagtgtgtagtgaatgtagctcgatggaggtatcaattcgacagaatagaaacaatcttttgtgttcttggcttctttctgtgttgcagttacaattgtctccttgaagccagtaaaattgtagtaaatcttttatggctttttttctccttccttggttactttagttcatgtattgctgacgatctgtagctcccatctgacacacagctatgctacttttgttttcaggaatactacaatgggctcatacagtccaggaaacatgatggtataagagtgaacttcagcagcaagcatgggaaaggtactggttactgaatacttatatatcttgtgcaatgcaatccggcaaacttggagtgcttgtataaagttggtgtcgggtaaaagccaagatacttaaccagttggttcttgcaggtgtttgtgcgaacaaggagtttgcagaaggggaccttattctgaaggatcaaatattggttggtgctcagcacagtcttaacaaggttcgtctgcttttgaagtgatcctaggtatttgttcccttctattttttgtgtgaactgctcctccctgaagtgtggtgtccattttgtgttttatttcagattgattgcgctgtgtgcagttattgctttcgcttcattggttctatagagttccagattggacgaagattgtattggcaaagcgttggttcaagcagtgactgcactaataggaggcattgccatgagagtgatttgggatcgagtgccagttcttctggtgcaacaaaggaaaacagtagtactttgccagaagaggtcttaggatcacttattactggtgacatgtcactgcctttcacagaccattttagtttgcctcaagttgttccttgtcgtggatgtgaggaagaacgctactgcaggtttgagtcactaaccattttacagttcacactttcttttggctgcaacacccaaagatgttaggaattttgtttgaggcataaatattttgttgatcaattcattctccatcataggttatagttgtcggtcgtgttaaaacttaaaacctaattatcttatcagaacatgtaacttgttcttgccgtcttagatagaaatgtaatcttggggtaaaaacataacttgttgattctgcatttttgtttagccaatcatgtgctgattccgactgggaaacttatcactctttgctgtgtactggatctaagactgaaccatcccagagatctgctcttcagaaattcatagaacatgcaaatggtaagtgcagtatgcagtgatcattatataccatcattacgaatttatgttgtgttcactattcattaaatgcagcatgcctagatcaattgttcctgattagtgatgattgtgattgaggttgtcagtctgttatctgctactgaccaatctttattttcagggtccaatgatatttttcttgttgctgccaaggtatgtgatagaaatatagattaatgtttagtgtactaagcactaaacatcgtgttatgtgctcatctcagattctaatattctccaaaagttttatggggatactagaactttgccattgtccatggctaatacaaaaagcattcaagcatcacacttgagttggtactgttatcactaatggctgtcagcaatctacttatcaatgcaccaggacagactattgcacaagacgagttttagtagctatatcaagaacatccccaaacaaaagattcaattgcaatttccttattgctaccaattgcagtcaatttaatatctcctgatcatgatgcatgagctcgatacaattttacatgtcaggctatcactttcactctgctgaggtacaagaaactcaaaacgcagcctgaatttcaaaataacacagatgaatcaaacttttctttgcttatggaagcatggaaaccactttcgatgggctacaaaaagaggtaaagtcatgaattcgcatgcaactattcatcccctctgataaagtagctgcgcgtatggcactaccagcagtgttattttaatgcacaatcgatagtttcttcatcaagtgtatatcaataattcaatggtactagtatatttccactcttctcatttataacagtcaataagatctctgttgcatggttgcatattttgttctctttttttggatttgttggcaagatgttattttcagctcagtgtggctttcactaccttgctctagctctacaagatcctttgagttgtttgcattgttgttccaccctaatatgtcccaaaaaaaaaaaatcttgttgcaggtggtgggactctgttgctttgcctgaggatgttgattcctgtgatgaagatacatttaggcagcaaattagggatctagcacttacggtaattatgctgtcacatatttcattcttttgaaactatataggtattctattcacaatattgtgctctgaaacgaagctttattcactagctcgtcagttaaaatataaaaatggcacacaagaagtggttattgttttgattgaaaagtgtcccacataccaatggattgatgggcagatcattatcttctgtgtttcgcagtcattgcagcttctcaaggatgctatttttgattctgagtgtgcaccctgtatcctttttggcatatactagatcagttcatatatataaataagtagcttcccttcacattcaagtaatcaagtttcattgactcacgtaaaaaaaaacggtcaccttgacatttcctagtgttctcacttgacgtgtatggccatttaattggcatgtttgagctgaacaatctgtaagtaaatctaattatttttcatttgtatatgtgcattacatactctgtcattgtttctttccatcaacagaaataagttctgtactgcatttgatgtaataacctcaatatatttccatcttttattccagtggtttggttgttccgtctccagtggaagactatttcatacatattgatgatcttccagatgatgagaaggtattttcactggttagccttagcttttcttgtggcattgttaatctgaagtgcaacatatcccaggaggaagctgaaaaggttacaaggccatttctagatgctttaggtgaagactatgcagctccttgtgagggtatgtggagcttcttcccaagtttatctccccccacagtaatgtcattttctatttacccagcagtattcgttcattctcttgtgaattttctcgttggcagggacggcattctttcctttgcaaagctgtatgaatcattcatgttgtccaaatgctaaagcatataaaagggatgaggtaatctatatttcttccagttgattcgctcatttttcacaccaaattgccagtcagcaatccgacaaaaccattgaactaccgttgcaggatactgatggtaatgcagtgataattgctctggagcctatcaagaaggacgatgaggtactgagctgttaacgcttatctcaaatattttttttcttgtgctgccagtgaaaaaagaaaacattgaaaacgttgttttgccaagtactaactgtgaaaattctagattaccatatcctacatcgatgaggatgtctcctacgaggagaggcaggcggagcttgcagattatggattcatctgtacgtgccctaggtgccaagaagaaaagcccaactgaacaagatccacagtttggaggttcctgaaatttatttttttggtgtggaatatgcaattgaagttttgacgactccatttattttattttttttgtctaggatatgcaattgagattttgacaactccaaaaatgttaggataggatatgcggaaagaatgatatgatacgtacttatttgagtggatgctggattttgctgtgctaatgttggatgctgcagaaagtttttattccttctgttcagttgagatttttccttttgtgaaaataacacatttctgggatgaatggccgaacaaataactggatgacaattttaagtatttcggttatacaggaacacaattgatacatggattatgctacagatgctatctctttccatagcttatggggagttgcagaaccagtttaacatgacacgacttttacacatggtacaagaaaaacgagttccatcattcaaggaaaaaaaatgaacaatgatgttcgtctcagttctcgctatgccattgtttgctggagctcacctgcagagagatagacagtataaattagaggaacggcgtgtagaattgtgcagtacatatattcagtccgtcatgtcttccggtcggttgagcatacaggttttatgtcaaatttggtgatgatatacaggtgctgctatcaatttcatgagaaacacgccgatgcacatgtcaaataataaattctctcctgctctacctcatattatcatctctgatcaaggcctccaaagaattgttccaagcttgtagagctgaaaacattggatgctactctttctgctcgttgtggagaaatatgtagttgatatttgataaacctctgcaagggagcatagcaactcaaaacctgcttctataagtatgatacttgattgttaaaattgtgacttacagctagctgatgaacaatttctggactagtatcaatgtgccaatcaggttccagttgccgcacaaaagaggtgcggccattttctgtactacagaagagaacctgccatttgaagaaatgttacataaggtccattgcgaacatccaatggctatacccaaatgaaaaaaaaaacgattaagcagttatatttctgaagtgacctcatcatgcggcttaccttgtcctttatcaatccactgttcgtaaaaagtccagcttcactcagggcagataacaccttttcctgcaacattattcagttgtgctgatgtcaagctataatagctcattcaaattccgtactaggcagtgtgtctatagtgatgattccaaaaatactcttctgcttttctttttttaaaaaaaaaaagaacccctgaacataatgaaataaaatagcagaccaggtagttgttcattcatcgtattattccgatatcaatggtaaattgattactgtttattccgcgtgcatatgccgatatcagtatatattgacatatcaagtcttgagcatacttgtaaagcgtaaaacataaatgcaacagaaaaaatgcatggtccttattacttactccgctttcatcgtcaagaatgcgctccatcagatagacatcacagaattttgcaatttctagaagaacctccaggacagaaggtctcactgtgacatggttctgaaaaaaaagtataattccgctaaattaaattcgttaacaaaaaacaggaaattttttttgcagcagcgcttttgctcacctggagctcctctggagttgtttcctccaaaatcacaccaagtaaccggcatgtaacctaaacattataattcacacatgggaaagaaacatgcattggtataacaaaactttaaatttcgtgaaaaaaaaaggtgtgaaagcagttgcttgcaaaatacccttcgtccttcgctcagtttatgcctaacaagctgctcaagagtcagctggagaagaatataagcaaactatcagtccaaggatcctaaaagcagatacatcatttcagtattcagaaaaggaaacaggcaatacgtttactggctggaaaagctggttgattgcttcctgtgctcttgaatctgctgaagatgaacaagcatccgttgaggtcaaagcacctggccgtgatctactgctggtgttgctaggtgatggagcaacgcgtctacgtggcctccgaggttgctcttgaggagctctcaacagtttccaggcaaagataagtgtgattgtaattgcggcaagtgtagtaaatgagcgaagtttctaaaatagaagattgaagtaattcaataattcttgtagcaagaattaataaaacggactttgtgtgtgagaaatcacaaaaaatggcaccaattcactcatccaaaccacaacaacgactgatacaagggattaaaaattgacaccaagtacaatcttttgtggaataatatgaatgctcatgctgttgcaagttgcaacatagggcccagaaggtcgattttcgagcgctacggcacttttaagtgctttcacgtgatttgatacctaaagtcgttttaatgacgttgtagcgcagatttctgagcatagaaatcggtttacctcgccgtgcatgcacatgtcatgttcgcatgtgtatgcctgtgcttgcatccattactagcctaggatctgcacgttgtattactaccgagttcttggaaatagcgttgtaaaacactacagtcaagagaacttacaaaacgacaacatgccattaacgaattatttagtgattcattaactgactatagaggtaagtagatcattcgatgatatcacataaagcaagccatcataaaagtttgcatctttctggccaaccaacacttctacatagtaactatttctcgcagcactattagcctattactaacctaaaggatacatcaaaatctcaactatcacaatgacccaaatacgaccacatttcccaaaagggagacatatcattagcgaactgcgaatccacgcctaaaaatttactacagcttctagcttgtacagctgctaagaacgaattaccaaatcgatgcttcgaactcatatgtatgtaataacaactaaacaatagtagaatggccacagtataaaatatagttccaaacaaaaaagactagccttccccacaaacaatcaagcaaggcgcgccacctttacaccacggaccaccacaaatccctaaacagcgaggaaaacctagagattatcaaaacaccgcaaaacacacgcgcgacacgggggggatcacagatccgagcggcaaacctggcgatcgaggtcgaacgggaggcgatcggagtagcgggcgagggcgtccactaggcgccgcaccagatcagccagctcgtcgtccttcccgccccccgccgnccccgcctccacccccgccgccgacgccgctgcccccgacgacatcggacgcgcgcccccgctgaccaccagaacaagaggaggaggaggaggaggacgccgcggcggcccgaaaccctagcgcgcccgctcgcggcggcgacggcgaggaggaggaggaggaggaggagaagatttggagggggcgaagtgtaaattgtgccgtctcttctacgagggggcgggctgcgacatgtcggagggaatgagggcggaggagagggaagctcgttgtttttgcttgcggcgtggtaggagacggttattttgcagttaggtccttgaagagtgtctttatttttggtaataggtctttcagttttttttttgttttactcccagtcacagtcttcatggttgaaccaaccaactgctcgaactatgactttgggtgtgttagttacgcgtaaaatttgaacgtgtcacatcggatatacggatacacatttaaagtattaaacgtaatctaataacaaaataaattaaagaatccgtatataaaccgcaagacgaatttattaagcctaattaatccatcattagaaaatgtttattgtagcatcacattgtcaaatcatggcgcaattagtcttaaaagtttcgtctcgcattttacacgcaatctgtgtaattagttgtttttttatttatatttaatactctatgcatgtgtccaaacattcgatgtgacatgtgtaaaatttttttttggcggggaactaaactggccatttgatgagttggttttcttctatggttggtctaattttgtactcctcggtatgagctttacatgatttcctctttattttttccctttgagaccttgatttcaacaaacttagcctgatccatcatgttttctgtacaaactattgaagtactgtggtttttttctctgcgaggttattagatggtgtttttacgacacattgacacacggaaaaagaacggaaaaaaacagtttctttttccgttttacacaagatggtggtgtgttcatgtatattttctccgtgttctaaaaaaatcaacatgattcataatattagaatatgttatatccggtattaggttgtttaatgcatgaaaagaaattccatcaaacaaccaactctacaacgactcgacgattgttccagattttcattttcattgctgaattgctgaacaggcaacgagtaatgttcgtgtatggcaaacatttgctaattggcactttggcaggtaattaatccgtctttaatttttttacagcctcaaaaactctcgttgataacctgatatatacacacagaacgcgctctttggcaacgctggctatactagcaatcgaaggaataccgcgacgacgacgacgacctgtgccgccgcacgccgttcgccgcctccgccgccgccgccgtacccaggctcctccagtcgtcgtgctgcgcggcgccgttcaccgccgcgcgttccagcagcttggacggcgagacggccgccattctccccgccttggcggcggcggcggccgacgcgccggcgagcatgtcgccgccgccgccgtccctccgcgcctccttctcgaggtgctcgcggtagagctcgtagacgcggtggctgagcatgacctcgaagtccagcacggcgaggagctccagctccagcctgttcatctccgcgttgctcacgccgccgacgcgcgcgaagaacgcgttgttgtggtggctgcacacacgcgcgcgaatggtaattaacccaacagaactgaagtatacagtatactccactaattcagaaactgtttttttttcctcactcgagtggaactacgctcatgcaactaaaaagtcactctcttttttttaaaaaaatatcaacatataacatttcactctagaaacattcaaattaaaattctagttctgacatacaaatagagaaaaacaacacatctaaactgctaatagtacataattttttattgtcatatttataatttttttatttctatatgtaggtcgaattttaaattgtatgtttatagttgatatatcttatcaaaatgttttaattttttatagtgacaggcataaaacgagtgtatgtacataaaagtggtaagaagatttcccaactactaggttactgtcacagtgtaagtactaactaagaagcaactaatcgctgaataaatgcaactaactactaatcgaatgatgacacatggtactagcactaatgatcgattactgacgcgaaaaatgacgttaagctgtattgatcatacgcatgtcagtatcagaagaatacgtacgtagggcaaccacctactgacctgatggccaaaggattaaattgagcatcaagaaaaggatggataaccctcggtcatttccatgccttgcaaagtctactccattaaaaaaaaataaggaaaaagtacgaattaccctccgaactatagcagtcgtctgaattaccccccctaaccacaaaaccggacatttttcaccctgaactatgtaaaccggacgaattacccccctcgacccaaatccgcggtggttttggtctggcggtccagtcagcaatttatttattaaaaaataggtgggccccacctgtcagtttatctctctcttctatctcttctatctctcattctctctctcttctccaagacggcggcggcatggcaggagcgcggcgaggcg

SEQ ID NO: 32146 - DNA, 37751 bp, Oryza sativa
ccgcctgcctccgtgtgcgtgagtgagaagagagtgagagaagagggagataagagagagaggggaatagttggataggagtatgacaagtgggttccatatttttttaataaataaaatactgactggactaccagcgtatgccacatagaccaaaaccaccgcggattaggtcgaggggggtaattcgtctgatttacatagttcggggtgaagaatatccagttttatggttcagggaggtaattcagacgaccgctatagttcggggggtgattcgtactttttccaaaaaataaataataattaccgatcgattaattcattcttatttaattgtggtattggttggtctcaatctacccattgactgttcatgcagtagtgactgcagatctgtggttatgtttccaactgttcatgataagaacaaacacagttgctgggattaatacacagacaaagtggccacaatctttgtgtttgttcttcatgtatcctaacaaaactgaggttcttttacatggttcaattatgtgtaagattttacttgcgaacgagtaaattagaggttaattaagaagagatgatttatgcttacaagtcgtcgagaaccttggaggcgacgaggaggcaggcgaggaggaggcggtggacgttgcgggaggcgacggcggcggcggggcggcggtgcgccgccatgtcgacgtacgcgtacgccaccacgtagcactccggctccagcccggcgtaccggtgcacgcgctccagatactgcgccacgccgatgcgcggcgccggcgcgcccctcgccgcctcgaacgccgccatccctgctcctagccccgccgccgcctcccctccgccgctcagcgcctccaccgcgtcgttccgcgccaccagccgctgcacggcgcgcgccaccatgtccagctccggcggcggcggagccgacgccgtcgccttctgccgcgacatctcgccgcccgctgccgcggcggcgtccatggccatgcacggcatcgacagcgtggagtggcgcgcgttagctcaagctgtagccctgtagctgattcggcttggcgcttttttttttcctctttttggttggcgggggattaaccgcgggaacggacggtggatgatgcggcggcggtggggccgtggccgtccgatgaagctgtctctcttcgattttaggaacggaattttctgtttcgcgattcagacaacaccagaatggactgttcaacccttatttccgattttgtcggcattccgtgccaaaatcgtgatccgaaatggttttttaggagtggtggacaggatgctcatcctctcccactcaccgctctttgctgtccataattttagcacagtttatcgttaaaaaatatacaacttttaaagcgataaactttaagaaaaaatatgtatatttagtttattgatgtcatattattctcatgtttttttttcatccgttcgtcatcgccacttactgaattctaccgtaatttttccccttaaaaattgcacacttggacacttggttcatttaagtccccctctcatgctctaattacgcgttcaccgctgactgaaatttgggttactagaaggattttgctcacaaacttttgactcttctatcagtcaagaaaaaggaaaacctttcactctacttgttaggcatgcggcatcaaagttttcttggtcagttttggacttgtggttggggctgcacggcctaatcaaagtgtgatccaaatgatggttttatgccatcatgggccagtggtgtcactataaattcaggcctgataagcactagtgttctgaatatcttcagagttcagaggtgaatacccaaaatattcagaaatcagtagtcatgagtttatacttttcagctggaacgaatttgctattgctcgagcaccgaatgtaggatcaactacttcacaatctccagaactccagaagaagtttatcactgaacacagttcatggacaaactacccggtaatccgaagaacaacacctgcaaaaaaaagatgtgaaagatcacatgtcaggttgtcttctccacaccgctttagctcacatggctggagaagcgagcatgtcaacttgggaagtgtgctaatgactccatgaaattaaaagatcggaacggtggggacgaagtaattaagcagatggggggctggtgctttctgacctccggaattcatgtctgaattctgaaaacacaccggacaaatgctccggtctgaaagatgacagccgttttttctctgttccttcctcctcgcttttattatggctttctgcaggatggtgcaggtgactgttggctcaattctggagaacgcttttcttggccattcactggcctgaaactctggatgatttgattggattgacatgatgcattgtatcatatgatggcctacatgctaccttgaactcctcaattgatcagagagaatcagttgcatttgcaaaattctgcaatcttctcatttcaggcttcagagatgctatgggctgcagttgcagtatcctggcatcaccaacctgacggtccttaatcgtagaattattgaaaatcttcactttatctgcataaaagaggtgacatgtagggacacggacaggcatagatcactcgctcgctaccttcctttggcataggttaagttaataatcattgtgattctctgcgatttattctctgcttgaagagttgggtgagtgagaataataaactttgatgttctggccgtgcagatctctctccctttctcacgtgccacggttgttcttggtcccatccaagaatgggctcccactgggaaggaaggaacaaaagttcagatctatgatctatcgatctgtgtttcctcacaacgacagtcacagtaagtcagtaaaaaaatactcaggtaattaattactgtcttaagctgtaaataatttttgtttacccggactgttctgttcctaatcatcatcgagaggaggagttggagatgatgttgtggatttcgaggcgagcagctttaccacgagatgaagcttcgtctagttatagccagcgatttgacagtatgcgaataatgtagagtgtgatgtgttgtaattgcttcaaaattaatttgctttttattgaaggtttcggttaacttttgtgcacactcgccagtgagagtttggagcgtagtaacatggtttggtgatcacttttttgtagggcagtactgagttaattataatatttagaaaaggattaccatgtggaaaagggattatggtacaaccaaactgtgatgagcagtaaggtgtgcaagcgtcggttcggtctactgatgttacaacagcaaacgaggaaaaatcatggccaatcgcttgactaaagttggagagaattaaaacaggagaggaaaacacaaagcttaagacaatagaggagagaacaatgctgtgttctttcgagagagttaccaactcatttttcacgtgcacgattttcaaattactaaacgatgtatttttttaaaaaaagtttctatacgtaagttgcttacattaattcatatttcaaaacaataccaaatacttaattaatcatgttattttaaaaataagttaatatgatttttaaagcaacttacacgctcactatacttcaaattaaaactaattaaagttaaatggtcatgtcttaacatgtccagattttaacatgttttactgccttacacgtccactgtacttcaaattattaaaaccaataaaagttaaacacgggtattgatctcacgagcatcatttacaaaacaatgcgaatctgaacctgtcaaattactacagctttgcaaaaaacaaaacaaaagaaaaaaaaaagataaaaaaggcttaaggcgaaaggaagtctcagacctaaaagagggccccacattttctttcaccttctcttccattccacctctccatctcgccggaatctcacctccgatccggcggcggcgccgccaccgacaccgagaaggggcgtcccctccctccgccaccgcgcgcgcggcacgaagagccaccggagcattcaggggaggggcgttgtagaagcgcgggcggggggaaggcggggatggagtcgatcatagcgcgggcgctggagtacacgctcaagtactggctcaagtccttctcccgcgaccagttcaagctgcagggccgcaccgcgcagctctccaatctcggttgggatccgcttctccggttgaggatgccaatttggtcgcctccgggtgctaactttttttttgggcgtgatttgggtgatgcagatatcaatggcgacgcgttgcacgcgagcctggtgctgcctccgtcgctcgccgtcgagaccgcgcgagtcgggaagctccagatcacggtaatggcgggagccctgacccggtgcctttgtatatgtcagtgtgcttactcttcccggcttctccccctgaaggcttaaggggtgcatttagtgttagatttcttattgtttggtttccaaatttagatgattttcgggagagcattgttttgcactttacttgcgcctctgcgtggtagaaatctgtgatgaacttgtgatttcgctctcatgtgatagattatagctctgggtttgaaacgtttgtgtgggaggctaagtgaatgatgattaggaagcagctatttgtacctgtcttgacaatgccatgaaatttggactcccattaatttttatcatgtggccatacctgtgaaaaatctagagaaataaagctgcccttggtattccttgcgcatctggttattgcaagttttggttgggtggtgatctcaggtaaatttggaaaattaaaatctatactccattagcattgacctcaaagcttcaggcaattattgaatagccattgggtacttgcaacttttggtgataagcttatttcgtttccttgctacagcttccatcagtgtcaaatgtgcaagtagaaccaattgtggtgaacattgataagcttgacctcgttcttgttgagaaggacaattctgaagatctttcaagcactagcaggcaaattcattcttctggctctggtctcatatggttgaatgagcacagtcatttactgatttcagtcttctctgtcattttgttttggtttgcagtgctttatcgccatcaccagctaaaaacagcggatatggatatgctgataaggtttatttctttgaccttgatgttcaacgtaaacacattccaaacttttactctgtaaaaaattcaatatgctgtctaaaaataaaaattgtcacttccagttatccatgatggttgcatccaatgcacctattttgctatctgatttgataattcttctatattcttatgtgatcttgtctgatattctgaaaagcaattctctgctcttttattacaatatatacaattttgaaaaaaaatacgtgcagaaaattgaactatggatagggcttaatttgctataccgtggttagattgcagatggaatgacagtccaagtcggtattgtgaaccttctattagaaacacatggtggtccacgtcatcaaggaggcgcaacttggtattcatctttgtttgaatgatttttggccctttttcttatggcttagctccatatctcagttcttgttcatttctcttattaatatctgtttcatgatgtagcttttccctgcaatgtttttctgcaaacaggaacattcattccatctttccttttcaggtcaccaccgctagcggctatcacatttcgtgatcttgtactgtacactacaaatgaaaaatggcaggtactcttgcaaattagattagcattaaatatagtaaatgattgcacttcagtacctgattagaatgccttttatataggctgtaaatctgaaagaagcaagggatttttcgaacaataaaggattcatttatatttttaaggtttggtactctccttttctctccagaagattaatgtttatttatgttgctaactgttctattgacatttcttaaaaaaaaaactgttctattggaaacataatgaactgagaaatgctacacttgaaaggatttatgaccacacacatttcttctttcaaattcacagaaattggaatggcaatcactgtcagttgatctgttacctcatcctgacatgttcacggatgctcggtttaactcttctagcagtgaagatggaaaacgagatgatgatggtgcaaaacgaatgttttttggtggtgaaagatttttggaaggaatatctggggaggccaacgtgagtgcttttgaacttcaggacatatcatatggaactcgatgtttttcttttcagtttctcttgaacttccctctttgtgtgcttggcttacacattgctttgaacatcagatcacagtcaaacgaacagagcaaaacaatcctgttgggcttgaagttcagctgcatattactgaagctctctgtcctgccttaagtgaacctggtatttggttacttttcatgatgcttgatcccttccctttctgaatgctgtttgaagtggtatttgagcttgaatgctattttattcaggtttgcgggcttttcttcggttcatgaccggggtatctgtgtgcctaaacaggggtgatgtggatccaaaagctcaacaggtttgccttttccatcatgcattttaatcactgcattgcatgcagtacagaagtaggatgtttattggttttctttgtgtccttatttcttttctgcttttcttttttgaccagcttgcagaagctgcaggatcttccttggtatccattattgtagatcatatattcctctgcattaaggatgctggtatgtaccagctctggaaaacttcaaatatgctatgtttactattctattctgactttaaaccattttgtcaacagagtttcagcttgaatttctgatgcagtctttattcttctcacgggtaaatttctttaccttccaatttattgtactgatgtcatctgctgatgatatgattgatttaggttatgtaatttatcttattgtactgatgtcatgacaatcgtttttaaatttgttgaaggcaagtgttcccgatggggggatttcaagaaacttgtcttgcataaagattgccgggctctttctgaggtactatatgttactccctctgtaccctaatgtcgtgaccgagaaaaattaccttttcccaaacgctagtgtattaatccccgtctcaggaaaagccggggtacaccacacaaacatgatacaaaaggcacatctttattatatcaataatatttacattattacaaaggcactttaggcctgacaatcaaaaataaacagcagcggactagcgggcctacggctccatcttcacaggcgctcaactggggtataagccaggactccacctaggacatcttctccaaagcttctcttactgaaggggggaaagatagagcaaggatgagtacaactacagtactcaacaagccacaccgggagatgcacgattaatgcaagggggtacaaggggtaataatataggggttaagttttgcagtaaacagcatttaaaagacacttagttgctcaaagctattttgtaaagacgatcctagagatacacaatattattaatcaagaccgtgaacccacacgaacctgccttaacccaaggcgtacgatgattcagaccgaactggcaacccgacctgggtcccagctcgtcccaagccaatccgggccaaccattccacattttagttgttaagcaagttttaagaattaaaccactaacttgggtacattgctaggcttgcccataatcgagggcgcggctattcgaatagattatactctgatcagaggtgtacatctttacccacaagacacatctttactccgcattccatggccgtggaacccgtcataaagaatgtgacataacccctttacccatcctagccatgacaaaagcaccgacccaacctcgcctacggccagaatcccgggataggtaggctaggattgaacccctagcagcagaacaccggccctgtgccatgacatctcgactaccgagccgcagcccgtgtagccttcatttgccctagagatgtccatcgagccccgatttcgtccatctctatccgtgtcctcttgccaggactagactgagcaccgagttaagccttacccattagacatgtggttagtacagtagtgctttgcaatagaggcccgaagactggtccttacggtggccgaggtgctcctaggaaaaccatgcacctcgagcccaacctaaaaccattttgggaggtttgaatagaggggggaggtgtgtgttcggagacctccggaatgacagaagctacgcgaagcacacaagcaaagctacaaccctgtaaagaagcaataacaatacataaaaagaaagcacatggttctttaggttataacaaacattaagagacttgaacgggtcgattcggagttcgtatggccaaggcatggtcatccgaagtttaatgctgttatatggagatttgcggattattataattaagctttgcaactataaaacatgtgtaagctctagcctggaaaagacaagaaggctgcgctgctgacatgcggaccccacatgtcaacctaagggaccacggtggaccgggtacacagagacagtccacgggtcgacgaaagcggacctcgtgtgttaaccgaggcaagtggccgacaaacggactctactagacaccacgtgggctgcacacgtggaaaccacgcggctaccgagcgggcacactaacacggtcaccacacgcacacacgaacgactaccgacaccggtacacgggtactggggtcgacaaccacacaacgggcacggggcaacaccgaaaggacgaggacggagcaacgagaggagggagtgggccgggaaggagaggagggaggggcggcccgggagaaggaagggagggggagggagctggtccgaggggagaggaggcccgagagagaagggaaaagggagggaggagagaaagactttgggctgaactcggcccaaaggaggaaggaggattatttttagttttctttttaataaactttcttaattgttgttgttgcttaataaatatttccggtgctctgaaaattcaagtaaaaatttgagggctccttttagaccaaggagaatttaacaaaaattctccgggccacattcgaatttttcttgtacgtattttagtgtttgccaatttcttttcgaattttaattaattctattattccttttagagaatgatttttatttcgggatgaatttatcaggacgtgacacctaatataagggattttgacattttgcttgcactgtttgatcactcgtcttattcaaaaaattttggaattattatttattttatttgtgatttactttattatccaaagtactttaagcacaacttttcgttttttatatttgcacaaatttttttgaagaagacgagtggtcaaacgttatatgaaaatagtgaatattccttatattagggggcggaggtagtacgtgcatccttgagtcctttttactggagattatatgcacctggaagttcatcgtaattcacttgctcagttacaatacatactaaattcagtgcattttgttgatgcctataagtatcacatgcattaagcccaacagaatttagttgagtgcattgctaggttaccaaaagatgcatatggtgcaaaataggatacattcacagtttaacttttcgtaagtaagggaatttgtgttctacctgtgctagaatttttgtttgagctatcaaagcaattgaagaacctctgttcgatcctcatgtactgacatgttatttctccagggacacattttctcgtccaccatgcacattgatacagccctctatgcaatctgttccacaagaacctccacctgtgcctgactttggtaagactttatgatacctttgctgagataaatgaattggtcaagtctaacgcctcctattgaattgccaggtcaaaatttttgtcctcaaatccatccatttgagaatcagcaattggaattcacgtcaggaattcctttattttccctctattgtcttcagctcactccttccccattacctccaaagtttgcttcaaaaactgtcatcacatgtgaacctcttatggtgtgtctccttaacattgagagtgaagtaatgctcaccctttttttctgcttaactaaacaccgcccatactttctcattcctaggtaaccctccaggagcaatcctgcttaagaattgcctcattcttggctgatggagttgtggccaaccgcagtgccatattgcctgattcttcaatcaacagtatgtcattttatattaaagaatttgatctctctattccattagatgctgaggaaatcacgaggtacagtggaactaagaatgtttgcccgcaatcatcatttatgggggcaagacttcatgtggaaaatctatacttctgcgagtcaccatcagaaaagtgtctgttgctaaaccttgacaaagatccagcttgcttccttctctgggggtaccaacctgttgatgcaagtcagaggaagtgggctactcgagcttctcatctaagcctctcacttgaaacctctagcacttcgaatgaacagagaacagttaggggctcctctccaagtttgtggaaatgtgttgagctggatgacatccggtttgaggcagctatggttacagctgatggtagccctttgttgattgtgccacccccagagggtgttgtgaggattggtgttgcttttcaacagtttacaaccaatacttcagtagagcagttgttttttgtgttaggtctctacacttattttggccaggttggagaacggatttcaaaggttagcaaaggtaactgctctgcgacaaagacatcagctgacaaacgtgagagaaaactgcctagtgacacagcagtgagcttaactatgaatagtctccaactcaatttcttggaatctttatcatcaaatgacttacaattgcccctggttcagtttggtggtgaggatctgtacctgaaagtttctcatcgcactcttggtggtgcctttgcagttacaactaacttgacatggaaaactgtctcagttaattgtttggaaggagaaagtgctatatttggtgagaatggcactgcagttactggtgaacctaatattttgttgcatgaaaatgggcatcccaatatgagagctgtgttttgggttgaccaccggaataagaaccagtctaaagaagctcgatttattgacatagacatcactcacgtaatgccttatgacatgcgggacatggagtgccatagcttgagtgtatcagctaaggtatctggtgttcgtcttggtggtggaatgagttatactgaatctttgctgcatcgatttggtatccttgggcctgatggtggtccaggggaaggtctcttgaggactctgaaagatttatcctctggtccacttgcgaaactattctcgccatctcacctcaccgacaaggaaggtagtgaattttctgtctttgccatttaatttgttaattcatgctggaaattttgttggtaagcatgcatgttgattgcttctgctcagttgcgagatatttttgctgtttttccttgtattattcatggattcttccccgttccccttgaattgcagatggaatgcccaattccaaagacaatgactacaattcgaagtttgacctggaggtgccagatgatcttgatgtgtcaattgagctacgaaactggctcttcgcccttgaaggcacagaagaagtaggagattggttatcgcctcatggcagtgatcatatcagtagagaagagaaatgttggcataccacattcacgaatctacatgtgtcaggcagaagtagtgatcggcctggatctgcggagaaggtgattcacaaaagggcccttccaatagaacgttttacggtatgtagtggattattttcatacttttgcatttctatgtggcacttttattttttatccagttcaattctgagacactatgctgcacttgcaggctggaattgaaggtttacaggcaataaaaccttgcctgagagatcaactaattggaaatgcaacatcaaataatcttcaaacaggcagtgtttttgataacacaagtagcattggtgaccaaggtgtcgatgttgaagcgaccatggtcatttgcgaagatgagattgaaggtcccaagtggacaatggataatgtcaagttttctgtaaaagaaccggtatgaacatcttctgaatatttgtccaaacctctcggaaattaacaactgcttcctgaactagttctgtttgtttgactcggcagattgaggcagttgcaacaaaagaagaattagagcatctcaccatgctttgtagatctgaagctgatgcaatggggaggatcactgctggaattctccgtctccttaagcttgataagtctcttggccaggggactatagaacaactcaggaacctaggtatgtgttccctacatgtaccctgatttattttcttgtagatgccatgctaccctgtgttttggacttttccccttcttttgctcctttttggtttgctatgaatttttactagtaatacactgctatcagctactccttctgtttcgtattataagtcgtttgactttttctatagtcaaactttgttaagtttgaccaaatttatagaaaaaattagtttcaaatatcaaattagtttcattaaatctaacattgaatatattttgataatatgtttgttttgtgttgaaaatactattatatttttctataaacttggtcaaacttaaagaagtttgactatgaaaaaagttaaacgatttataatatgaaatagagtgttctttatctaactcctttgttgggtcattaaatgctgcaaagaggagatctagttacggttttttatgcccaagtcgaaaaaacaatcctagataagacaaaactgtttcccaatttttcatcggggggttttgccttggtgtatactgtcaacaaatgccacctgggagttattttgatctgatgctttgtgcttcagcaaattatgcagcaatcactattatttggttatatgccattgcttttctttcttgtttatgttactgtatttttatattccctcgtacaatttatgctgttaaaactgattcttttttggaaaatgcttacctacttcattttctcaaaacaattttagattatcttatgaaattgtgatgtcccaggaagcggaggaatcgacaatactttttcacctaggaagttgagcaggcagaacagttttggcagcataggtactcctaggactcctaatctgcactcaactacagatgcaggaacgaaagagttactggaatcaacagttgcttcattacaaatcgaaatcttagaatccaaggccaaatgtacagccctcgtttcccaggcgagcggtgtggaggatcagaaatgcgccgaagacatcaggcaattgaatgacaagctagagagcatgcaatccttggtgacaaaattgagaactttgatctaagttgcacatagttttttgtgtataggttcgtgcagtccaaaacttggaagtggctaatgctgtacttcctcttcattattctttttgtgtacatctttatgttccttggggtgtatacaggtggattctggaataatgagctgacacgcagcaaatataaaattttgtagctggaatgtcacatgtagcactgtgttcaaaacttcaagtgcagtcattaggaataacatttttgtcatctgtatgtgactcatgtagtatcatatgcaaagttttgctgttgtcacatacaccatctttctactggtggactgggtgttttgcgaccaaaatatgtatacataaataattttcaaaaagaacatatgtactaccaatatactctctgttttatattgttttatattataagtcgttttgatttttatcttagttaaacttatttaagtttaaccaaatttgtaggaaaaaaatatagtagcattttcaacaccaaacatactatcaaaatatactaaatgctagatttaataaaactaatttagtcttttatatattactaaattttcttaaaaattaaatcaaacttaaaaagtttgtaaaaaagtcaaaacgacttatagtatgaaaaagaggagcaagtttttcctctgatatctcacttagtactaatatcagcagtgaacctttatttttgtcatgtttcaattttttgtatggatttatcccgtgcaaaaattttagtaatgagaacaagatatgaggggataaatttgtaacaaaaatatttgaagtacaataaacctattggacctagatatatgtttgtatataggtgtattttatcggcatactcaatatacacgaaggcaaatgggtcattttcatgcccctccatattggcaatgtgacatgtcctacatatgctaaattggcaatatgtaaagatttactcttcaatgacattttttgtaatttcatccaaaaagagtggcatctcaatagtctagttgtaaaaatcgaactgaaccaagggtttaaccaaataaaccaaaaccaatgcctagtccgaagatataactgacttgagaaaaatcatttaaacccagatggtttactacataaccgaaggaaaattggggtggcgtagggattgaaccccccacggtcaaggcccatgggttctttcacaaccttacataacccttaaatattttcataccaaaaatgtataaaaaatgaacgcatcgtattttagacctaaccctcaaattttctaatcaaaatagttgggctcgttgctacctctatttgcatacatgcgtgcgcacctgactatttaggttagttgctataatggttttagaaaacgaaacaaatatatattttatgttgattattaaaccaaaattctctcaataaaatatataattttattattttattattgaaccgatggttgaaccggtgaatcggtggattcattcaccggttcgaacaccggtcgggtttagagaggcaatccgccgccgccgcctgcgccgatccccatccgccccgcgagcgagcagaggcggcgctgccgctcgtcctgctgcttccgccgcatccacatccttcgccgccgccgccgccgcctgcgccgatccccccatccatcccgcgagcgagcatcctgctgcttccgccgcatcctggttagcacatcctctttcccatctctccctctctctttttttttatcgaatttgcgttaaccctagcttctgttgcagaaatttggcttaaccttgatgtttgtttgttcccaaaaagtttgggggtgttgaactgaaccccccatgccccatgttagatccgcccatgaatggatcatgattcactccaaaacactatggagcatcctgttcctggagaggagcatgaggaggataacagcatgaaagtggatgtggcatttgatggagtgcacagcccgttccggtacaggcacaagaaaaggtccaaggtttgggaggagtacaagcccatctttctgaatgggaaggttcagtttgcggagtgtctctactgccataatcgcctcagctgcaaagattccaacggcacaagccatctatggcggcatcagaaaatctgccctggcaaggaggaagcggcgcagaggcgacagaaggattcctacttcccatgcggtataccattcttgcctattctgggttcattcattactcaatagtgtagataagttaacattggtgtggtttaggatcttgagatgtagatattcctttataaaggcgatttacctcaggaatataaataacgtttccatattttatatgcacagttttggtgaatgagaacgatccagtttcaccccacgatccggtcaatgatgttattacagagacgcttagtgatataaactcggtaacacccagcggtaacagattcacgtcaaaggtgtggaaggagtttacacctgtctatattgaggggaaactccaggctgcagattgcattcactgccagaagcgcctcagtgcgaataagttcggggggagaagccatctgagtcgacatcttataacctgtgcaggacgacgtggacgtggagggggccaaattcatcagaagggtttattttatccttctagcgtgcctagtttgaagtccagggtgcaagatgagctctcacctgccttgacaaatgggaaggttcagatcgcagaatactctagcaagcttctgagggcaagtagctctggtgactcgacccctaagcccattcgagtggtaccagcagagcattccgtgccgactccagattatacaagcctgatgaaacagaggacctcatttgtgaccactccagctggtcaggaaacatctgatccagacctagtcgggatgatagctttgcatggttatcctttgtcaattgtggagcacgaagaaatgatgagatttgtaaagaaactcaaccctgtggtcaatttagtctctcgcaatgctatggaagaacattgcttgacactatttcagaaggaaaaggaaaatataaagggtaaaattgcacatttttcccgacgtgtctctctgtcagcaagcatctggactcctgatggacctgagacaacagtaaattacctctgtttgacagcacattatattgatgaagactggaaagttcataggataataataaaatttggaatgttttggtccgcgcctgctgatttggaaaggatgatacattgtatggaagcctgtgtcccagagtctgagagcggatcatataatgtcatattggatgccattagagattggaatcttgatcagaagcttttaagcttgacttctgttggtgaagttaggggtgacaccaatacttcattgctaaaggaaatgcttatagagaagaagtgccttcctattggagggacgctattcaatgttgcctgtgtggactatgtccttaacagtattgttttcaaagtgcaagcagatatacttcgtcttgttggtgacatagtaatggattttttagtgtcattgacccagcagcagcttctggaagttatttcacagacgggtctaaagtgtccacaagaagatgctaagtggtggcacaaactttattttagacttgaagtgcttttgcatttcaagaagtcatttccttctgaagaaagggtgtccccagaagatacaaaaactgctgagtccgtttgcaagattttgaggacaatttatcgtgtcattgaagttatttccagccctagctctccgacagcaaatatatattttaacgagatatggaaagtcaggacagttttgcaagaagaagcattaaatgatcacagagaaatagctacagtggctatggtgatgcaggaagcattcaatgagtattggcaaaattcatatttgtggttggccatacctgttgtgctagaccctagattcaaattcagtttcattgagtttcgtctgaaacgagcttttggaacagattcggcaagctacctatctgtaatacgtgaaacagtccgggaactcttcaatgaatactgccattctttgaatcaggcaagtgatgttgtttcaaacagtgaagctttgtgtgcagatgataatgattcgttggaagattgggatcagcatctccatgaacaagcaagtcgtcagctatcttcggagcttgatgattaccttgaagatggtttagttcctagaaaggatgattttgatattttaaactggtggatgactcatagtactaagtacccaacacttgcaactattgcacgggacatcttagccatgccagcatctgctgttcaatctgaagcagcattcagtagcagtggaccagtaattccaaagcaccagagtacattaaacatcagaacaatcgaggcacttgtttgtactcgagattggatgagataaaactggtaagattctataaattgctactcagctccatcctatctttgtgattttggtagtgtgaacacactgtgatttagtccatgttttcttattaccagaatcttgtttccttgttttcctgtattggaagtttggaaccatactatatgatcagatgaatgtcagaaaccaaagcctacaatgttagtaactttatatggaagtacatattagaatcttacatgttcatgtgcaatcttagcagctacatcactttaggatgttttagatcatgcttgtaatttgtaattgaaacattttgatcccattggcaatcatgaatatcttgttctgtgattgcatgctttggatcacttaataagtttgtgcgttatagtttgtgtccatataatcatgatgatatctcattaggaacttgattcctcacatctttttgctatatgctcttacatgacaaaagaaggtcgctgttgaaatttcacttattaaatcaatgcagttctggtatatcctcatccaatctattcatgtgcaattgcttgaaaaatggtatgctgcagtgaactgttgagatgggttgcatgcagctttcgccggtggaagatttcaggcagtgtatgatggtgcttctgaccaaggataaccgctctgatgatcgagccccaacatggtgtatcaagcatttgggagctgttaaacttcatttcagtcgagatgtgtatgcatataaatgttactcccatcaccccatgcatttgcctggtgtagtgcagatgtatgccgttgtttagccaaagttcaggtcagcccagagccttaggtcaagtaggaactaggagttgtacgacgagaatgttgcaaatatcctctgttatgagcaattaatctgtgttatgtgcagccttgtttacctgcttatctgaattgtttgagggtacgtaggcaatgcgtgttgctgtctggtcctaatggaccgaatttaggatgtggcccactattcagcactatcccgtaaaggtaaatgttgtttaaaggcccaacagctgaacagcataaccctcatagtttattagagaataaaaattaatttataggtaaaatttgtatatatgtgtttttataacaacttaaaaactaatactgaaaaaaaattatgttgaacatatttaaaaatcaacttcaaaattaaatttgaaaattcaaacttgacttttcatttagcttgcgatgggctctagcctctggctagcatagcatgccatgtctgggagggggctggcccattggtcagacacaactgagccttctttttacatgggccggaattgtaggcccatgtacacagcccacaaggctattttctgggcctctatcctcctccacgccggggagccttccgtcgatgaggctccccgacgcgctcctccgccgcatcgccgtcaggaatggatagttccaaaaacccatcgatttaccacatgttccattaatgtaaataattctacatgctaatgctaaaatttaatttctactcccttcgtatcatttgaagtgcagccataattttccacactcaactttaatcattcttcttatttaattttttttaaaaaaattaaaaacataagttatgaataaagtattattcatgttttattatctcataaaaaaataattatcatattttttttcaaataagacgaaatattaaaattgagcatgaaaactcataattgtacttaaaatgggacggaggagtagctaagtagctagctaaattaagctagaagaagtcgatgccgcatcgcttctgctggaactccggcagcagctggccgtcgggcccgaccacgacgtcgcaggtggcgtgcaccgggtgccagtgcgacccccagaacgccacgcgcacccgtatcctcgaccggaccttcaccgtgaacgccacgccgccgccgccgccgcccgccgcggcggcggcagcgtccctcgccatcatgtccgtggcggcgccggccggcacggcgacgccctcgaacccgaccgccgacgtgcccctcggcggctcgtacagcggcccgccggtgaggtccttcccgtcgacgaccacctcgccgtcgccgcggtactgcaccgacatgtacacccggccgaagaagaaggcgaggtcgtggttcgggttgtggatcgtcagctggccggagagcgccaccgggccgccgccggactggacgccggcggcggtgaacgcggcgacgtggaaccgcggccggtgggggcggacgacgaggtagacgacgaagaggagcacgccggcgacgaggaggagggagaggaaccacgagcagagaagcttggtgcagcgcgtcaggtgcggccgctccctcggcagcgggcgccggatgcggccgccggcgatgaagcccgcggtggccgtcggcggctgcgacgacatggcggcgtattatatatacgtgtgcggcggccggcgagcttcgacgacgatgggatggagctcgttggtgcagcaaagcatgggcggcaaagcatcgccggagaagatggaattcgggagaggttaaggaggtgtgtacgcgtgtacatacgtagaggttgcatggcaagttggtttttgggtttcttttgttgcgcgtacatgggcgattctttgaggagatagcaaggaacaaaaggggtagcagtggccggttttcttcgtgttttggttctctaatctcctacttattttatttgaaaactagcatggtggcccacgcatattgcgcggctagcatcattatattttctgtcatataatagcatatatgttttctcaatgtattattcaaatatattaaaatgactacataattttaaattttgtactacctttacaaaactactaatgtataatattcatattgtattttatatatgtgttagttattaattatttttaatatcaaattttagttatttgtaaattatattcctatatggactctaggctcttctttcaatattatttatttttaattctgaacttttattatttataattgtatttctatgtggactttaaactcatcttttaatattctttaatttttaatttcgaatttcaggtacttctaaattgtaatcttatattaactttagactcttcttcccatatttttttaatttcaaattttagttatttgtaaattgtatttttatacgaactctaaactctacttttaattttattatgtttattccgaattttagttagttttaaattcctatatggactctatactctacttctaatattccatattttttaattcctaatttctattattttcttaattgtatttttatatggactctatactctacttctaatattccttatttttaattccgaatttctattatttcctaattgtatttctatatagactctatactgtacttctaatatttcttatttttaattacgaaattatattatttctatatggactctatgctctacttctattccttttttaattctgaatttcagttatttcctaattgtatttctgtatggactctagtctcctcttctaatattccttatttttttaattccgaatttcaactatttctaaattatatttctatatggactctagtctccacttctaatattccttattttttaattccgaatttcaactatttctaaattatatttctatatggactctgccttttctttttcttcgattaatgtgagaatttctaggccatgagagcgaacgtggaggcttccttttctatttctttaataatataatagatttcatattagtaaaatatttgtgtttgattacatggaagctagtggcacggctaatcagggtttgcaattttgaaacaggggcttttgccggtggggctaaagaaccgaaatcaccgaaatttcggtatttttaggccgatttttttttgaaaatttgatgtactttggatgaatttgaataaacttttaccaaattcacaaaaaaaagagaaaaaaactgaaaatttcaggagatatatgtgcttgctggtgggggcgaaattaccgaaatttccaaaaattcgtcccgaaattgcaatcattgcagctaatagtgttttcaaagatcaactagtttacaaacatcgatggtaattcgtagtgcagatggccgcccaacctgcccgagagttgcctccatcatttgggatctaagtgcgctcgcctaacatacgtggagagaaatagagcccgacagtaaaatatatcactcaatttctattaaatactggaggtgtgcaataaggagtgttaagatttcgggcaactaaatttttcaaaaatttaaagcgggtttctcacccttggatgatatatatttcaatggctctcatcaatcctctattatttatttaaaaatgactcttctttcatagataaaagtttaaacaacattttttctaacataaacatgaaataaatttgcaattaatattacaaaattaccggaaaaaatgttcaaacttggataagcataaatcaaaaccatttacaaaaaaaaaatgtagttcaaatgaacttaaattacacgtagcactataattttaggcttagcaatgtacaattttgggtgaaaattttcagacagttcaaatctagcaaatacatgtttctatttcaattaaggccagtaaattaatactactatacaggtagatgtaaaagttctgttgttactgcagatgttgatagtatggcgcaaggctggaaagtgatgaagaagcgagacttaagtttgagaagttgaccgagtagatatgccaccgtatgtacacaccatgtggagctagcttaatgacttggtatgcttcttcccccctggctagggtcactccatgaatatccacttcacaaagtaaacttttctgaccaaatggccagcgagcatatttcggcctcaagtttcttctgcagccgacatgacttcttgcttgtcgatactgctataatgcagaatcataattagcccaattcgttttttgatttctccatttcaatcagtaacacttaacacccaaaatcatacagttgctggatagcggtacattacatcacagtacttatcaaacatgtaacaccgaaggcattacgcaacattttatttccttgaatgaagcaaatagtttactttgattgtacatcataatacaaacaaaggcataacaaaacatatttcacaataattctacatataccaaggaatatcaaacagctaacacttcagacaaatgcagttcagcggttgtatatatatttgcagcctaattcacaaaggcacagtgcttcctgatctccccctgggcgccggtgagcacctgcatgttccccatcttcaccatggacgccgcgaagtcggcgaagaactccgccgggtagccggcgacgccggcctggcggaggatgtagcccctggtgaaagggtcgagcatgagcgtctcgtcggaggtgaagagcgccctgcccctggcgatgtgcctgtagtagctggtgtcgaacgtcctgaagctccccgggtccatctccaccagcgtcgtcttgtcgccgggctggcacttgctcttcagcctcggcacgtagtacttgtccagcgtcgggtcggccatcatcatgccgctgaagttgtacagccggctggcgaaggatgaacaatgggaggttccaagagtgtgcccacctgtgaacaatgtgtcacttctcaaattgcatatgcacatttgtgatgagttcttggtaattaaacaagtttggattgcaattttgccatggttttgaatctctggctatagctgtttgagaagagtcttagccactatagctccattaagttcgctatagctgtttgagaaggtcaatcgctaaatatcttaacccgctatttaaaaccatgaattttgcaagtgcacaaatgagtatggtgctgaacaggaaacgatgttttgaccactcgaataaagagctatgctgtgtttgaggataaagtggtcttggtctcctggcttggttctgtactgtgccatgtgattagaactaagaaccacatagttttgtacttcccattttgttgacttggtatgcgcatatgataccttcctttattaacaagttgtatagtaattaaataagtgatcacctttattggagaatgctactgggatatatcgggatcagcagagtgtttaaaaggagcacaggcaacagaaccgagagttgcaactttcagtaagtacagtataaatcatctagggagctagtctatgaagattaaacattgaagttagtgaagaatagtatatacctagcagaaccacctgatcctttgcgtcaaggccctttgggatgaagaattgatacaagttccgcgtggcatcgaagaaggggggagggaggttgttcacagcatcatccttcactgatcttgtcccatccctccgcccagttggaacttcccagtgaggccctttggtctgttgcacaagggaagaatagggacttttctcaactatagttctagttactgtaagcagcaagaaatccaatagccacgtagaatatggtgaaaatcaaactgtgtggttttccactattgtcggcctaaaacagccaattctcaccacttagccaaactatactaacttttctaactaaagaatgaactaagattaatgaacatggaagctagttcttaccaagaagacaacatctctggctaccagagcaaggatatcagcacaggacacaactccagggcaggcttgctccagcttagctttgacacggtctattgtgccaaaacctcgcagactgaggtttggtattgattccttctcagatggtgatcctggtgtgctatccagaagtatagagccatcgcaaccctgcaaaacacatagaggcacatagcttagtaggataaactcaattcaaaatcaaaacagctcagagcatggtaagcagtatgcatacattcacaaaacaatcatggaaatgcatgcgaagtagagggcctgcgagacttggaactcgggatatgatcttggtcatctcatcacgaacaatgacctctgcttttggacatgtgtattggtaaaagccaatgtttagccctggtggattggataatactaaggagaactgtaggacaagagaaaggacaaatccgaagaggagtctgtaaggcatgttgtgcatgactactgtggaaccactgcctatgatgaaagagttgccttctatgattgttgaggcaaattataacttgcagcctgctttatagctcagttgcttaggttgtactatagtaaacaagtgacataaaccatttcccacagcttcattttatttttcctaatgcaacaagcagatggtctaagacttggagatcgagattttacaagccctatgagttgtgtgcatgtacttcaattgaagaatacgcaagtcttggatcaggcatctagatagtattacctggtaatattgcataattagttggtggtggtcatccttcgtggcttgtgcacttgtgagtaatacaggctcttgtattgatgaataggtcacgacatgttgctaaaaggtaatactctctagctgttctaattttttattttaaatattatatgggttgaatttattctggtaaagaagttcagaaggattcaaagatatgagataatatatcagtttatccgttgtcgtttgttccagaggaaattgtgtatgttcatgcaaagtggaaaagaaagaaaaacaatccatttcctgttttgttagtatttaagggaaccagggaatataatatggttgcctcgctatgacattatcactgctagtttctcttgggattgcatctgaacactaaaggaactgcccataataatttcttaactggcaccagtcagttaaagtaaataatatcaaagcaacaacccattgtttgatgaaatcaatcttcttcctttgaaattaagttgagaaaaaaaaaggttgcatgacagttgtgctcgtgtcaatgaagcaaatcaagggagaaaagttagaagagaatcaacatgatcactgctagctaattattgaatgccaaacgggtgcagaagcatctcaggcaatgtgcagatacttcattttgaagcaaaatttaggtttgatcaagcatataaacactctaagaaagatgagaacatgatgtgcaagttatggaaaaagattctctatgtttgaataaaaaatgcaagagtttgtgtaagtaaaccttcagtgaatccctatcatactgagaaaatcggtccattggtcagatattagttgcagcctttaagttaataaataactgctgggctcaagataaccttccgctgagctctccagagaataataataaaaaaaaggtgaaaacaagtcaggagtagtgaacagaaccaatggtggacaccatagtgcgtgggggtacagatgcacccctaaaacttgaaaaaacaccaaatatataggattacatgtacgtatacaatgtgcacttagataagaatcccaaagtgttaaaaattttgtatgtaatacatgtcaaactttatttttctttatttttttagattccattggtctttatagggcatattttaatttgaaaacaaaaattcaagattaaacattggccattgatttctcagaattatattcttaatagctataaagccaatattttgtgaacgcactttgaaatatgaatctatgggcacaaatttcacattaaatatatattaattatattaatttgattaattgctggtcaaaatatacataatttgacattttgaaatttaaagatgccctataaaaaatcaatgcaggttttttttttctgtctgttgtaatggaatcatggaattttctctatcaatattccatactatctactagtgcatcattacatcttcacccctattgtcaaaatcctgcaccacaggagataacaatggtttaagtgttcactaccacatggcttgggcaatgtattcaattactcttggagtaactgaaaagtgatgtcttttggttgttcaagaattcaagtctaagacattcacagcaggtaaagaaatttttagttgacctagctcaaaatgtgtgcttcactcaaacagcaagggagtgcaggacagttttgaccatgaagttgttcaacaatggtggacattgacaagttcgaccttttccataggaattaaacagtactccaatttttacctcatgacttgttcatgcacataagaaaaaaaatgccaacccctttagtcatgttcagcagcaactcacagtctagttaatacttaataaatgttttctacgatattcttataggacatcaaaattgcttttaaaagagaagggttaatatcccataattattctgtctaatcaacgttatgtgacttgcaaaaacacatctacagtcctaaacaattatgggactaattaagatttaaagcacagtaacaattcagaaaattatttatcaaggaaagtaacccacagaagtcagatgaacaaaaaacttacactgaacgaacatgatggcaggtgaatttgtgataggtcaataggtcatgagctattcactgtttaactgaacaggcagaaattggttaactctggagtctgaactctgaagtgtgttgcggcttgtcaaagtggcccagaatttgaggttcatctgatgcatctatcagtggctaaaaactgtgatacaaatttcttgcagtggaaaagtttctgtcatattcagatgacactgaaaccaacttcctttccatctgttgtttcatctattacttctctcgtcctctgtgcatcctcccatagactacattctgcatacatgtttgcaagaacagcatagtttacagaactcccaggatctatactaaaaaggttcttggctgcagtttctccaagaagcatgtttccatgcaatttacaggctccaagcattgcacccagcattgatgagttgggttttaagtttgtcttctggacaagtttccatgcatcttctaactggcctccacgagcaagaaggtcaatagcagagctgtaatgctcagctcttggatcaataccatacctgctcatcatggaagtaaagtactccatccctttgtttgtcaaaccacaatgaccacatgcagatagaagagaaaggaatgtcacatcgtttggcctaacaccatcttccaccatcctattaaaaagagtcacagcatcttctccagaaccgtttcttccacaggcagtaataagtgacgtccaagaaatcacattccgatagggcatttcatcaaaagcacgcttggcatctgaaaattctcctgcctttgcatacatatcaaccagagcattgtccaatgcaatatcacccataggctgcttcttgcacatatatgcatgaatttgtgtcccaaatcttgcagaagcaacgcttgcacaaaggcaaagcactgagcttaatagaacaccatcaatccataaacccttccgatgaattttacagaagagctccattgcatcttcactgtagtttctatccatggtgtacccactgatcagtgcggttgatgacacgagatctggttcagagatggaatcatatatcactcttgcgctgctcatactccgacattttgcgtaagagttgataagtgatccgatgacaaccttttcatcccagtaacccaatttgatgatgcaactgtgaattagctcaacattgacagcaacaccgactattccacatgcttttagagcacttccaagcgtgtaatggtcaggaatcatcgctgtcaattattttgatgtaaaaaaaagaaagcactttcaattttagtgccaataccatcagcaaaaactaccttgcaatttcatgctaggacataataggcagcatgattacaggaaaaatgctcaagattgttaaagcaaaaggagggacggcataccttctttcagcattgaagagaataatccaagcgcatcaccgtcatgcccgcgttccacaaaccccctgatcagggcattccaggacaccacatccttcttccccatctccgcgaacagctgccgcgcatcctccacggacccgcacctcaggtgcatgtccatgagggcgctctgcacgaacatgtcgcccgcaaacctccccttggcagcgcacgcgtgcacctgctccccgctcctggcgcacccggcccccgcgcacgcgctggccgcgctcccgtacgtgaactggttcggccgcgcgcccgacgcgcgcatgagcgcgaacagctccagcgcctcccgcgggcgcccgttcctggcgtagccggagaccatggccgtccaggacacgacgctcctgtgcggcattccatcgaacaccttgcgggcggcggcgacgtcgccgaaccgcgcgtagaagatgacgagcttggtgctcaggtgcaggtccggaggagaggcggacgcggcggcgaccctgccgtggacggacttgccttgccggaatgcgcaggagctgatgcagcactggagcagggaggagtataatggggcggtgggtttcgcccccattaggagcgccattcgcgcgcgcttttctccctcctcggagcaattttgatctcccgagactcaacaattcatgaattcatgaatttatggcagggtttggcaatccaataatatgagcacgaaacacaccaggagcaaaaatctgaatatatttagattcagttctactaaccggcagtagaaatgagcagctgcaaatatatttttcatgcaaaagggctagaaaactgaactatacaaagttggcttcaatccataaatccaataaaggccttctgaagaatcaaattcagtcataccaccatcagttatccatctagcacatgaaaatcaaagtgtgaaaaaaaaggtgattggataaattaaacgtaccgttatgattcaatagcatagaagaaagattaaatggagaagaagaaaaaatggagatgaagaaaaaattatgtgcttttgcagattggaaagcagacaaaagggaatgaccaaattttttaggctgaagagaagaagcagaaagagataggacagaggggacgacaccaaaaacagttgaactgcagccgcgcagggacgctggtcgctggagccggcgaaggagctccttggcggcggccatggcgccgacggacgtgggtggcagcggcggctggagtaggacgcgatggttgggattggggaatggccgaatgggccctcaaccatttttgggcccaaaccaattttttttcaattttgctatatctcactcgaaagattttttcttatctctcactcgattttctcacttaaatttacagtgcattttcttgtaagttacagtgtaatttatgaaacttacattgtaacttttgtaagttacactgtaatttttgaatcttcgcatgtaaattttaaattttgtattggatttggtctttttcttttttattggatttggtctttttctcgaggatatggtaatttagtgtccattatggtgtttcttaattactttttactttttattatatctatcggattttaattcaaagattaaaaatctgtgtgatacgatcatcaaaatctgtgtgatacgatcatcaaaatctttcgaaagatgtataggtactcccattttttttaggcaccaaaccgcaccagcccaattgtgaaatcaaccaacaccattagaattccaagcatcagaagccgtaaagactgaaatgcgcatgaaatcaacaaacataccaggatagataaccaaaccaacatcgacaccccaattccaagcatcagaaaccgtcaagcgcaaacagattgatcaacaggcacgcgcaacagtggccggttacgaccatgtgagcaatgcacaaacagaatctcatctcggatcaaacatctcagaaacattaacagaagtagaatgataatatcatcgattggtaccgatgcacagtgaagcaaattgtactagtatggataatagtatcaacacaacttagggactctaaaccagaacacaacacaaccatgacacgatgatatgacagacgagcggcataggtataatgaagtccaatgctgcaccacagcacacgctcagagaccaccacggaggcgcaggacaaggtgcagggtggactccttctggatgttatagtcggcaagggtgcggccatcctcgagctgcttgccggcgaagatgaggcgctgctggtctggagggatgccctccttatcctggatcttggccttcacgttgtcgatggtgtcagaggactcaacctccagagtgatggtcttgccagtgagggtcttcacgaagatctgcatacctccacgaaggcgcaggacaaggtgcagggtggactccttctggatgttgtaatctgcaagggtgcggccatcctcaagctgcttgccagcgaagatgagccgctgctggtctggtggaataccctccttgtcctggatcttggccttcacattgtcgatcgtgtcagaggactcaacctccaaggtgatcgtcttgccagtaagggtcttcacaaagatctgcataccgccccggaggcgcaggacaaggtgcagggtggattccttttggatgttgtagtctgcaagggtgcggccatcctcgagctgcttcccagcaaagatgagacgctgctggtctggtgggattccctccttgtcctggatcttggccttcacattatcgatcgtgtcggaggactcgacctccagggtaatggtcttgccggtgagggtcttcacgaatatttgcatgcctccacgaaggcggaggacaaggtgcaaggtggactccttctggatgttataatccgcgagagtacgcccatcctcaagctgcttgccagcgaagataaggcgttgctggtccggagggatgccctccttgtcctgaatcttagccttcacattgtcaatcgtatcggagaactcaacctccaaggtgatggtcttgccagtgagggtcttaacgaatatctgcatctggaagaggcaagaaaggattggaattaacataggtaaaaaaaagcagctggagaataagttggcaccagatcctacgatatcggtactgtcagctcaaaatagatgaacatatcaatcacatcatactacactacaattggacagcatcattaatcataagagcgctgctcacagctcacaccacatcaacaagcaacaaccaaaaatatcttcagataataacaaaactgacataagtaactacaggacaacagatctatgtaagaacacagaataaagccacctagttctagcatctgacagatttgatttgcacgagtaaagcaaataaaacgggtaaaaaaacacagtacaacatcagcactacagttcaactaggcaaagagccagatacaatacagattaaattgaccttagaacccaagctctacagttcaagtaggtgtacacgatacagatgtaattctctaacccagctccacacaattccaatccaaatccaggggaaaaaaactaagaacacaattccaatccaaatccagaggaaataaactatgtgtcgcctaactcaacctaaagattttaacctaacgagctattcatctattggaacaatatcagaacaatcccatccgaactaagcacaaataagtaaaactaaatctgatcacaaaactcaaactatgtggcaggatcaaaacataactgtgaactactcttattatccatcattagggtaatatatcgaaacaatccccatctgacacatcattagggtaatatatcgaaacaatccccatctgacacatcattagggtaatatatcgaaacaatccccatctgacagaacaatctcaaaaccaatccatctattagatcgatataaataacacagatccctacctcgattctcacgaaaccctaaatcaatgagagattaagaggattaccctaaaatcgcacgaaaccgtaactcgattaagaggtggatcaccctaaaatcgcacgaaaccctgagagattgagactaactcgcacgggatcctcctacgctttccaccacgagcatcaaaatcgcgagattagacgggcaccacgagagattcgaggattaggacgaggtgattgattagttaccttgacgaggcgattagagaacgcaaagcttcgctccccctccccttcggtcgattcgactcgctatgcgattaatggagagaaaacctctctatataaagcgtgggcaaggcggtgcgaggcagcatccggtgcggtcaccgccacgcgtacggcccaatggcagcaccacacgtgtccatgtagttggaggcgcgacacgtgtccggtcccggtacgaccatccagacggtgcccggaaccaactccgcgtcaggtcatgccgcctctctttgacgaagtcggcatgcctgatcaagaccgtacgtttccgatccaacgatcaggaaacatcgtacttgatctgctataagctgcgtgtgggccttaataatcctctggggaaatatttgtgggctgaaatgaacgggatattgggcctagacaaaccagggcccatgaattttacggcccaatagattgttgagacctaattggctaagcccaactcgcgcactctgaccaaccgatcggaagttcgcgtccacgccgccctgctcctccgtcgccgccggctcggcggctgacccccgcgccgccgcaccagctgcgcgcgcgcgcgcgcgcgcccccaccaccgcggcctctccctcccacgcgcagagggcacgggcagaggccgccgcggcgccgtactcgccggcgcttcgtcggcctcggcctcgggtcgaggccggtggcggggcctcgtcagatcgccccccttcctgtgcagtaagtatttcccacggacccaatatggattcgttgttctaatcgatagctgctatcagagatgggttcttctgcgtgatttacctgttcttcacatcctctgtcgatatggggttgggtggggttcgtttcttgcgctaatgcaagatttgaacttgcaggcgtgctctgctgtgtgtgcgtgtgtgtggcaatggcgttgatgcggcggagagtcgggggctacatttgctcggagctgtgtggctcggttatgaatcagaggctgtactcttcgagggtggactggaagcagcttcggcctatgatcctcaagaggataaagaaccgggcaaaggagtatccaatcaagcgcatgattccagtagcggaggaggtagtcaaggctagagagattgtcaccaaaggtgtctcgacgctgcttcaagttgttcccatacattcatgcaagtaagggcgagaaatgtggaatttttatgtatttgtctgtttgtcttaacacttggggaagatagtatggctaaacaagtgttttatttgtagtagatcaacttcaatttaggcatgcactaaaaatgttccagaacatccagaaatggggcaacattacaagattaccagtcttctatagattaccgttgttattgtgtaccttgattgcatatagccatgattgcttttcttgccatgccaagttaagagcagctctctctgatgtgcatgtttgatatcattttcttgattcctgtcctaaaatattattgaatctttctaacaccttgtgtttctattctcactgaaggttttgtcccgaagttcatattggagctgtagggcatgagatgcaatcctgtcatggtttcaagcgtatgatcaagaaccagccgcataaatggggtccaggatgcttgaatgacatccttatccctgttgaatccttccacctggaaaacacgttccaggatgagataaaacatgaccagaggtttgatttccctcgtgtcccagcggtactcgagctctgccatcaggcaggtgcagatatacctgatgaagtttggcataggagtggcacgtcatctgcaatagtcagagaaaatgatgaaaaacctgctgcttttttgccagaagagcttagattcataggtcagaggacaatagaagcatgggaaaggcttagattaggtgtgacaaaactcctattggtttacccatccaaagtgtgtgagcgttgctctgaagtgcatgttgggctgtcagggcacaaggccagaatgtgtggggtattcaagttcgagggctggcgtggtaaacacaagtggaagaaagccgatgtggatgacctagttcctccaaagattgtttggcaccagcgacctcatgatccaccggttctggtcgacgctgggagagactattatggtcatgcacctgcggtcattgagctttgtatgcaagtgggcgcaagagcacccccaaaataccattgcatgatgaaggcgcaaggcctagcaccgccaattaaatgaggccaggggatctaaggagttgattgccaaattagatcagcaccatgatgttatacaggaattgtacagatcagacatcaaaagaccaatgcagagaaactccaaggttgcaaatgttgtgattttgcccaagacattagttctttgaagactgcatgttatcagaattcaggaggtcagaactaacacaattatttatacccattgatctgagtgagagccctcagatgataacaagggaaaattgtttctgtggacaacttcgtgcatggtaatttatcgactatcagcattgttaagtattcagagcgattactttgctgccctttcatttgttcatcctccatcatttgccaagaatacgggtggaagggctttatgagcctgctgtttggtcttcttctcctctgcttgactactgtaacatcattggtttctgctgttttgtgtaaactttctcacattacctagacatccttataggcagttctgttataagttagccatgtagagacgccttgttgcaagctgcaacatatggtgtggaacatcacagaggaatgtaatatcacttgctgtattgtaagccctagtcaaaatccctccttgaagctgtaatctgtgtacagatttttacctggggctccttttgctgtgccaataattacagccacgttggctgattttttttttctggagataaatgaatggatggtgaagtttttgttctttgtatttgaagttgaacattacctcgagtacttgaccccatatgttgctgatgttttttcagttcaagtaatcttgtctctctatgaatgcatcattctggaaattaaagattacttggttggtatttgatgcgtctaacctgttattaaattttctctgcaaaacgtgtcactcaattgtacttcttccgtttcaagttataagggaactgttcactttgatgcaaaaaaaaccttaccaaaatttggatgccaaaattttggcaacttaccaaaattttggcaggattttttatatagttaccaaaatttagcagcaaactaaatgtagccatttttttttgtaactttaccaaaatttggtaaggttgaaaatgacatcaaattgaataggcccaagatgtttttgattttggtcaaagtcaaagtattttaagtttaaccaaatttatagaaaaaaatagtaatatttataacaacagcatagtaattgaataaattttcataatatatttttcttggattaaaaatattattatattttttctataaaattagtctaatttaaaatagtttgactcgtaacctgaaatgtatggagtaccatgtaaacactttttaccgtatgtggccgtaacctggaaggaaacattagcagaatttgcaaccgacatgatttccttggctaccaatcttccttctgcgcgtgcaattttggtacttccgtcagttccgtgtcgccgacgtacccggatagaaaccgtgagagccaagtttggcagcggcgtacgaggaggattctactcgcgacctgggtagtggggaccgtagatgcgccgtcggacggccgagatcacgccacgtctaacaacttatccgacgtggactccacgtacgacttggactcctcggcttgaacctttcgcgtcccctcataaatacacgcgaggaggcgccccctgattcgtgcaatgcaaaaaacgaacgcgaagaacacgaatcctccggcgatctcgagcgcaacgatccccagagccaagaaacccgccgctgccgccgtgtcgccgtcgtcgaagttggcgagcagcaacaaggtcaccaaggtgtcgccgccgccgccgcagttgtccgcgctgtgggccgccgcctcgtcgtccg

SEQ ID NO: 32147 - DNA, 2926 bp, Oryza sativa
aaagtacgtcaagggccgcgcggcgtccaagaacaagtaccttgtcccccgccgcggcgaggaggatcaggcggcggagggcggcgggaacagcggcagcaagttgatgtccggggcgccggaggagttcggcctgccggcggggacgttcgacgcgttcgcggacgcggagggggaggacgccgccgcggccgcggcgccggcggcgactacgtgcacgtccgcgtgcagcagcgcaatgggcggaagacgctgaccaccgtgcaggggatcggcggcgagtacaactacgccaaggtgctccgcgacctcaagcgggagctctgctgcaacggcaacgtggtggaggacaaggagctcggcaagatcatccagctgcagggcgaccaccgcaacagcgtctccgacttcctcgccaaggccggcatggtccgcaaggacaacatcaaggtccacggattctaagtccagagagatcgtatatcacttgggttttagtataggttcttaattatcagttttgattagtataggttctggttcagtttagcagtgtgtcgtgtctgccgtaatggcttgcagtcgtcaggttgatcatgttaagcctcatacttcttttccgtattggtgtcaatggatgattttaagtatatcttgtttgcttactgttctctgaatacgtacttatccttgtgatgctctgcactttgcaacttgtgacacagatgatttttactggtgacaaaaaaaaattaaatactgaaaatatcgctctgaacaaatttgttggtgatacaaacaagtcaataatttcagagatcagcgtagtcgaagtcgtcgtcaaaatcttcgtcgtactctatctcacttacgtggctatgataatgtggtattgagctccacgggctgtcgtcgagcacgctccggaatcggctccgtaggaacgtgacggcctcccatgccgccatctgcttcgcctcctgcaccgacgacccgacctgcgtgaaacgcaagcaatcgcggttgagaacgttgacactcacggttacggcatggtagtcggcggcgccatcatcatcggcctccgtggtcgtcgtcgacgtcgtacgacggcggcggcggctagcgctgtaatagtaggttggctctttggttgctcccatgccgttgatgacctcccatagcagcagcgtggctccgaactccgtcaccggcggtggcaccatgctggcttcgacgcccaggtagcgctagctgcagcatgatgcactcccatggcgacgacggcttatggggtttttgctggtatctacggaagcagctggtccgcatgtcgtacgattgcaccgaccgcaatgcccaggaggagctgatcaccggaccatcaccggcggcgacggtgaccaccatgttcctctcgtcgtcgacgtaccaaatctgattctcggtgatcttgccgccggcgccggacgacgtgacatcgaacgcttggcaagaagcgtcgccgatgaagagcgcgtggccacgcagcctggggattctcgtcagccgcgtcttctttcgccaggatccccacgtctcgagtcgtgctcctcgaccacgtacaccttgaatctagatgtgtggtagcgcgccgcggcgcggccgccaccggtgtcggggacgcgggctctgccgaagtctctggaaactactagaaccttccccatcgtgtggcaggcaaccaggtagaactcgggcggccaaacgccggcgcctgcttgtcgacatgcgttcaccgccactggtcgctgggcaagtgcgagtagtgctcgatgtccgcgtcgtcgaaggcgaagatctcctccgcttcggtgacggcgtacagcttcccttccaagaacacgatgtcttggatgtagaacaccctgctaatgtccgaccaagcattatcatcatcatcgggatgatgtttcttcttcttcctccccgggaggtggcagacgaagatcttgcctagccgcgccacgaacctcgatcgggtcggcgcgggcgatcgcagctaccgtgatgccgccgccgccgtcgccgtcggcggcggcgggggatgcggacatgacgaccttggtgatggtctctgggttggtccacatcggcagcttcacggtcgccatggtgaaagggttgaggaggaagggctggtagggaggaggcgacgacgtgggcaccatcgccagccagttgtcgaacgagccccggcagacgacgtcggtggcgccgccgtggaggctgcagacgcggtggatggcggcgtcgtggaggctgacgcagtggccaggggccacgagccacgggacggcggggcgcgggtagtgcgaacgctcggcggctcgccatgctcggcacacggcggcgaagcggaggcggtctcccagggcggggagcctctgcaggacgtcgcggagcaggtcgtcggggaggtcacaccacaactgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggt

SEQ ID NO: 32148 - DNA, 9788 bp, Oryza sativa
tgtgctgtcctcaaacgttctcgtatcagcttaacttgttcttctgctgacttgagtatgtcaggaccgaataccaaggcttcgcccacctcattccagcacaagggagtgcggcaccttcttccgaacattgcctcattcggcgacatctgaatgctggcctgataactgttgttgtatgagaactcggcatacggcaaacaacgatcccaagtgccttcgaaatccaaggcacatgctcgcagcatgtcttctaggatctggtttactctttctgtctgaccatcggtctgcgggtggtaggccgtactaaaattcagatcagttccgagtgcttcatgcaattgcttccagaaccttgaggtgaactgagtgcctcgatccgacactattttcttgggacagccaaatctacatacgacatgagtcatgtagagttctgctagtttctttccatcataggtggtcttcactggcacgaaatgtgctgacttcgtgagtcggtccacgattacccaaatggagtcgtatccgctgggggttcttggcaaaccggtgatgaaatccattccgatctcttcccatttccactcgggaatcggtaggggttgtagcagtccagctggcctttggtgttctgccttgactctttggcaaatgtcacacaaggctacgtattctgcgacatctcgcttcattccagcccaccaaaagtatgccttgatatcttggtacatcttcgtacttcctggatgaatggagtaagcggactcatgagcttcctttaggatgagatttcttaactccttcttggccggtacacagatgcgtggaccgcaccaaattgtgccttgatcgtctatggagaaattggtgtctttcttctcctgtattctttttattaattcttttatcccttcgtcgtctttctgagcctcccggatttgcgactctagggtaggctgtactgtcaagctggcagggacacctgactgcaccacggtcagccttaacttctccaattctctgcacaggtgatcttggtcaggccgtatttgagctatattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcgcatctgttccctattaagtagtgcctccagatcttaagagcatgaatcacggctgccaactcgagatcatgggtggggtaattgacttcatgaggcctgagctgcctggatgcataggccacaacctttcgttcttgcattaggacacatcctaagccctgtcttgatgcatcacagaagatctcgaagtcttttcggatatctggcaaggtgagaactggggcagtggtcaatcttttcttcatttcttgaaagctgtcttcacaggctgtggaccattgaaatttcttttccttctttaacagctcggtcataggtctggctagcttagagaatccttcaatgaatcttcgataatatccagctaagccgaggaagctgcgaatctccgacacattcttgggcgggttccacgcaagtacagcttcaactttgctgggatctacttcgacaccgttggaggagatcacgtgaccaagaaaagctactcggtccaaccagaattcgcatttcgagaatttagcgaatagttgatgatctctgagcttttccattatcagcctcaggtgttcagcatgttcttcctcattcttagagtatatcaggatgtcatcgatgaataccactacaaactggtccaggtattccataaagattttgttcattaagttcatgaagaatgctggagcattggtgagtccgaaggacattactgtgaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgaggcaacgggtacttgttctttatagttacttcattcagggctctatagtcaattaccattctctcagagccatcctttttcttaaccagaagcactggggctccccaaggggatgagctaggtcgcacataacctttactttccagttcttcgatttgtcttttaacttctgctaactcattagcggccattcggtagggtctttttgcaattggagctgtgcctggtgccagttctatggcgaactcaatctctcggtctggtggcattcttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagttaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcaaacaggactattgcgggtacggagttgacagagaacatacccatcacaacgtctggagcatcctgagcggtttcagcttgaatgtgattcacacgtcctcgaccaaagtggttggaagcacgagaaccttgtccacttgcttgagagctaggacgagactgagctgccgctggagtaggagttctggcagtgctgccattagcatgtcctgggctggtgttggtaggattctgaggacactgtctagcatagtgacccatctggttgcaccggaaacactgaactgctgacggtccctgtggtgacttgaaggaggtaacactgtttggcgcagtgttgccactaggggcacgctgctgtggcggaggtgccggacggttcatctgaggacgaggggcgtagcttgactggcggttagcctgagtgaccgactgatggtattgcatgggctgaccgtagcgagggcgaggtgcgcctcgggaagaatttccctgatggttagacttgcgtttcttgtattcttcggtggcctcttttctggcatcctcaagtagaagtgctttgttgatcatatgttgaaaagtggggaagtcatgagcaagcaactggagtctcattccaactgcgattcctttcaagaatttcctgatctttttcttatcggtgtctacttcctcaggggcgtaccgagccaacttgttgaactgacttaggtactcattgacactgctgtggccttgcttgagtctgttaaattcttctttcttcatgtcaatagtgctttcaggcacatgagctacacggaaagccgtagcgaactcatcccaagcaatgttagtgggttcaggatgtgcattgcagtaattctcccaccaatctgcggcaggtcctcttagctggtgagaggcgtagagcgtcttctcaacaggagtacactgcactaagttgagttttctatccacatctttcaaccaatcgtcagcctcgacgggctcgatggtctgagagaactctggtggacgtgacctcagaaagtctgtcagcttggatctattgttgcccacgtgagggtggccatttccatgcgcattatgctgaaagctggctatggctgtggttagaccttgcaagatctgtgtctgaactgccattatgtgttgcatgttgttttccacatgaggtggggaagggaggcgttcttctccagaattgtgactggcagtgcggtgagagcggtgagactgctccaactctgcttcacgggaaactgtgcgatgcgagcggctgctgcggcgaggttgctcaacctctgcgttgcgggaaacagtacggtgcgaacggttgctgtggtgagaatgctcattagctggttcgtgatttgcttctgcttcaactctaccatcttcaaaaccaaagcggactggtgcacgagctgtacgacgggggcggctagccatctaaactcccagaaaagggcggggtaagagtcagataagcacttaggagggcaaggagcaaagcaaatagcaactcagatagcacacactaggcataaactggattttttcaaatcgtaaaaacacctgatacaacgggtgtggacaagtcacagagctacgccgagcttgactgtgcgcacacctcctaggagaaccagactaccaaacaacacccacatcaaacacacacacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcgactggagtgtgtccgggggtgtaggaagggctaactgggtgtgggtagggggagtacactggtgagtacggcgcacgcgagctgggggagcgcgggccactgggagtgcgagcagagccgcgggagctgtgggaggacaggtggctggcgtggcagagacggcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcgaccatgcgagtcagcactggctgagactcgctgtacggacaagggtatctggcgtctgcgtggccagaaggaagacgtggaagctgccggaaggcggagcctccgagacggtggccgtagtcgtgggccaggcggcgaagcgcagtccaggagaggtcctggtacgcgatctggagagtgggcctggccacagtgaagtggtgggggcgaaggccaactccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaaactggcgttcactgccatctacaattttgaaagaggaagaaaggatcagtaaccattttagaaacaaactattgaaaagaaagaagaagagagaaaccttagcttttcgcaagtagttttgaatctagtatccttagggtcgtcctaagcgtcgggtttcgccctagggccaagcctgtgctctgataccatctcttgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaaggatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgcgggagggaggagagagagggccggtggaccgggctcaccacgcgcggtcccgggtgggacccgcttgtcggcggctcggctcaccgtgagcggggtgcacgcggcgtgctagggtttggggaggggaggcgcggcgcatgcgcgcggctcgcggtgagggcggaggcggcgggcccacgtgcagcctcacggcttaccgcggaccacgcgcacggggagaaacggagggagcggctggccgggtcggcttatctggtcgcggccgaggtggcgccgacgtggcgcctacgtggcagccacgcgggtcggcggaaggtagacgaaggcccagccgaaacggacggcgggcggcggcggcgatcggcggagcgagccacggcgatacaagcgacagcgagtacaccgggtggttgcacgggacgcggggaggcgagccaacggctcggattcaccggagggagcttgacggcggcgaatcgcggcggcgacaaccggcggcgggaggagagggaaacggcgacgaggtcacgaggggccgattcccggcggtgggagcatctacgcggccacgggaactcgatgctagcgtcggatttggagggaacacgccgagggaggctggcgacgtgcgggtgctacggaactcgggcggcgacggcggcgagcacatggcgagcaacggcatcggtcggggcggcgccggccaactacgggaggtctactcgagctaaaaccgaagtctaagggggggagacggagcgaggagggagaacgaagcgaaacatcaccgcggaaaggagaggcgctgtgacgagaggccgacggcgcgggagtgatctctccggcctcgggccggggaagaggaagaagaggcgcggccggagtcctcttcggcgtccttgctcgtgccggctcctccgacacgcgcggcgacgatcggcgacggcgaaaacagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaattggcgacagggaggatgacgccggcggagaggtaaaggggaaaaaggaggggagaaagggggcttgcccctttgccggttcgggaaaaaggaggaggggagcggggcgacgcggcagagggagggggcgctgcctccgtcccttggcggcttgcgcgcggagtggcggggccgggtgatgacgacggcgatgacggggggaacgtcttggagcggagcggcgacaccggcgacaggcgtgcgcagaggctgacggcggcggcgaccgggcggtcggccacgcgcgcgcggctcgcaacgggaaggcgcggcggatggtgcggcgcggctcggcacgcgcgctggctgcggggccgagcggctgcaggctgcaggcggcagggcagcgggaccgggcggcatccacgcgggcgcgcgcgagcaacggcccgcggggagcggcagcgagggatggggagacggagagcgaggggggggcgctcggggcggcgcgcgagcagcgtgcgggcgaggctgagcggggggggggggagagcgcgccgggggagagagagagagagagagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacagaccaacccccctaacaagaatctcgtccccgagattcagcacctaagggagcagctccggaaactcggcgcggagaagatcttctcgttcccaggttgcttcatcttcagaatgattgctccattggactttgtagaacttgattgtcttccttcgagtctgacgttctgcttcttcaagaaccttgatcggtctttccttgtaggtcag

SEQ ID NO: 32149 - DNA, 7162 bp, Oryza sativa
atatgtaggagtacgtactaaagattagacgaagcaagatcactatctagctagcactaggtgccacgaataaatagaagtgcatgacgatcggagagcgctgggcgcctagcaacagctcccgcagcaactcgggataaaaaccgactcgatcgctcatcgcgttggaaaccgactcgatcgggcaccctgcaccctgttgtcgagtttcaaaacgggcctcgcgcatatccgccgcgggcgcagacgccgccaatggagggtcccgcgcagatgtggcgcttctttttgctttttttttttcccgctgctgattaccgcaccgtgtagggggactcaacatttaaaactttcaacttaagattttttgaaatttttaactaagattaaaaaatttcaagtcaagatttaaaaacttttcaactcggatttaaaaactttcaatttagaaaattttcaactcggatttgaaaactttcaattcagacttgaaaactttcaactgaagatttgaaactttcaactcaaaattttaaaaaatcaagtcaaaatttgaaaacttaacacatgtttgaaaacttttaactcagaattaaaaattttcacattcgacttaaatttgaaaacttccgtctcaaaattcaaaacatttaagttaaatttaagaaactttcaactgaaattcaaaactctcaactcatatttgaaggcgaaagattgaatttgttaaatatcgtaaaacaaatcatgcgtgtgtgtggagaataaaataggaagcgatttcaaaaaaaaaaaagaagcaatatcaggtgtaacacgtttcttagttccctcagctttacgctaagtttgaattgcatcattcaaccgcaatatcaggtgtaacacgtttcttaacttgcaaaaccggtgtacttgaggtctcagggcaatatatcgcatggttttgcctgacgtggttaatgggacctacatgagccccacatatgtcatcgaccaactcttcttcctcatctctctcacattcttccctcttttccccatccctctttagggcaggtgctgctctctcgccgcacaaaagcgtcgtcatcctattgcacacacggaggtgcggaaggacctccagccaatgtatacattaatcatcgaatctgcatctatcccactatatcagtatcggccaattggttcattggtacagttctttctgtcatctttgttatagtctctaatgacatgaattaatacatagaatttatattagacttgtaaaaaggtagagtctattaacaaatttatattaggcatgaattaatgcaatttcaaattcaacttgtaaaggttgtaaaaaaataacaaattttgttacaacccgcagaagtcaaatttgaacttgcattttgtgaaatgatatattaattgcacatgaatctatcttgtcaatttttttaaaaaaaaaatcataactatttagttgacattcatggtcactgctgtagtagtacaacatactccctctgtctaaaaaaaatctaggattggatgtgacatatcctagtacaatgaatcaggacggactaggatatatcacattcagtcttaggtttattttttgtgggacggagggagtatatagtaacctcttaccgctttatgtgattcctgctgaaatatttggaagtccggacaaaatacagccttcttttttgccgggtcggccgaccactttcattaagatttgagggagaaaaataataaattgttacaaacgacaatactacgatgtcgtgccagttcgggaaagatccccggtccagctaagaacgaaagagaaagaaaagaaaatagccggggcaaatcctcgagacctatccaccgtgatcactcgccaaattgggaaaagatcccagccactctccatacagtaattgcagtgacctgcatatagcctagtggttacagtgacttgagtagtaccccaaaatcctgagttcaaatctccatatgagcaaatttcagattgggttgtttatggagctagattccctatttcaatggcagtatatatacagttggttgtagaggtcgggtaaaaaaaaaacccttctctaaaaaaaatacagcaatttcctctcttatatcctccgctagttgctccggtaacttggacacatgctgaaatattcttgcattacgttccttccaaatcaaccagcaaattagcatgaatgcactgtcgaaatccgacatgtagctcgtccgaaaacaacgtcttgttgcaagccaccaatcggccagagtattgacatcatccgccgggattgcgaagttagcattgcaccatcttcagagaaggatgtgtggtgcaagaagctttcaatagaaacaactgaggaggggcatcaacatcatcaactaccctctagctatatcatccttgtcagaatgatacatctttgtcagggatatttcattctgcacataatcacaatatctggttaacacatctttgtcagggatgaaaaagccttcgaaacttctgcatattgcttgcctttgcttgtaagatttcttttttgtgttcttattgtttctgaagagcgtgtttgtaaggaacatcccaatggcgtacaagatgaaagggatcttcaagggactcaaggtcatctctcagatctttggtcagtacaatagtacaatgttttgggcttttcatgctcctctgcatctaatctcctttcttgcttgctgacatctctcattttctactgacggtcttctttcttgcattctctgaatggtttttgcagtagtgaaggagcatgagatgcagattggtagtccgacagacgtgaagcatgtcgcgcacatcggttgggatggcctgacagggaatgcttctccaagctgggtaaatgtacctgaatttcagtgaaatgatacaatcatcttcttgtttcaaattgtctgatttctctcatctgttctttagatgaatgacatcagggcatcgtctgaacttctgtctttgggcaactttgcaccatctgcagggacctcttgggcttctcaaggtatggcaagaattacttgttcttcagagtggaagattttctgtgttggtgcgattgcttcatatgattgtggcttctttgggaaaggctttggtctgtcttatgagtggcatgtatggataagcatgcaaacttggcaagttactctagtttaatcctagaatcatgggcacgtctgcatgttcttgatctgggatccggagttgcagggaacactccgataaaacaaatccacacttctgatttcctaactaccagcagcatcttttgccaggcaatggattgtgtgtacacatgattactgaaccttttgaaagaaaacttgatgaatgataaaaacatgtaagcctctggtaatcctcttcaatcattatgtgattgatggttagaatcacgagaatcgaaatttattacgagttaagtaagtgtgaggaagttcagagaaaacaatgtttaaccaagaacaatacactgtatcatgcatagtttaatactgcaatacggagtgagctcgagacgtggtctagctaataaactagcagaaattttcttgttgaactcatatggcaggacaggattcggatttgataagaacatgatgtccattgtccactcatgcataaatagatccttcccaaggcacaaacaccgtagattagattcccattgtcacaaactgctgtctgacagacaacaaacaagcatgctaatggccacggaacgactgaaattttgcatgatcactcaacatattcagttaaacactgctgcaacaatgcagttcttggacagcatcagcaatcggccatgtcgatcctaatgtcttcttggcactcacatgctgatctgcttccactgttgggacagatttcgaccagcctcgagactcgtcgtccttcgccacgccgtcagagaacaccagcctgcagcagcaagaagcggcgccgcctcctgacataccacgcccgccggcggcgaggaagacgaggcggaagcggaggtccacgagcgactgcccggtgccttcttcttcttcttcggcgagacccagctgcgattccaccatggcgcctgcttccgacgccaatgcgtcgcaagatcaaaactgcaactctgcaacgtgaagtgcagcactgatcgaatttccgggtgtgctactgctacttgcgcagagagtgctgtacatcgttgtctgttcagtgctctctgctttgcgccaactgtacatgtaaatgggtttggagtttggagtgcagattaatcggcgatcgtacggagaaattggaatgtgatcgccgtttgtgtgtttgattgtgactaaccagagaagttaatttgatgttcaaggatagggatttcgatgagtaggccccaattgcctctgcactactctgtagtctgtcctgcctggccggattactgtcaggtgaccacatatttttctcttctagaaaaagagaagttttttttagtgaaaaaaaagttctcccaccaattttaagagttattgagaggtattacctctgcttttaaatttatgacattgttgatttttggatatttcatttgactatttgttttataaaaaaaagctactcatttcattctagaaaataaaccaaagatttaccttataaattgtttttttatgaagggtgtatgtaagtatcatttattttgtgttttaaactaaaattatcattattttattattaaagacactctaaatatgactaatatttttttatatttatattttttgaatgagatgaatgatcaaacgtcatattcaaaagtcaatagcgtcatacatttaaaaacacatggagtattatatcttctagcattatttttttttcgccgggcttctagcattaatttgcctgaaactaataaaagttacttgtgatgggatgaacaggggagtgactaaaaagaactaagacacttggaaaagcctgcaaaaacaatcatgttgccttctggataaactgatatcacaattgccagtgtggaatctcagcgccggctctccagcctccagccatgcgtattccctgacgctaaagaacaagttgagcaagccaaccagagactaagattcgttcaaacaatgcagtacaagattcctaccaatggtggacagtttttatatcagctccactgttttaatttatacacatggttaatatgcagttatgttccaagccccagcctagctatagtctctgcttgtctcttccggagccgatgaactgatgaacaccgagatgcttttggttggataagatgccgttcgtccctgaattctctgaatccgtcctacttctggtctgtttatagctggatcatcatttcggtttgttgccgagtgaaccaagaacagaaaggattttaggtgcacctttcgctctgacgctgatgaatgatgagtaggaggttgacattgtcacaggtctgccattgctgaattcttaagtttagtacgatccctgaaggtcaatatcaaatcggtgttaatgtgtgtagatggtactaagtttgttgcagtgatcattttcagaaattgtatagtacttgtgctgttccctaacccagctagccttgactgactgcaaaatattcttagctagagcagattcgtgtgccagatggttcctacctcgaaatatgtcttaaatagtacgttttgttcttcaatatctcagagtgatacctgattcagacttcgaaatatatcttaaatagtatattttgttcttaaatacctgattcagactctaggcaatttttactccatttcttgtacttgtactattccctaacgcagctagccttgactggctgcaaaatattcttagctagagaagattcttgtgccagataattccaacctccaaatgtatcctaaatagcagtatagtacattttgttcttcaatatctcaaagagtaatacctgattcatacttcgaaatatactacctccgttttttaagtacataacgctgttgactttttacatcatgtttgaccattcgttttattaaaaaaaattaactaaatattttttcttctgttgtggcttgatttatcacttaagtaccattaagcattacttataacttttaagatgtatacaaaattttcgaataagactaatggttaaatgttgtaacaaaagtcaacaacgtcgtatattaaaaaactgagggtatatcttaaaagtacattttttcttcaatatcaaaaagagtaatatatcttaatagcatttgatcggcctaatcctttggccaacccggcaacaaaagagtaatacctgattcatactgcaggcactttttactccatttctccactggtctttgtcacaaatgtcttgaaatggcaaggtaacctaaaagaactttttgataaatctttatactagtacttttacagctgccaagttgtcataaaaaagtttagtacattaaagtcagtactaaggattaaggaatatggataacagtcagacatgtcaagtggcattgtttaaagagcaaaacttatccacactatgaaaagagattttcctagcagagtcggagataggatcttcatggaaagaaaatagtctgcaagttactactaaatactaacataagtgtgaccttttctagacaactaatctgatgtataaagtataaacaactgggcctatacatatcatatatgattagtaaggcaacatgctatgctccatattctatcttcagagcaaggaatttcacatgaacttcgtgagaaccttttgccttaatcagttcatttccggtaggagacggaaaattttcagcgttctagaagagcccgaaaagaacatgttcaatatctccactcaatcttaatgaaatttggccggcctaatcgttcagccgacccgacaaaatagaacatggtcaatatgatgtttggaagtcttcaaaactaactatatacagtacaattggaaatgctcctgaaaattcaaaccagttaatgaattccattatttaaagaaacaaattcaaaccagttgaatgagaatcacatgcctacatc

SEQ ID NO: 32150 - DNA, 15395 bp, Oryza sativa
  unsure (1)..(15395): unsure at all n locations
ttgtacttattctgactgaataagcagaggcaagtggcactttctggtcactaaaaaaagattagcttcttgtattaacaagtattacagcctgcttctacctagtgagcgatcacatcactgacgtttgcagaggtgcaagggcactcatttaactattgatagaatgtaaactgactgaactagttgattaatgattatacttagttattaaagtttgagaatttaacattgcacttaacactctgcaggtactaagttgctatcttctagtaatagatttacaggtcaatacctgtacttcagaagaatgaatgcagcgtgaaaatttactaagtattacgatgacataattaaggtatgcagtaacacatagataaatgactaccctgtcacatagataaatgaattgtactgaaagtttgcctaaacttggaaatttttaacaattgaatacttagaaagaactgaagctatgcgtacaaattaaatttcctcactggcgtatgcactagctagattatctcttcctacttgtttattgttctccaatagttgaatacttatttttctaagcgagtggtacgatcagacagctcaacagcatgataggaattaggtttctgatcatcagctgacacaagagagtgatatatgaacactatcgttgtatacgattaattaaactgaatactgacagtacacattaacagtacaatcaatcatccgaggtaatttatcaacatggagagagggaccaagcagagccctttcttcctcagctcattacattcatacaaggacttgtcgttgttgttatcaacactgactgtttcttgaagcacttcagccgccggctgtcgtgaactggcatcgacaaaatacttggcctgcaatgttaagtaaacttgtaaggaaacatacatggatacatataattgggttctgaacaaagaaagaaaatatagagaaactgtttcagaaacttaccagctgtgtgatgttgatatctttagcctccattgttgccattgacttcatatcaacattgttcaagttgctagttaactgtaaaacaacagatggtagctatgtaagaaatgcaggttatatatgtaatgttgttttgaacaacaagaagagatgaacagatgaacaggcatacaggcagaatcttttctaaccttaggggcagctgcagaagaacaggcagtgtcctgcaaggaatcatcgtcatcgtcgtcgtcacacatcatctccgacgtgatgaacgatgcgtcgtcataggaagtagcaaacgaagaagagaagccagaggagaagctgctgctgccagagatcactggttcctggcacatctcctggctgttgtacggtgatgccaagaagttcgcaatgtgcatcgcccagctgctctctccagctgacatggacgacgtctcagctgctgggctaatgcaagaagagtaatgagatgtgttgttctccatgtgtgattctttctagctcgacctgtctctctctctgaatttgtgcctagcaatatgcagcagtagcagtgtgtagctagagctggatgatggtgtgtttatatatagctgcaagaatgcagagaatggatatgatacacaagagaatgaactgtctgtcagagactgaggcaggccagcattggaaaaactaatgctagctctatgggaatcttctcgttgcaattgtttaattcttgcgatggagaattattctacagtagtatacaagtatgattattatggtgatgatggtttttatattgtgctggtgattaggccgaggcggttgggacatacaccatccaatgatccccagtgagagctccacttcacctactgctaattgcagcttctctcttaccaattcactgtactcttggccaattcttagccttaaatctgaactgaactgaatataatatataaaatgcaaattaaagctcctgcctttctttcagaagaaaatctatcggaactgaaaatgcagtacactaataatatattatctccatttgcatctaacttctacggatgaacagctagctacccctgttccagtactaagcttttgacgacttcgcgagtaataatggcgaaaagttgcatgtagtagtagtcttggcctcttcttagccttaaatcttaactgaactgaacataatactcccttaattccataattataaggcacgactaatttttaaagttgtttcataatataaggtatgcatgcatgcatgtcattaactagcacatcttttacactaaaatattattatttgaatcctccatcatcaaaatctctaattttattaggtgcatgcattctatttattaggttaatccaaactatgaggtgatgataattatttcttggtatttgtgttaagggtggttgtgtcttatattttggaatggaaggagtataacatacaaaaaagcattgctcttgccttatcttatgaaaagaaaatctgaactgaaaaatacaaatacagtgctaataatatatttccatttgcaatttctactgatgaacagctagctatcccagttgcagacttgcagtagtcctgagctttttttgacgaattccggagcaataatggcgaaaagttcccttgcaatggaggatgcagcagtagtactgaactactgaagagaagacgaatcaggattcagagggattaagatacgctgcattttctctagccgatccattctgatcatgccgggcgatcgggcgccaaagaccaaatcgggccgtggtccattgctcatatcaggcacgtaatcagagtcgtctctacctaatccgatcatgtggatgatcacaaatttcacacgaaatgacacgatcttaagcagagggacggccaatatgcatgcatgcatgcaaagaccgtatctcgcggaaaccatagtttaactagatttttatctctgaaacaactcaagcaagcttttctgaggtgtgatagatgatgatacggcggtgtgatgaactgataatatatacaatctgcatatgcttgcatggtttgcttaacaaaggattaatccatgcagctagtagcatgcaactgttataatgcagccaataacaataagcaagtggtcaaatcaaaaaattcaaaaaccaaaatcgaactgaaaattaaatcacatcgaccattacagacaagtgtgtacagctcatcactctgttctgtgtgaggtgtcatgtgggcaatgcagggggtggggcccacatgtcagtcaatgaggtaggcatcgctcctaggtgacgtcatctcgcgcgtatctatcggatcctgagttagttggtcgcgcgcggcgcgcaatccagacagatgaacggctggccgggtcaatgcgtgaatacgtagttgatgattcgtataattaactccatcgtctaagtacctagctacagtagcctagtgttcatagccagtagctaccaatttaacaatcttgcagcacacccggcgtagcctcaaccattgattagagatttagaaaaactcagcgcgtgtgctcgtttttctcacaagcatatacatacacaacatttagttatatttagtgcaactggtggtgtctatcaagaaattagctgtacgtcatatatacctatcgatagcgaggagtccatcactttatcaattttaagatataccgctccagaatgcatgcacttatagatttaggtgtacgtgcgttcatatgggtgggtgtgcgcgtgttgtgtttctaaaaagaaataatcttattttggttaatttttgatgcagcctattagcatcaagccatgtgttgatcgatgaagcgctggctgacgttctcgtggacgaatggagattctagatctcagcgacaacgacatgacttgctaacgaacgcgcgacaacaaagaggatcatcgtggatatgccgatatggctcaactgctcaatatagaatttgctaaggccctgtttagttctaaaaactttttctcaaaaacatcacatcgaatctttgaaaatatgcatggagtattaaatgtagataaatttaaaaactaattacacagttagggaaaaaatcgcgagacgaatcttttgaatctaattagttcataattagccataagtgctacagtagcccacatgtattaatgacggattaattaggctcaaaagattattctcgctgtttctaggcaagttatgaaattagttttttcattcgtatccaaaaaccccttccgatatccggtcaaacgtccgatgtgacaaaaaaaggccctaagtaaaattgtttttgttagaaatgaaagaggtaggaagagagagattttatttatacccaacttagcgattttatatatatggtgatgggatggacaatagctagcttggtcgtccagtagttgagtcagcccaagacgaagtgtcgcatcatcgccaaccaaaactcatcagtcatcacggtaatgaatgtcaacttgccaagaaaagaaactcataaggaattaaaaaaatctacagttaagctaccagtgtgaattctcatttctcaaccccctgtgctcaacctatgcaagtggaactgtggaaggccttgtttagttgctattttttttttcaaaaacatcacatctaatctttggataccgtagaacattaaatatagataaaataaaaaactaattgtacagtttgcatgaaaaatcgcgagacgaatcttttaagcctaattagtccatgattagtcataagtactacagtaacccacatatgctaatggtggattaattaggcttaataaattcgtctcgcggtttctaggcgagttatgaaatttgttttctcattcgtgtcaaaaactccttccgatattcggtcaaatgtccgatgtgacgcttaaaaattacttttttcgcgaactaaacaaggccgaaatatggatcctccgtcttgacgatcactataagaatactttctggggttcgcatcaaatgctacagatacaaacgccaccaatgcagtttcagtccacagttaaatttccctggtaaaaaaaagggttgggaaaaaaaatcaaggattcaaaaaagaagaaaaaaagtatatatatcacgttttgacaatcttttattatcgatgtttcactttgaaccaccttttaattaactattatttttattttggacatgataattttacctttgtgatatttagacaatctacatcaattttgtcatacataaaaaaacggtctacatacatccgagggagtttattgacgagtaagagatggcgtacacaaggttgttcatatgcttgagaagagagtcaggtgatccaaagtaaaacatagataatattatctggcctaaaataaaaatattggttaaatgacagctcaaaacattaagaaaaacatcggtaacacaagatagctcaaagtaaaatatacattaagaaaaaagaatgggaacgcgggccaggtcacggcctcaaaccggcgagcccattcggatccccacggcccatgattggctaaagcccattaaatcctcgtagaaaaaaaggcccagtaaaccactcaccacgacactcccccccacttcgtcgtctccgcgcgccgccgccgccgccgccgtcgcgcggcgcaccaagccaccaatcctcccgccccccaccaccgcggcgccgagcccgcgcgcgcgcggngctgaaatggcgccgctgaagcccccgccgccgcggctcctcctcaacggcgtctcctgcatgcggaacgcgcaggcggtgctccgcgacatcaacgtcagcgtccacgacgggacggcgctggtgctcaccggcgccaacggctccggcaagagcaccttcctgcggatgctcgccggcttctcgcgcccctcggcgggggaggtcctctggaacggccacgacatcacctccccgggcgtgttccagcagtacaagcttcagctcaactggatgtcgctcaaggacgccgtcaaggagaagctcaccgtgctcgagaacgtgcagtggttcgagctcctcgaggggaagcacggcaagtcggccccggccatcgagctcatggggctcggcaggctcatgaacgagaaggcgaggatgctctccatgggccagaggaagaggctccagctcgccaggctgctcgccatcgatcgcccgatctggctcctggacgagccgtccgtcgcgctggatgccgagggtgtcaagctgctggagtacatcatagcggagcaccgcaagaagggtgggatcgtgttcgtcgccacgcatttgcccatcgagattgaggatgccatgtcgctccggctcccgcaacggttccctcggaggaaaactttggttgatcttgtgcgttgatgtggggtcaagaattcagctgtatgattctaattcatctccattcatatgaaatccgttggaacaacttcttgatggttcagttttgtgacactttctttcggaaattaacaatgcactcaccatttgaatatgtatgccggttcctttttgctaacataacatacattgaatttggtgcattcacatgtatatgctggtggtgggttattctgttccctaatcaatgtagaaattgaagagtatttgatcatgagttgtgtattcactcgagaagtttcaagtggggggagatcaggtggaggaaatgctgaccaattttgtctgaaggaaatattgactgaatcaggtaacctattgctggtttaagagtaatttcgctgtacacattcaaattgaaacattcctgaatctcatgtattgactaatgtagattatgtacatatagttatgtttgtctgaaatttgtgtacaatggtacatcttacatatatttttgtttacaagcacaatagtttcaaatggcttactgttagttcatttttagggtctgtgctggctagtgcaatatacaactcaaccatgtctgatctacattaactaattattctgcctggtatacattttccggctggtgtttctccttcctatttgaatttttggacaaaaggcatgatggccctgcttttactgaaaacataacagctgtctttcctatttgaatttacttatttgtgtgcaattctcatgaatttaagttaggatgcccctgtagaattgagcaagtatgttggtttatctagaaatttgccatctaatggaagtctcaaatgtttggtatgaatatgaaaagatcctatcgtggtcttctgaatctctaacttatggcttgttacgaatatggcatcacattttgcacgcatgggtgtaatgatgtgcaatagtgttgtgttgttttatactctcattcactcattcctgctgtaaaagattctaacctgttgtgttcataaatataggcctcagatgttcttggggaagtagcttgctttgttgattttatgaacacttctgacctctgtatgccatatgctgaaattaaattttctgtgctctgtactgttttaaaactatttcaggtggcaatcttttgcgttatgtgtagcacattccattcttctacatttttctggcaacagtatcgaagttttccttttgtccttgtataattcattaattctattatgcttgtatacttctaacttataaacctaaactgatgttcacattgatttcagatgcaaagtatgatcaagcactattttgaacttgaagagtagactggatctttcacactgattttctcttcgctgtaatgtgaaatagaagatcattgcactaaccagtcacattcgccttaagttgaatatggaaagtaatgtgcagtagcaatctcgtatgtccatctatgactactcaaattctagttcctactctgaactttcatgtattagtatttacctgctagcttcaaatttctgcaagctactagctttattatcatcagtaatctatcattctgggcaaaccatcatatttttttcttagatgtacaaataatttctgcattattttgtatacggaaatatgtaagatcagtataaccattgtaagtgtttccattctccaaccatgttgttccctctagactaataaaaggtagattttcaagagagatatgcatatctccctctcttgcaatgttatctctttgtacagggaaaaacatatattatttgggagcaatagctaaaatgaagttaaaattttatttccacctgatactctttgagtaacatcatcttgctgatagcaagtcgaatggtctgggatagtttacattcagtatactaggctggtctgtgactctgtgttaactctggtactacacaggtgcaggctgtaacaagggagcactgaatgctccactaataagtccccagggaccattggaggtgctatctgaccccatgctggaagtagctggcccactattcaagacaaggtataaagccacttcccagtccagcaccaagccaccaatactacataaatgcgcactgttcttttgctgtattttgtttggttgttaccttctcttcaggcccaatctagaggatgctagcgtggaatatgtgcgcaatggatcacggtcgaaaattatctttatattgcaaacgatcaggtctagcccagatctgagataacttgttatttttttctaaatgaaaattactgatccgtggtggaattcaattaggatcttggccatctggttcaatacagttgtgttgaaatgctcatgttgtcatctgacataagattgtgattgccctctatcgcgttggtgaactttgttttctcttcactttataaatcccatgtttttcaattgcagagagaagcctccggtttgcattctacaagaaccaagaagggtggtaacttgttgaggtcaaacagaatatttaggatggtttgacacattacgtagcattaattgtcaaaatgctattctattaactaaagggctattggatgtgggaagactgagagtatagataaattgcctgaaataggtagaataactttatgaaaaaagtattggatgtggagacttgagagactggtatatccgtccactcattttcaaagatgatcttttggtttatcagtcctcttattttcaaagataattgttccattagttatctcttcatatcttaggagatatatttggtttgttcctgcaattactactgttttccagcacataaaccttagttatgtttaaatgtttaataattgtgatggaaggagaaagacaactaattgcattgagaaggaggcctgaagatccaaatatagacaagctctaacaggtttgcagcttactcccaagttcagcttactacttgtagcttcacatgtgtgtataaactacttgcattaaattgtcatcatggaagactaccactattaaactggaaaggtatgatatgccattcagataaagctcccaattaattggcagcttagctctttcttttccgagagctgaaacagtatttggagttatggatgggctggtttttattaaacactggagtagaaggaatatgacaatgatacctagagtatatttatgacattaaaactaatgtttgctagaattcaagcatcatgctgatttagctttaaaggatggcctaaaaggggaacttcttctctgtttgcctggttgtgcttaagagaatatgcatgggccaagtgcccaacccttataaatattgccaggtgaaattgttcaccatgcctgcctcttgtttgcactctttccttaaagactgttgtagttggccacatcaaacatttaatcacagattcaaatcctatatcattccttaaaggaacaaatataacgcacacacacacacaaggccttattaatacccatactaatgtgaaaaggtgcagtgaagtgcttgatttccccaaaagtctaggactgagacatggggcataagccataatgtagcgctgccagtacgtcctctctctagggcatactataataactgcttgcactcagatgtcaataccactctgctttaaggcctgatgtttacataattagtacatcataaaactttggaatcggcacttatacttcaacaagcacaataatacaaggccgagtcccacatgtcaatgtcaatgggcattattagtataatttgtatgacttggaaacagtgcttgcattcattcatcaggttgcttaaatgacaagcacttttaatcaaagttcattttaaaaacatatggtgctaagcttacatgatgttagtttttttttttgggtccttttttccatgtttgctacaatccttttgtgtacagtttcattttggcacaagcaagctagaggattctgtctatatacaaagtaagagaaacttgtaagtaaatattaagattaatacggttcctatttgtggggtccacaacggccatgttaggcagggaaggtagccacatctgctgtagtccatcataacgaaagaaagatgttcaccaatgatatggagatacttgtcatgtgttatatccacggattctccgatggaaaggaagatgctatgaagaaaacaaacgctagtttcactttctcgattaataattgtgctacatcatagactacttcaattcttgaaagaaagaaacttatccagtggagcaagttggttgctcctgaagattggatatcaccatcattatggtgtaattctgcggttggttagagatttctctttctaaaagtttgtcatgcctagtgtatcacagacttaagcaaatgctcatctggaattttcccttgatgcttggaaaaataatgggaccaactactttaagtttgcctgtaataaaccggaaaaatagagaaaacaaagtaacattagtacatgccagccaatttaaggagatgaaattgtttaatttaggttgttttaaattaacatttctaagttttagacaattgaaggaggcaagattgtgtataaataggttgctttatatagtagacagttctggaccctaggagtacatagattgtgttctttggtattcataggtaggtttgagagaattgaattcatagaacacgttttcagccctcaatgtggatatccatcgaaaccctgagagtggtctgtctaaattattcaaattatttgaagtacactaccgctaattatttctcttttttctcttcgaaaatgtccttatcaatcatacatgtaccagagcaaaattttaactcgggaaaaggaaattgcttaacagagataattatgatattgaagtgtggttgacaaatatatgaaaaattgaaaagaagaaagcgatgcatataggtattttaaccattaaaactttccttaaaagggggcactcactttctttatcataaacagttgcttattttccttgcactgtaccatgtacgtgaatacgttctttctcatgtgcatgagttactctgattgttttttttatatatatcaaagagtacgctgattgttacatttgtcaaaagaaacactctgcctttttttcctttgtgtaccttttttatatattacatgtatgcatgctgagtctgctgtatgggctacaggtagctcagctggtcatgcaaactactagctgagtcgattgtatatctagccaatcctctggattattactgaatactgattgatgggtactgacgtcaattagctagtatttacattccttgctcgggttcttccaggctccagcagctcacccatcagtttgcacttccgattttctctgcagaatgcaattttctgatgcatagatgcatagtcaatgatgttgctcatgtccgttatattggcttgtgtttttcgacagggatgttggaaagagttctgcataaatcgaaggaaaggagtggcccttactgagcaggaataaaggaaagggtacagtgaaaaacttatagcaaaacaccggcaatcacttctcagctcatacctaaacaggtatgcaagtcaattggttaccttttttagatgccttggtaatagtatttctttgcttactatattttcttggatttcagcatcagtttctccttaaagttgtggtactgttgacagaaaacacgaggcctgggagatctgcttaactccagtgcaggtccaaagctcgccttcgaatgtatgagcgtgccagttgatttgatcctgtaatcaacaagaaatagaagcaaagaaaccgcatttaaatctataaatgatagccgatcggctaggtgccgatgacatatcatttatctttgagccgatgtcatatatacatcgatcggcagtcattaataaataagaagggactaaatctactcgatcggctgcagatattgacaatatataatctttgtatcgatatatacttaaatcaagtgattggaatagatcggtcgccatgccgagacaatataaatcacttaaatcgaaatatatattaataatgagactatatacattcatagcatagccgatcaaatagatctagcctgtatcggctaatactccgataccactctatattaagatattaaagcaagtagaatatactagacaaaagcctaatatacttaaatgcagcaagatcttaacataaagggcagatttaacatgtcaatcaagcatataggataaaaagtagttaaatcaggtaagatcggctgaaactccgacactaccctaatcggcaaccagagtacatgctagagattgatattctaagcacgacttaagagatcaaattcggctgatgcagcattaagtatgaaaagaagaacaatatctagacaatcaagccgctggaagtttcatagagtggtagatatcttatataatctaggtcaacgtcgctatttaaccaaatcggctgccttctgttaacagatgttagccgattgtaggttagatgacgatattgtcgaagattatgtaagatatataataacttgacgaattacatagacaagattagagtatcataaagatggaagcactaatctcgagaacataattcatcataacaagttttacctcttgttgaagatcgaaaccgatgcagctcaacccgaaagcaagaactcgttgaaataaaattaaagcaaaaaggtggcgatgcgccgagattgtattgagcgtgtgtgttaaaagttacatagggctcgggtctatttatacccgaaaattacaagatatgtccataacggacatgacaactatctctaacaaactctaagataccataagtctttacggcagacttttgctcaagcatatctctaaggaaattacataaaacactctaattaatagacacaattgccttctcaggactctatccatgtgcggcaatcaccttgaagcacctcaattcaacccgatgtcatacatcaagtcgcattgtcggaatcggttgcatcggcttgcctagcctgactcagacccagctgatcctaatcgtagccgatctggactccagctgattcctgctctgtttccgaactcgatctccgcctccgactttgcttcgatctaatcttctttcccgatgccgaaattaccaaatttggttgtgaacaggtacaccaaaagaattcagtatagaaggtttcctgattcttgtcaaaggtagtcctataaggttatagacagctcagccatatctgcgcatgtggcctccagctttcatatggcttgttgagttttatccaaaccgtcgtaatgagatttgatggctcctaagaccttattagttattgtatacttgaaagtcgtctcacctaaaatttcaattttttccccttttcatttcagaaaaggaggcgatagctctagcattaaaaaaaaaaggaaatacgcccatgttaggacctgaaccaaagttaggtaggtagggtgcagccattgtttttagagaaaaatccctgaattttctcttgtttttactgtgacaaactgactgtaacatccacatcctttcacttcagcttgacaatttgatggagtacatactactatcccaattatgatcacaagaatgtcaagaaccactcctactagacatatgctgtgtttagttcacgctaaaattggaagtttggttgaaattggaacgatgtgacggaaaagttgaaagtttatgtgtgtaggaaaattttgatatgatggaaaatttagaagtttgaagaaatattttggaactaaacacggcgataccaacccatcgtagttgggtagctagcagttgactcctcataaatgaatatctgaaatacacacaccaaagtcacactcatactatttttttttctcttcttcccattttgtttgttctgcagggaagattagaagaaagcctaaaacaaagacctccctcctcctccggttcgacgggcgtggcgtagctgtacccggccccgccaatgtaaatgtgcgcttgtctagttcttcagcttgggtcaggaggacctcatggccatgggggccattgcttgcaacgcatgccccgagactgatgcaatgttgtgacagggagcgtggcaggcagcgtccgtccacgagatgagatgatgggggatcgaagcagaagcagaggagcagcatgcagtagtttttctggctggctgatcttgcaacaaattggtaagcactttcggctgggctgaggttctagatggtgtggtgtactggttctagtaccaccactaccacacctgctcaaccgcaaagctctttggattgtatcgccaacaaaatttgccacccaaaaagcagcttttctgcagatggtactactagctcgttgctgacttggagtgtagggtgctgtgcatgtatgcagatgcatgtcgtgctccatggggaagaagacggggttggttcttggttcttgttgcacggcaggcagcggcagattgaggtgagctggtgaggtgaccatcgtcgtaagggtaaggcttcccaaatgctaagctaaaagttcatttgatacagtattcaagtactctgtaccacatgaatttgccttggtgtcaattgtggatgtgcaaatttgctaaacaacaaattgaagtgttcaatcttgtaataataccagtactcactttctagtttctacttcaattcaattccttgcatttatgatagtagtccagaaagtgaggcatcattcagccattgatcatgagagatggccgttttgacctcttctaaccagttactcgtattaatgaattacagttacaggtcttacgcactggaagtctcattgttcaacttcaacc

SEQ ID NO: 32151 - DNA, 7891 bp, Oryza sativa
tgtaattctacgtgatcttcctatatatcgatctctatgttaatgaaccactgtcaggcttgctggtgcacggaaagagaatagtgctgtagccaagccaacggcgccggtgccgtggactcgtggagcctgggtgacgaagagcttttttttttgccggctaatttttaagggcattttttggtgattgacaatggtgacattggcggcgaagccttatcagggttgggagtagtatatgataaattacagggaaccaactcccagactacacggactgtcatagtccgggagctgtgtcgtagtccgggagctgttccgtcgggtgtacaatttatcgtatactactcccaatcctaaaattttagtccttattttcttcttaaatgctgctctccacaagtcgcaagcacctcttgtgccatgtttagttccaaatttattcttactttcaactttttcatcatatcaaaggctatgtttagttcacaccaaaattagaagtttggttgaaattagaacaatgtgacggaaaagttgaaaatttgtgtgtgtaggaaagttttgatgtgatggaaaagttggaagtttgaaaaattattttgaaactaaacacgacctttcctacacacacaaacttctaacttttctatcacatcgttccaatttcaaccaaactttcaattttgatgtgaactaaacacagccttgctcccaatcgccaagttggcacgcacctggagagttttcacacgggagtacgaaaagagcgattttgtttggaagtttcatatgtggtccaccttttttgagtttaaattagattctctcttataggtgaaaatattttcatcccttaaatcctattagagaagggggtttatttttaaccgtctatcggtaatgctcagatgatgtatttaggatcgacgaacgacatgatgggtcgttcgcttgtttgctttacaagaatatacgttgaggtgaaatgaagtggaacgacttggttttattcagtctattggtatcataattcagacaattgtaaccatggttttgtttgggctctttaaaaattatatatataatcagttaccaatagatgcgacgaaaaagagagttgatgggaagtacaggctgtttttgattaaagccaaaacatgacctactaatagcttgttatcttgaatacatagtagacaaggttgttttggtttaaagccaaatcattagtatcgccaatgttcaatttggtagtttctatattctaataaaaaattttggttttttataccaaatacaattttatcttaccaaaaatctatcgtaacagaacgtatttaagttttgacactaccgatagtttgagagttttgtaaacctaacaggccctactagtagaagacgacgacggatctcttagaacgaaaacagtggcatgaagggcgccgatcgatccatccatcgattcgatatatgagcatatattgccaggtcgtcgtcaccccctgacaggtgggccccacaggcgcgtgagacacatccgcggcgcgtggggtgggcctgcacggcggcggtgggtggcggcattgggccggcgatgcgagggaggcatgaacgtagtaaatgcggccccctcccttctctcttccatcttctctctcgtctctgctggagctggagtggtggtggtgtccacctcacgcggtgttgctcagagaccattcaatggagagagagagagggacgccatggaaagcgcggctgatgagctcgatctccagctcatctcatgtgtgacgcatgggcatggcaatggctggcatggatggagtcgacgtacgttacgtacgtactcccgtctccaaccatccatccaccgttccgtccataccatcgacgatcgatgaccgatccgttcacttctgtctactggaggagtactactacatgtactccctccattttcatccttcttttcgcatagattcgtctcattgttggttcattagtcttaactaaaatttatatttaaattgtaatcttatgtaaactttgtatatttttctatgttagtaatttattttctagcaattgctttttaagtcactaataatatacttcatccatcccaaatataaaaagttttaattggattggacacatcctaataatacgaatttggacaaagagcttgtacagatttgtagtactatgatgttaccaaaacttcttatattttaggacggaataagtggatataaaagatttatttataaattattggttgctagttcatgattttcatggtttatcagccgtagatcatacgattagagtatattggtagcgacaaaaagagaggaaaatcgaagcatctctctgctgacatgagatcagctccacgctcctccaacatttgtggtatatacgtgtgctgcgtgcatcactaacaaaggaacaacgcgccctttaaacaaaaacagtaattttcaggtgtccttttaacgaataaaatgtactgattctatgagaatcctgtaaaatctatatgttcaaaagtaaacctgggatcgatcaagtcatcactagccccgtcatcatctcgatacctggaaggatgcaacagagaaatattggaattattatggtacgcgtgcagtttaggccaacactaaattaacttaagactgtacacataaactattgaacttttaactagtactacagaacagagaacagagaacacgaataaccagtatgtatatgatggtcggactatatgttaaaagaaacaagcagccgaattaagcattcatccatgtctggttgtgtttagttcagcgcaaagtttgtattttggttgaaattggagatgatgtgactgaaaagttacgtgtgtatgacatattgatgtgatggaaaaggactgaagtttggatccaaacaaactttagatctaaacgcagcctctgtacaaaagttgaagtttttttttacgcacatgtttaattttggctactactcctacgtaagatggatcggaaaccgtatgcaaaaggagacaaacgagtccaggttggcaacacacctaaaagatcataagtgacaacacgctaaagggaaaaatattaatggtttcctgaccttggtaggtgtatattattatgtgtttgatcatgcattattattatggtttctgtttcataaatggtggcatgttcgattgactttgctggtgtgttaactttgacactctctaaagtccaaatatgttttctggccggggtgcctgttgcctatttatttcattaatatggggtcctgtatagtactgaaccactgatgatgagccagagacagccagtgctaagctagctcaagaaaagcaaccttgtttttttgggacagctagcacgtactgttgggttgcaaattgaaaaaaaaaatgtttctgccatataatttacaatgtgaaattaattttagacagtttgtaattacacagttataactatatattaatttgttataagaagctttattttttggagacccctgttataattactttgaccctgctatatgaacaagatgtgtatactcccatgtaccacttaatatggaaccatctcatgtagtcacgctatatatatccaggaaacaattgatggtaattaattaatcctatcttaaatttgtagaagtcgtatctcgtcaacatcaaataatccgaaaggcagggacagctaatttgggatcaatatgtgctatcttatacgctaccatgtgttaacatctatctgtggactaaattaattacatgaacaaatactggatcctaaattaagaggttagtttctttttctcgtaataaatatatatggtcacccactggaacagtgatgttcctaatttgagtcagaaaatatatagaacagcttcatgttgacctagttaaatcatatatatcttgaattaaattataatcacacaatgaataacttataaaaaaacaacatatttattctttaaggaaacatacttagcatgacctagttaaatcatatatatatatatatatatatatatatagaattaaattataatcacacaatgaataacttagaaaaaacaacatattttttcttaattgcccatagaggctaaccagtaatctaattaagcacaccagttctttaattttacactatggccactactctatggcactctgattttatagtcttgttggcttgttgcccgcaaaaaaaaaaaaggatttcgaatgttagttttaagttaactttgagatttttcctatcttaacgttcagccttgcctattaaaacgtcaacaatacaaatatataagtttacaggaatcctaattcgcgcgtatgcgcgacttctccaagtcgcgagcgtgccacgtggcgggtcctcctacgaccgagtctgcgcgcttcttttttcttttttattttctttttttcggtaggcacaactgccgtgtttctttcttgtttttttcttcttctttttttgccgttaactaccacacacgtctaagagtaggagtcaatatttgaaaaaattcaattcaagatttagaaacttttaactcagatttggaaacttttaagtaaaaatttaaaaactttcaactcagatttgaaaactttcaattcaaacttgaaaactttcaactcggatttaaaaactttcaactcgatttgaaaacgttcaagtcggatttgaaaactttcaactcggacttgaaaactttcaactaaagatttgaaactttcaattcaaatttaaaaaaatcaagtcaagatttgaaaacttaactcaggtttgaaaacttttagctcaaatttaaaagctttcacctcaaaattcaaaatatttgataaaatttgaaaactttcatctcaaaattcaaaacattcaacttaaattttagaaacttttcaactcaaattcaaaactctcaactgatattgaaggtgaaggtgaatgtcacgccccgaaatagtcccgaccggaactagcccgtgacgctccaaattaacctgttaatcgataccagtcccaggaaacagtgctggtatcacagggagacagaatatcacagcaacagaggtctctttattatagagtaggagtacagtcatgttgggctacggacagatcccgagctcacaactgcattacaaaaggaaagcggaagcccggacttggaccaatcatcacaggcgcgacttgggaactaggccgaaaccctaaaactcatcgtagccggcttgctcctggaagaactcctcatcagcaggatccgcttcatcttcgtcagcaactggggggggattatttatatagagcaagggtgagtacgtgggtactcagcaagccaggggaaataagtgtttaatgcaggcttcaaggagaggctgttgtttttgcaattgattttatttgaactcccttttttttttctaaaaacgactaaatgagtgcttctcaaacgacacggatgagacagtgcgtctcgtccggtcggagtatgtgcaatgtatcagtctttagatttgaaacaagattggcacccggccaacagcttttcaagggccaacaacttttcaaacggccacccgggccaacaacttttcaaacggccacccaggcctagctgatcccgtcagctgctgatttttcaaacatcgaacccattttctcaacagcaatttcacaagcggtagtcaaacaaaactacgctaggaatcacctcacatccgcccatgaccgtgggcacggctgttcgaacagtttattaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagtgggaaaccgtacacccggtacgttccccggtacgcggttttggaaattcatttagttcgcaagcaccgacccaggtgtcgggttttccaagtcttttgtaaaactccagttttacccaaattgttactcagattttaagtttgaaggcgaccgtcgatactcgcactgagtgcacgaatatcgaggcgcaactgggtggttacaaggggacatggtatggcaattaacaatggaaggatcaaatgcaacaagtcaggtaggtccaccaatctgccttgcagatggggcaaaagattaagtgcggtcctatcaatgcataatatttttcaagcaatataattaaatttcaattataggctcaagatgttcaaaggtggcttgccttgctcgagatctggagcttgatcctcgaaatcctcgcactgcgggtcttcgggctctgaaactacacgcgaaacggaacaactcaacaaacagcgaaaataaagccctattaatgacctctaagcgtgccattagatagatctcgagatttgatgaattttggaagttgaacggagtcaaacggagttacggttgggaagatattgaatttctaagattattggatttttggtctaaaggaaaaaggatttaattaaatcctttttggaaaagaaaaagaaaaagaaaagaagggagggagggaatatagacttttctcgggcggctagggtgcggcccaagagatttggggcggctcggccgagcttaacgggccggccggcccaagacggcccaagcgcgcgcgcgcggggggaggagagagagtccggtggaccgggctcaccacgcgtggccccgggtgggacccgcttgtcagcggctcggctcaccgtgcggagggagcacgcggcgcacgcgcgcgggcagggaggaacgcggtgcacgcgcgcggtccgcggcggacgcaggtgcggcgggcccacgcgcagcctcacggcttgcggtggaatgcgcgcacgcggagggaccgaccggggtcggcccgacccggtctgggctgagctggcgccgacgtggcgcctacgtggccgccacgcgggccggcgggaggtagacgacgatccggccgcgaatggacggcgggcggcggcggcgagcggcggagcgaaccacggtgatacgggcaaaagcgagcacaccgggcggttacacgagacgaggggagacgaaccaacggcttggatttgccgggggttgctcgacggcggcggattgcggcggcggcaaccggcggcgggagaagagggaaacggcaacgaggccacgagaggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacgggaaggctactcaagctactaccgaaagctaggggaaggagatggagcgaggaggaagaacggagagagacatcaccgagaagaggaggggcgctgtgatgagaggccgacggcgcgggagtaaactctccggcctcgggccagggaagaggaaggagagggtgcggccggagtcctcttccgcgtccttgct

SEQ ID NO: 32152 - DNA, 14862 bp, Oryza sativa
cgggatcggcgagcccatactttaagaggatatcttgaaataatttcaccgtaaccttaatttacgctaaaatccctaaacatatttatattcgtggacatggcgagtacatgccacgtttcttctgctagtaatttttcacataaatttttttttctcagcaagaaaggctggctatatactccagtgcagaaagagtgaaaaagactacaccaaacaagcatgaggcgtgtggaggcatgaaaacagtacgtacccagggcacagcagtgaaaacatcgatctcttcaccctgcatggtgtctccttaaaatctgatcgatcgactcccaaaaatataagtaaaatactcgagtcaaaatgcatcagtttgcatgcatagtgaaacagcagcaagctggtcttccacaggatactttttgacccattcctcctatacatgcatgtaattaatcacaaagttgcaaaaaatacaatactatgattgtgtatttgtgtgtactatatataaaacaaataaattaacctagtagtaactgatcagtatcgatcgagagtcaacaaaatatatgtagactacgacgatacgtgtgtgccttcctgttttcttttgttcttatctttgggccgcactatacgctgcatctatactaaacagtagtgaaaaatctacctctccaccactcaattattacgccggtctataataattcgttgtataaattacggggcaacagtgaattattcatgtgctcttgcgtgtaggattgccaaacaactgtttcatggtcagataaatgaaaaaaaagcgacaaattggtaacaataaggaaatgttaattaatttatgacatgtattactttcattaaaaatataatagtttctgactatacatgtatctcggaggtacataaccaaaaattcttagaggaagtataaaaaaaatgttttcttgttattggctacgaggtctcccaaaaatccaatgttgtacaaatactatattacatgtcaatttgaaattgtgttaataagtaaaaaaggacactccaatttctccatatcctcaattgaggaaatataaaaacaaaatttgtttaaaaaaatgtttcaggaagtataaaaaatgttttattgttcttggctatgaggtctcccaaaaatccagtgttgtacaaacactatattacatgtcaatttgacattgtgttaataaataataagtcaaaaaaggacactctaatttctccatatcctcaattgagggaatataaaaacaaaaattggaattgaaagttgaaaccatgcaccactagtctctctctctctctctctctctctctctccccttccatctctttctctcccctagcaattacactacgccttctccataaatgcgattgcaccctctcaacactccgcggcaataactccttcgcccccctctccacattctcttccacctgtgttccccttttcttctcctcttcttcttcctctcctcctcctgatcctgatcgagaagatctcaccttgatctcttgccgtgtgatctctagctctcgctagccctctgaaccttgcagtttgttgtttgcacccggtgaaacatcttcttttgtgcaggtaggagagacagcaaagcagagataagagttctatatttgcatgtagttcttgtcttggatctcactggctggctgtctcctctctgcagcaaggttcgttgggctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtataatgatgatcccggcgaggcatatgccgtcgatgatcggccggaacggcgcagcgtacggatcctcatcggcactgtcactcagccaggtaaagaatttcttttgtcaggaatttgagctgaaaagaaattaatttcaaggggtggcctgctttccttttattttcttgaaaaatccaaagacttttgagcgttttgctgtgctagatttttaccttttgcgtcttctttctctttcttgtgtttgattaatttgaggtgttactacttgagatgaaaagctagaagaggggaaaaaaagcaatacattcagttctgaagtttctgaagataattagtcacactttcttggaaaatgagaagtttcagggttgtggagagagagagaaggggggctatatagaggggagagaaagaggttatctccagtacttagtggttgctgttcacacatattaggtcataagattcagagtacatgagagcctccctttctttaagactggcctactcctctccctactcctatataaggggagcagatgaacaggtcagctgatagatagatagataggactatggagaggagggagattttccaagttgctgatcttgcacacatattgagagggaaacctgtagatcatcttcaacaggtttgttgttgcttgcttccttgttcttccaagctttttgggtctttgtgttgtggcactcttgaagaagaaacatatcgatctagctaccctttctttcttattcctctttgcaagcttgctttcacatcttctgcatataccaaagggaatcaaaaaaggagaaaagtttcttcacttagcttgtctcctcatcccttcctgatttaaagcaatcttccattttatccccaaatttttttctgtgtttttatgaagtatgaacacaccagatttttccttgcagaaatgagaaagttatcaatatgggttgtttttgttcatgcatacaattttttcttctatcttttccacaaaactttgaacttctccactttgtctagtatctatttaatgcatatgccatgtataaaacgcacggaataaataggtactactactgtaaaggcgtaatctgtggtaccaaattggtagctaagttttgctctttatgtagcacacgcatactaatcctcaattaattcgatctgctccaaaattcgcagccaaacttgctggataatcaccagttccagcaagcgttccagcatcagcagcagcagcatcatctccttgaccagatcccggcgacgacggcggagagcggcgacaacatgatccgcagccgtgcgtccgaccctctcggcggcgacgagttcgagagcaagtccggcagcgagaacgtcgacggcgtctccgtcgacgaccaggaccccaaccagcggccgcgcaagaagcgctaccaccgccacacccagcatcagatccaggagatggaagcgtaataacactcaactcatagctatttacttaattaattatgtgttcttgattccatatagtatatactttgtttgattgtcctagaaatgtgacatatttgagttcagttcagttttgccccagctagcttgttcttggaatgttattcatgggtgttctaattcagaaaattacgcatgaaatgctgtgttagtctactgaaatcaatgtgaggagatgagtacaaatggaacagctggttaattatactgtctttaattaatttcccatggactgatgtaagcttgcgtagaagtcaaattgatttctcttgcccgtccatttcccctggacgaactgcataaagttgactcgttgatcaaaaccgtttttgttcttttgcactctcccccaaacaaaacggaagacgaagcattcaagaacgtagtacgaattttgcgttcacacgttcaaccgaacttcaaaaatttccccttctaatttatttttcctggatgcattaattcgtacgtactattaacttactgatgactaatagaattaaattaatctcggttcatctgttctaaatctatctgatctgatcagattcttcaaggaatgtccacacccagatgataagcagcgcaaggagctgagccgggagctcggcctggagcctctccaagtgaagttctggttccagaacaagcgcacccaaatgaaggtgaaaaaacctaattaatcacccaaatagttgttgattctgctcatcattttcacctttctttcacctgtgttcgtagcagtacaattcttttttttaggaaacacatgtacgtgtaattaatcaggacgttgcaacctgcaagcgagtgcaaatgcaacggattctttggatttctggttgagaaaatttcggccggaaagaaggcgagcttgcgagatagagagaagagagagagcgtcgtcttcttcttcctcctcgtcgtcacaaccacttcatttaagcctctgacctagctcctgcaggacgcattcatggcgtattactataactggacaaggcttgcccacgcacccccatgtccgcttctgcattgcacactgccaaatgtggcagttgcaggcctacgcctccgtccgtcctccatagtcaaacccttcccctaccttgctgacctagctgcatacgtgtacagtgattggaattaacagtttgcacgaacgaacacactgtcatagtgtcatcgtcaatccgttgcaaagattttcgaagtttttagcttgaaatttgagtaaaaatggtgtgtgatttgatgtgttggggagagtgcagaaccagcatgagaggcacgagaactcgcagctgcggtcggataacgagaagctccgggccgagaacatgcggtacaaggaggccctgagcagcgcctcctgccccaactgcggcggccccgccgccctcggcgagatgtccttcgacgagcaccacctccgcatcgagaacgcccgcctccgcgaagaggtagttttcaccatatctgaacaatcgatcgatcatggtgacaccgccattgcatggatcgtcgcacgctgatcgtgtcgttgtgcttgtcagatcgataggatatcggcgatcgcggcgaagtacgtggggaagccaatggtgccgttcccggtgctgtcgaacccgatggcggcggcggcgtcgcgggcgccgctggacctccccgtggcgccgtacggcgtgccgggcgacatgttcggcggcggtggcgccggggagctgctgcgcggggtgcagtcggaggtcgacaagccgatgatcgtggagctcgccgtggcggcgatggaggagctggtccgcatggcgcagctggacgagccgctctggagcgtcgcgccgccgctcgacgccacggcggcggcgatggagacgctcagcgaggaggagtacgcgcgcatgttcccccgagggctcggccccaagcagtacgggctcaggtcggaggcgtcccgcgacagcgccgtcgtcatcatgacgcacgccaacctcgtcgagatcctcatggacgcggtaagctcttggttaattttctgtcagtcagtgcgctattcttgtctgaatgttttttagtttggtgatttttatgatcctgtttgattgttggggtctgaatttcgttcaaattttgagtgaattgcgcagaatcagtacgcggcagtgttctcgaacatcgtgtcgagggccatcacgctggaggtgctgtccaccggcgtcgcggggaactacaacggtgcattgcaagtggtatgtgttcatgcttgtcttaaaaattttgtctcctttctgaatcttctgtcatattcggtagtaccaaagaattcgaagtgtgtacatgttggtcactgaaatgggacaaaattgtgttggttttggccgttttctctgcagatgtcagtggagtttcaggtgccatcgccactggtgccaacgagagagagctacttcgtgagatactgcaagcagaacgcagacgggacatgggccgtcgtcgacgtctcgctggacagcctccgccctagccccgtcctcaaatgtcgccgccgtccgtcaggctgcctcatccaagaaatgcccaatggctactccaaggtgaccatcatcagctcatcatcatcatcatcacaaatcaaatctgaaattctgaattcaagatatattgctgttcagaaatcatggaaaactgatgaaattgttgtatgatcaggtgacgtgggtggagcatgtggaggtggacgacaggtcggtgcacaacatctacaagctgctggtgaactccgggctggcgttcggcgcgcggcggtgggtcggcacgctggaccgccagtgcgagcgcctcgccagcgtcatggccagcaacatccccaccagcgacatcggcggtaagtaattgatcgagcatgcagcgaatttcaccctttaatttgatccaaaacgaaattaaaattcagatatgttcaatcactaaaccacgcagtggatttaattgtgtttgttgaatgaatgaatataattgcagtgattacgagctcggaggggaggaagagcatgctgaagctggcggagaggatggtggtgagcttctgcggcggcgtgacggcgtcggtggcgcatcagtggacgacgctgtccggcagcggcgccgaggacgtccgcgtcatgacgaggaagagcgtcgacgaccccgggaggccccccggcatcgtcctcaacgccgccacctccttctggctccccgtccctcccaagcgcgtcttcgacttcctccgcgacgaatcctctcgcagtgaggtactccctctgttttatatcataagtcgcttttacgtcaaaaaaaaagtcgctttgttttttattcagatgaattttgtaaaaaaaaacatagtagcgcttttaatacaaagcaaacacattttatcacaatatattcaatattaaatttaataaaactaatttaatattttatatgctattaatttttttaaaattttatttaacttaataaagtttgactaggaaagaagtcaatacgacttataatattaaacagatagaatacctataaatccatgataaggttaacaagaatacaattacaaactcttagttcgcgaaaaaaattacaaaatcttaaactttgaaaataaatttattttcagtgggacatcctctccaatggcggtatcgttcaagaaatggcccacatcgccaatggccgggatcagggcaactgcgtctcacttcttcgcgtcaacgtaagcagcaattcatccaagatcaaaacgcaagatatatacgagcatgcgataatgcgcgatgtattgatcgatcccgtttcatgtacaaatatatattgcagagctcgaactcgaaccagagcaacatgctgatcctgcaggagagctgcacggacgcgtcggggtcgtacgtcatctacgcgccggtggacgtggttgcgatgaacgtcgtgctaaacggcggcgacccggactacgtcgcgctgctgccatcgggcttcgccatcctgcccgatgggccggcgcacgacggtggcgacggcgacggcggcgtcggcgtcggctccggcgggtcgctgctgacggtggcgttccagatactggtggactccgtcccgacggcgaagctctcgctggggtcggtggcgacggtgaacagcctcatcgcctgcacggtggagcgcatcaaggcggccgtctccggcgagagcaatccgcagtagcttcgtccttgaatcaaacaaaagcttcttgtgctttcaatttcaggtacaaatgcaccaaattacttcagaactcttgcgagattaattgcatcagttaatgagaggtatatctgtaaaatttctgatgagtttgatcatgtttgtgtgcaggagcagcaaaattttggagctttcatcagtgggaagtcaagaacgcacctcagactgtccttgccatgtggtgcccatatatagtttggattatttttcgctagtttttccgcaaattcgggaaatttcaaaaaaaatgtgtcaccactacgcaagggcggttggttcgggtattgacttcctcttcatgttcgcctctcggatgctgctaccttatgaatttagggttcttctggagtacaaaaaaaaccccttaatttgatctgtaatttctgttgttcagacttcccagtacctagctagctagtaggagttgcagaatagagatctgtgtccctgtcttatacttttagttctcttcagtgtttgatcagtgctgtttcaatccaaaattgtgtgtgctgtgcttgttattagttcttccttgctgcttcaatgaaggcgatgttaatttcagtttccagcagttgcagagttgtgtaagatgacttgcatttcattgccttcaacagtattctatcagaactgtcgcatatcccccaaaaaacagcacaatcaatttaatactccttgataaaatttatgccactcttattatttacatcactgattacccttcaaaagattacatatatacgacaatccctacatggaaatactcgagtgcttctgccataaccttcaccccatgaacaaacatttcagttcccagaaactatacggtctcatccaaagcaacttagctcgcctttagactgaataatgaactggataaactcataagagacgccacttggatcttcatgattcatgacattaccaccaaaagcctcggcagtcagcacagatgatgtccgcgagggaatcattgtatgaatccattgcactcatgaaagtacatcattccgtggggacgagatcgtcaaacgaaaaatcatggatcggtgcacctgcaaaacaagttgagttctggagtaactcgtgtgttcattttacaaaaggcttattaacggaaacacattttaatagttttctcaggatggcatttttcaaaacaacttgattcttaaatatatcacttacatatggagtttgttcctagcaaacatgtttgtgcggtaacaaacatgaaaggatgcttactccacatttaacaatataagtttgctaaaagagttttttacctttttgttcagctaacaggtagaacggaatgtgagctaccatctttgttcctccttcactccagttgacaataccaggaccatttccttgtgcggtggatggtcctagtacagataaacaaatggccggttcattcaatagacctaaatagtcacaagcacgttgccacactctcctgtccgaggttcgggaacgagcgacctgtacgaaagtaagttacaagctcaaacgatgaaaatgagtggtgacagtaatatatcaaaccttaatattcctcaaactggaaggattagggcctaccttggccaatgatacacgtgctcttggaagcaactcattatggaacgttgctagctttgctatggcagtcaccacaaagcagaggagcctagcttgagatgattttctagaagatgcacccataggatcaaatcctgtgtcctgacttaatcccaaacgacttcacaacaagagataagaggtcagtcaaaagagatgccatgcaagtttagaaaaaaaagactggtttaacagggcccacctggtagccagattttcatataacagcaactccaaattttcaaacagttcacgagctacatctttgcgattttttcctccagctccatgctcaccaatggcccaacacaaatgcaatgctaattcagtctgtgtaaataaatcacattcgatcagaaaactcagttgatgtggagaagagtattaatcatttaagataatcagaactaggataagagagcaggtgaaaattagcagtttggtgaacttataaaatcaaaatgtacttaaaacatatacttgcctttgcaggattatcatgagcctccccaagtctgtctgtaatgggcttctgtagaatggtttgaaattatagtgcaaaatttttagtggaaccagaaaaaggagatatttactttgttgcttaaatatgctacaacattcactctcagaaaaagaaatgctacaaacatggtatattggttcagagaattgacatgtatatgcatgtctagttatatgtatacccagtacctttagcagtgcaatgatgtcaggggagcgctggaatgcagccaatatgaaatctgaaagtcttttcctcacctacagcaattttattgcaaggaacttgtttgaagggtgatatagaattgtggaaataaccaaacataaatccccatacgaacatataccatccttttgtactgaaggtacatatgatgtgaagaaaattcgaaaacatgatttacttcttccattttgttcgttagacactccaatgtaatgtatacgttccacaaatttcaacttttaggatagctttagcaattaacaattttacttaaaaaaaactatataagccgtatatctaaatagatgggtgtatcatcaattgttttcttgaggaattgattcttaattgctgactaaaatttagtttcctatgcaagtaagcacttcggttcaatcatcaagtaagcacttcaatgatcttaccgtagtactgtagttactactccagtattagacgcagtattagacgcaatgggaaaaggacacccacttgcctacctcgaaggagtatactttgtcagggaacattgctgcatatcttgacataactacaggaatcagagcgcataggagtgctgaagtgacaaatagtagagggtcaaatcaacaatatgttggtcatcactcatcagtatgtatagcaattaacaaagataggcaacatacagtcgttaacgtcccgcaatgctgtagcaaaatataatgtaagaaaacgaggtgccattttcagtgactgtttcaatctgtccgattgtgggctattaactgctgcctgtaaggttgaagatatcgtaggagatgtccaatgttttgcctgaggaaaacatcagaaaatgagaagactagatcaaggcattcactgaagaacatggaacacatacttcaaggaactacttacagcaataccatcattctcatcttttagaagatcaaggaacatcgggtcagcaaggtctagaggaccactatcatccgaacctgcattgccaatggcatcttctatagcagaaccagtgtatgcttcatccattagtgcaagtagcatctgtacgatagaaaaagattagcaagcttattagttttgataggtgacatttcatttacagcttttaggtcaaatcattacggaaatcaacctcaggagcagcactcttctgtatagtagctatactactaccgatgagagttccagaacttctttccaccttttccaatgctaccactaacactgttttgttccatgagtaagcaatagaacaaatgacaccaattagtaaaaaaagcataatagtacaggataagcatcctcagtagcagcatgttatacacattacatgcatctcgcatgttggaagagatgtgccccagatgtcagcagtcagcacatgcaacagtttaataacactatcataataaacttggctaattagcttctaaaatcatgaagtttacagccttgcacaatctaaagaagctagaggaaaattctggaagtctggaatcagaaggcttacttggaagatccataagggacaggaagagaggaagaaaagatcctgctgacatcattaacggaagcacttctgagaacttcctctccaatctaaaacaaaggaaacccaagttagataggtcaaatcattgctggaaagaggtagaatgaacttcttcatatttacacagtaaaatatcagcaaatatgtgaggagttcatgagcaattaagatggcatacctctcaccatttgatgcaattagcttcagcaacaatggaaaaaactgcacatagacagcatcacgaaagcattgccaaatattaacatcattaaatagtaatttggaaagagaacaaaacagaaaagtcaaaaaagaaaggaggaaattggattgagatcttttcaagaagtatgcttgattcattggcccttgccagtagaagcctagagctacatttatgcaaaaaaaattctaactgacaatataaagaatggtagttgacataagatgtagatattttgataattctagtgctgtataacattatatggtatggcacctgtggaattaatgtgggaaaagagctcaggatctttgtcttattcgctatcaggaattcaagtgtacgttctgcgacaataggatcagcgaactccctatcatcaagaaagaatagccaagtgattgagggtaagcaggaaaataaaaataaacaatcgcatacccaatacatcaagaaaaattattacctacttaggcaagagcggaagaaggtcctcaagctaccatcagcatcatgcaggactgcctccccaaagtccaggaagaactgcagaatggtctgggtagggagcagtaatacagtatgtattattagacaggtttttcttcaaatatatgatgactaaaaatgtgtgtacattactaatcaaatctaaatgattctattcaccaacaattgtccacagagaatgattatatggggtcaaatggggatcataaggttaaccattaacattagagcaagctcgcccctaaagatgcaaacatttcacaaaactaccaaaacattgcaacgatatcgtcctccaacctaacatgtaagaataacaaccatttgcagccaagatgggggaaaaacttcacatcagtgaatcgaagcacagcttacgagtagcagcacgccgctggaggccacggattgggtcggcgcggcggcgcagcgctggaacagcttgctcatcacagggaacgcccgggccaccatctcgtcgctggcccccttggcctccttgcacatctcgcacaccctcctcaccttcacgccgcaaagcccacacgagtcaacaagccaaaacgtgagcacatcccaccccccctgattcgaagaccatggaaggggccagggttgcagagagatgcgcttacggattcgaggaggttggggtcggaggcggggtcggcggccgcggcggagtccctggatgcggcggagagggagcggaggtggaagttgtagctgccatcgccggcggcgagctccggcgaagccatggccgtcgcctccgacgaacgagtgagtttacagatggggacgtatgatgggcctcagccgaattagagcccattaaactaggcccacgttgcactctgggccgttggataacacgtacgaaatgtaactcctatttaatctgagtcggcttctaaaaaaaaaaaaattaatctgagtcggtctcactgctgatttttcaccttttggtcctttaaaaaaacttattattcacgcagtgagaggtgtctgaataagtttagaaaaacttttggtcttttagaaaaacttaaggccattttggtttgaagctaaaatatgtgctatcaaattgtttggcactttgaatagtatatttttaggcctcttcactttgatgacattttcaatattaccaagttttgataaaattgtcaaaaaagtggctacatttagtttgctgccaaatttttgtaactatataagaaatcatgccaaaattttagcaactataccaaatttttggcattgccaaaatttggtaaggtttttttggtatcaaagtgaacaggcctttattaatgtttgatttactatcaaaatataccaatagcacaaaaaatttggtagtaccaatattttagtatggtaggaaaccaaacatacccttattctctttttggtccttaaaaaaactttttcatctttaaaaaactttttgagatctatttataaaatatttttttctaaaaggatcaaaatgtgaaaaattcagcagggagaggtgtctgtccctcccacagtcccactcccacctcccctcattgcctcgccgccgctcgccgtcgttatccaccggacaacgagcatcccctgacgagcgcagaaccgagctccggcgccgccgatctcggatgccaaggcgggctacaggtaggtgattttctttttgttccctaatcagttttttttcgatttaattatttcggcctatagtttcttattcgttttccatgttgatatttttcgccttcttttttttcagttttgcctctcccgattgctccgtctctcgagtcggtttccgattcgaacgcaggatgccaaattaaccgctaactccttcaaaatctgaactcgggaggcaagagaagaagagaatcaaacagagcgcctctggattttgattctcaacactacaagaggcatttttttttttgccggtggagtatatgaacggcaagcggaagagatcgggtggaaccatggagactcgtgccatcaagtgcaggacgatgcagcttctccatgaacttcaaataagtatgcttccccgtcctcaagtctttgatctaattcctatacagagattgttgattccgctgtttctagggttcatttcatatgtctgaagaagaaaaatctgttccttttttttcctgggtgagacgcctttttaatggaggggcggcggttgaaaaaaaacaactctttttttttaataacctggttggttcttcacctaaactacactttttttttcttaaggtgctatctaaacagaaggcaattgttaactctcgtctggtctaagctcaaatattaactttattttagagtaaatttcacaaaactatacgttttgtggtctatgttgcagaaaactacacactttgat

SEQ ID NO: 32153 - DNA, 8474 bp, Oryza sativa
  unsure (1)..(8474): unsure at all n locations
atgaataaatccaccgtgagatgacatggctgttccacctaaacgaggacgtggcatcctatgctattaattttttgcatgaacctcctatgcttgtcagcgccggcgcggacggccgttccatatttccgcccatcgacgaccaccgaacaatatcgtgtagctctcaccgccttcggcctgcatctcgtcgtcatgtcagccacaagccagcgcctttcctctcactgctatcccctcgccgccgcgccacgaggttcctcgctaggcctcatcatctctcccggcggcccctcaccatcctctggtcatctctctccaatacatgctatgctcgagatctggagttagcaggcaactcgctggctacatgcctcttcgagtactgcggccccttgtgtctcattccagtactatggtggctctgccattctgctactaacaggtatagtttggttctttttttttggtccaaggaatcaatcaggtgcccatttcatagtgagttttctaaaaaatctagtgtgaatgagcaagttccaactgaaatttcacataggtttgtagttttttgcctcactgttgattgattttgttaaaaaaaacagttaattcatcaaatatggaggtttctaatgcctctgaaatgaaagtagtacaaaacatgggagctataaggggaggacagggaactagtattctaaattttacagtcagtccactattgtacttaatttcaggtagataaattacgcttcagtggaaaggatcactgagtctgaagtttgtggctataaccccttgagttaattgattgttccattcagcttgtagtactggaacttgacaagagaagcacagtagtttggctgtagatagtagtaggtggctcctttcatgtctgcaggaaagtgctcctaaaccaagcacaaccttcagttgtggtaagcacaatacagacctaaactcatggaactttgaaatgaaataaaaatggtataatgctccattagacatgttcacacatctagtttgatcaacaagtattcttaataaccagctcaacaaatagtgcaagaacaataaactcaaaacaaccatatagaaaggtgatcactgaccagaaaacaagtcacagaataaaatccttggtaacatatcgtgctgggattgtgtagcgcccgttccgtcgtggcgcctagcgggaaaattatctctgaaaaaccctaattgcgaaatttgtttcttcgcttgttgtctagtgtccgtgccatctcaagatctcaatccccgatctatcgtcgagttcaattccaaatccaaatccctccaaatcaaattcctccgcaaaagtctaatttgcctcccccggggtcgatgggccgaatcccgctcggcccatctctccctccctccccggctctccctctctctctccctctccccgctccccctccgctccgcccgcgcgccgcgcgcgcgtgcgcgtgagtcgcccgcgccgagcgccccttctccttgctctccttctccccatccctggcgagctccccgctcgcgaagacggcccccgcgcgccgttgttcgcgcgcgcgcccgcgtggttccccgcccgagccgtgtcgtctgcgccgtccgcgtcgcccggtcccgctaccctgccgcgcccacagccgcgcagccgctcggcccggcgagccagcgcgcgtgcccagccgcgccgcccgttgtatcccgcgcgcgcgtgccgagtggccgaccgcctggtcgccgccgccgtcaccctctaccgcgccagcccgcgcctgtcgcccgtgtcgtcgcgccgctccaaaccgccccgccgtcatcgccgtcgtcatcgcctcggccccgccactccgcgcgcaagccgccaagggacggaggccgagccctcctccctctgccgcgacgctcccgctccctcctccctttttcccaaagcggcaaggggcaagccccctttctctccctctttttccttttcctcttcctcgccggcgtcatccgcctctgtcgccgttttggccgcaagcgccgagcgccagctcgcgccttgaccgcccaaagtcggtttccaaaccgacattgccgccccctttaaacccaggcgccctcccttcctcttttcccctcccaatcttccctatttctcgcccgcgccattgccgtccctctcgccgaccgccgccgtcgcgtgtgtgccggaggagccggtgcgcactaggacgcggaaggggacttcgggcgcgtcctcttcttcctcttcctcggcccgaggccggagagattactcccgcgccgtcggcctctcgtcactgcgccccgacccgcacggtagtgcctccctccgttcttcctcctcgctccatcttccccccttagttttcggtggtagcacgagtagcctccccgtagctagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgtagccgcgtagatgctctcgccgccgggaattggcccctcgtgacctcgtcgccgttttccccttttcccgccgccggttgccgccgccgcgattcgccgccgtcaagctccctccggcgaatccgaaccgttggctcgtctcccctcgtcacgtgcaaccacccggtgtgctcgcttttgcctgtatcgccgtggttcgctccgccgctcgccgctgtcgaccaccgtccgttccggccggcgtcgtcgtctacctcccgccggcccgcgtgggagccacgtaggcgccacgtcggcaccagctcagccgaggtcgggacgggccgaccccggtcagcccctcccgtgcgcgcgttccaccgcgagccgtgaggctgcgcgtgggcccgccgcatccgcgtccaccgcgaaccgcgcgcgtgcaccgagtccttcccccaccctagcgccgcgccgcgtgctccctccgcacggtgagccgagccactgacaagcgggtcccacccgggaccgcacgcggtgagcccggtccaccggctctctctctcctccctcccgcgcgcgcgcgtcttgggccgctctaggccgccttcttgggccggccggcccgttaagctcggccgagccgccctttctctcgggccgcgccctagccgcccgagaaaagtctataatccctccctcttttcttttcttttctttntcttttccaaaaaggatttaattaaatccttttcctttagaccaaaaatccaataatcttagaaattcaatatcttcccatccgtaaatccgtttgacaccgttcaacttccaaaattcctcaaaactcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctgtatttgaaatttaattatgttgcttgaaaaatattatgcattgttaggatcgcacttaatctgttgtctcgtctgcaaggcagattggcggacctacctaatttgttgcatttgacccttccttcgttaattgttatatcatgaacccttgtaaccatctagttgcgtctcgatattcgtgcaccctgtgcgagtatcgacggacgccttcaaacttaatatctgaataacaacttgggtaaaacttgggttttacaaaatacttggaaaacccgacacctgggtcggtgcttgcgaactaaatgaatttccaaaaccgcggaccggggaacataccgggtgtacggtttcccactctcgcacttaaggaccgattccttggaatttcatccaaacataaggcaagtacgaccacatgggtggaatgggacacccctggctgagtaactagcttatcaggggagccttgatgccgagagacttgtggatttgccggggtggtgtcagggaggacccctaggcttcctggcacagtatggtctaggacctaacctgttgttggtctgggacccctctcgtcggcatatggtaaacctgtgtcggctttggaaatgccttgtcatgaaagcttggaggtctcccgacgtggttgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttggggaaaggagttcgatgtttgaaaaatctgcagctgatgggatcagctaagcggatcctgctgatgaggagttcttccaggagcaagccggctacgatgagttttagggtttcggcctagttcccaagtcgcgcctgtgatgtttggtccaagtcctggcttccgtttcccttttgtaatgcagttgtgagctcgggatctgttcgcagcccaacatgactgtacctctactctataataaagagacctctgttgctgtgatattctgtcttcctgtgataccagcactgtatcctgggactggtatcgattaacaggttaatttggagcgtcacgggctagttccggtcggggctagttcggggcgtgacagattggaaggcacatatgtgcgtatatttagttgcagcagttttagtgggccatgcgcatagaagtccagcttgtcccacgatgccacgtccttgtcctaggtggaacagccacatcatctcgcgtgtgaattcattcattgatagtgtagttttgtgaaactacactatcaaaatatatgtacttaagtgccaaatgtcaaagtgtgtgtagttttctgcaacttggaccacaaaacgtgtagttttgtgaaatttactctttattttaacgtaactccagggtctttgactctgtgctctcttcggtcttagtggttctagagtccatcctttcggagggccggctgtggtcgttagcggccgtcgcttcctttggggaattgttgggagcgtagagtggctctgccctctcccgctgtttggagtagagttaccgttgtatcgagttcttttttcctttccttccttgttttttttatctttgtttttcttccttccttggcataggccgatctggctgagtgcgtcgtgtaacaaaaactctattcttctaatatattgacgtgcaatccttttgtgcgttcgtggaaaaattaacctttattttggtttgttcaaattagcagttcttgtctgaattacattatcaaattcggaatctaatagttggtttttatctccagacgaattgggcacatctgcaaaaataattgacgcaccaccgcgacgaggtgatatttctactggcataatgcgagaactcccgctcgataaacttccagaggtatggattgctaagaatgttttgattactatcgttgaaacttctatgtcttcgtgtgcttggatcgtaggatttatttttcctcgagggattgattgtaggaatttggtggtgaacacatatttaaacaacaaatcaacaatgtttgggcaaactatctaccactcaatgatcctgaattatcattgttacaacctttacagtactactagcagaacaaactgcatttctttgcaccacacatccttttatccggttgatttaaactagtcatcgtcttatctgagttgggtgaactattactgatcttcctgtgcagccatgtggtttgctcatgttgattcattaatactcactgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgctgtgaccagagcggttctgcggcgacgtcgacagctgaggcggagcggcgacgtcggacagcggaggcggagcggcagtgtcgacggcggaggcggcgacggctgctgcagaggttctcgacgcgagcagcgtgaaggaggagcagggcgcacgctcgctggttgagctgcgcaaggatttggtgcagcacaagctgtagggagcacagcggctgagagacgcgcagctgttggatgtaggatcaacagagaaggatttggtgctattggctattgttgtccgttccagtggtggtgactttggtggtgctgttgctggtgctgctgctacttgagaaggtgaggatttggaggtgaagtggaagcttggtttgctgttgctgttgttctgatttggggaagaaactgtgtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaaggagaaaacaacagtgcttggcaactttgttaatctcgcacatcctatgcaggtacctaactcaacttggatattagactccggagcatctagacatgttacaggaatgtcgagtgagtttacatcatatactccatttcagtcatcatttaaagaaacaattcaaactgccgacggaactttacgacatgtgaggggagtgggaacagtcaaatgtactccatcaattacattgtcgtcagttttatatgctccctcttttcctgttaacctagtatccgtaagctcgttggttgatcatatggattgtcgaattactattgaccgagagaattgtctaattgaggagagaagaactggaagaaagcttggaaccggcgttaggcataatgggttgtggtatctggatagaagagggacggacaaagcactatgtagtgctttgttagctagcacaagtgaagaggaggctaaattgattctaaaacattgtcaattgggacatatgtcctttgatactatgtctaaggtatttcctgatgagatgagtaaggtggacaaaagcaaattaatgtgtgatgcatgcgagtatggaaaacatacacgaaccacatacataagcagaggacttcgaagcattttgccatttgtgttggttcactctgatgtatggacttctcctattgcttcggtaagtggagcaaagtactttgtcacctttattgattgccactcacgaatgacttggatatatctcatgagacacaagagtgaagtattgaaatgtttcaagaatttctatgcttgggttaggaatcaattaaacacttgtgttaaagttattaggagcgataatgggggagaatatgtgaatgatgaatttaggagttttctctcagcagaaggaatagtacatcaaacttcttgtgctgacacacctccacagaacggagtagctgagaggaaaaatcgacatattctggaggtaactcgttcactcatgtatacgatgaatgtaccaaagtttctatggagtgaggcagtcatgacagcaacatatctcatcaatcgcatgccatcacgaatacttgggatgaagactccatatgaaatggtgtttgggaagaatgaattcattgttcctccaaaagtgtttgggtgtacttgttttgtcagagatcatagaccatccgttggaaaattggatcctcgagccgtcaagtgtatttttataggttactcttctgggcaaaagggatataaatgttggagtccatctgagcggcgaacttttgttagtatggatgttacttttagagagtctgttccgttctatggagaaagaacagatttgagttccttgtttgttgatcttgacaatccaattattgatgaggatggacaagagggggagaatggatcatcaggtactgaagaagacacataatcaagaagcatgaaatttgtggttggctcaatcccatatcctgttagtgaacccattcatgagcaaaattggagaaggccatgtgaagaagaaaatctacaagtttatactaggaggaaaacaaggtctttggaggcgcaaacaatagggcaacatgagtctcctatggatgggatggagcagcaacaatcttcaattgttgctgaagtaggtgataaaccatctgatcagtgtgatactatacagatttcatcggatac

SEQ ID NO: 32154 - DNA, 7230 bp, Oryza sativa
  unsure (1)..(7230): unsure at all n locations
ttggccattgcatcagttagatgtcaagaatgcattcttacatggagatcttcaagaggaggtgtatatggaaattccacctggatttgctacctcacaaactgaaggtaaagtgttgagactgaaaaaatctttatatggccttaaacaatcaccaagagcatggtttgatcgctttagacgtgcaatgtgtggtatgggttataaacagtgcaatggagaccacacagttttctatcgccataatagaggtcttaaaactattcttgttgtgtatgttgatgacatgattatcactggagatgattgcttggagatatctaggttgaaacaaaatctaagcaaggagtttgaggtcaaagatctgggccaattaaaatattttttgggtattgaaattgcaagatctccttgaggaatagttctttcacagcgaaagtatgtattggatctgctcagtgatacaggtatgcttggatgtcggccagcttctacaccaattgaacaaaatcataagttatgtgctgaatctggagatccagttaataaagagagatatcaaagacttgtgggaaggttgatatatttgtgtcacacaagacctgatataacttatgctgtgagtgtggtgagccgatacatgcatgatcctagaagtggtcacatggatgttgtgtatagaattttgagatatttgaaggcaagcccaggtaaaggcatatggttcaagaagaatggacacctagatgtggagggatattgtgatgcagattggggcagttgtcttgatgatatgaggtcaacatcaggctactgtgtatttattggtggcaatttggtatcttggaggagcaagaaacaatcagttgtgtctcgctcgactgctgaggcggaatacaggtcaatgtcgatgagcttgagtgaattgttatggttgaaaaatcttttggctgaattgaagctgtcgacaagcacttccatgaagttgtggtgtgacaacaaatcagccataaatattgctaacaatccagtccagcatgatcgaacgaagcatgtggaaatagatcgcttctttattaaagagagaatggatgagggaaccttaaacttaggctttgtaaactctggtgaacaagtagctgatagtttaacgaaggcattaggtgctagagagtgcacttcttcgtgtagcaagatgggcatgatagatatttatcgcccatcttgagggggagtgttgagtgtaggcgtgtgtatttcagcccaatagggcccattccaccaatgtatatgtatagtagatgagaaaggaaatgaagtgaagcttctagaggaaaaatcacaaaactacactcactaggatatcataatgaaaaggagaaaaaaatgtttatgccactacccaatagtagagattagtgaatgcacacttttcatatgtaccataatttttgcaacctctcatatttgccactaacaagtaacaagtgcatggctttttggggcaaattcacacatggtaatggataagagattgtaaaagttagttgtgtatgtgagaagtgtgtccaagttattgacatacacaaattttttttgtttgattaaatacaatttctttgtctcgcttgttcttggcacagaaacttatggattctccttttgatcataacaatgcaatttaaggagcactaggtgtccacctagctggtatggttaggtgcagtgattcaaagggccctagttgtagcatatagcacaaaatgatcacaataatgcccgatgttgatagtggattctagtactctttatataaaatcaccagagttggtgtttagtagccaaatggcaattaaccatttggttcgtatttagtagtggccactatccactagtacagtttaaatatagatactaagcagctggttcttctatctgttccaagtttggttaaatgtcctgatgagtgttgattttgtatctcaaacatgtttttttccaggacatcttgcatcatgtatattctcttatgccattgaaagatgctgctcgtgctgcttgtgtgtcacatggatttctacgttgctggagacgctatccaatccttatattaaataacaaaacgataggtttgattaagagaaaactcagtttggatgacatggaaagctatgctgtcagtaaaattgaccatattattaagagccattctggcattggggtgaaagtgcttaaacttcaactgttcgcctgtccgaatataagtgcagctgttcttgacaaatggtttgtaaccgttatcaaacctgggatcgaagaactctccttggagatgtctttcattgaaaaaacggacagaatacaacttcccatgttccgttctatccaataaggcagagggatggacaattcagtcacttttcctctcctcctgtgcttttcatcctacggtgactcttggttgcaacataagcttgacaagcttgcatctatgtaaagtcgatatttgtggggaggagttagggcagttcctttccaattcattctctttggagcgattggtaatttctgaatgcagtgatatagtccagtttaaggtaccttgcctgatgcaacagctcaagtacctcgaggttacaaaatgtcaaatgctacaagtgatagagatagatgctcccaaactctccacttttatctatggggatgttggagttaaaatctctcttggagatccactgcaggtcaaggacatacgtctgatgggttacaatgaagccgacaccgtctgttatgctcgtaccaagcttccatccattttgccaaatattgaatcacttgtcgtgtcatctcctaatgaggtatgcattattgttttctttgtgccatccagttgctttataactacaattaattacatgctggtgatatgcatgtcacacgtgcacatgaaacacgactaaaattcctgaggcatctcttcttcttctctttcagatgaccagtacgccagtggtgcccagcaagttcctccacctcaagttcttggagatttatcttaaagaattatttgcctcacttcccagctatgatttcttttctctggtttctttcttggatgcttcccctgccttggagactttcatcttgcacgtatgccactttctcaatgttgcataccgcaaatcataaaagttcagttaatgcttgcagtttgggcctttgggggcttctactcttagcaaatttggcaggataattaattcggtatagttcgttgtagatatttttaatatagtttctcacaatatataatagatagtagaaatagtttagtacttaaatacgcactagtaagacaaccaaatagagaacatctgtggtgcttcacaagccaacagcagcaattcagtttgggcttttctcatgataaaatattttaagcttctataatcattattagtgactgtacttgatgaggagtatgtgaccaagttttaatgagtaactactactattcctatgcaggtagagcagcagttcgaaaggcatgattcgattcttgatggagaacctacggatttgaggcgaattctgcacgacggacatgccaacctccagaatgtgacgatcaccggcttcaattctacaaagagcatgattgagctaacaactcacattcttgagaatgcaccatcgctcaagtgcattacgctggatacagccaacttctctggcaagaaccatttggcgatgggcgaatgctctcctatgatgagaggagggatcttggaagcacgaagagctttcgaggcagccagaagacacatcgcggggaaaataccctcctttgtcgagtataagtttctggaaccctgcaggcattgtcattttgggtactgacacaatacatctcaagaagtccagatagcgtttcttcagaggagaaattcaagtgtagaaatctatattgacgctcaatcctttttgcttgttcgcaaaaaagaaaaatcgaatgtagaaatgtaaaaatgcacagcagtacagcacaaccaagtaaagaacaagtatggtattttgggggacattcttgcattcagaagccaagagcaatatttttgtgctagaattgtttttagtttagtgtcaaaagcagtagctttatctggttttattagtataacataaaagaaatgaaattagtgactaaaggtcatacagattacagagtagctgccatcgctcatcgctggttgcaatcgcaaagcttcgacaaagccatggccgtcgaccgtcgtatcgctgagttcgtctctgacgagtgagttactgggccgaatagagagcccattgaaaagcaaggcccacattgcattctggttatatcatagattttaaatagaaaatttttgcacagaacatattatataacggtttgaaaatgtgctgttggaaactttaaaacaagaaagttatagtttgaaagtaaagtttaaactcgtccaataagtattcaaagttattttggtagtcgagaattgtgatgttatttcattcttttattctattattactttcgttctaaaatattattattattttatttttattggatgataacatataaatacttctgtaactatttttttaataaaattttcaaataaaacgaagaaccaaacattaagtaaagaaaataaaaataaatttattttgtaacaaatgtactttctctgtttcacaatgtaagccattctagcattttccatatttatattgatactaattaatctagataaaaaaatattaattttatttagatttattagtattactataaatatgaaaaataaatgacttacgttttgaaacgggggagtaactgagaaagtagccatcgaactgtgagtctgaggtgtcctcaccaacttccttcatcatccccttcccatcgccgcggttctccacgctccactgcggtggactgcgccgcatgtagcgccggggagctccacagtccaccccggcccgcgcccgcgccctctcgagttcccacacgagctccgccgccgacggctctcgaggcaggcaggcaggcagcgccgccgatctcggttgccgccgtgtggagcgccccccgggattttcattctcagcagtacaagaggcggccggattcgccgccgtttgaggtaatctcgcgcgccggcgacgtccggatcgcctttcctggctggcgtctggagtatgtagactgcaagggggaatcggaagcggccgggcggagccatggagacccgtgccaccgagtgcaggacgatgcagctcctccgtgagcttcaaacaagtatatgcttcccccgccccctcagctttcgatccaccttcctatacagagatcgtcgttggattctaccgctatcgtttattgcatacttattactacctccatattttaatattttaatgtatgacgcagttgactttttatccaacgtttgaccattcgtcttatttaaaaaaattatgtaattattatttattttattgtgacttgattcatcatcaaatgttctttaagcatgacataaatatttttatatttgtacaaaaattttgaataaaacgaatggtcaaacgttggtcaaaaagttaacagcgtcatacattaaaaaatacggagggattatgttttagaagaaaaactgctcttaggctcctccttaacctgattggttcttcagctagcttataataaagtgcaatttagacaggggaatttttaactcttatctggtctagtgctcaaatcttcaccttattttggtttatgcaaattagtggttcttgtctgtaagccttgaattgcattagcaaattcattctctaaccttttgtttctatctctatctctagacaaattggacacatcttcaaagataatttacgctccacggcagcaagatgatatttatgcgggcataatgccagaactcccgctcgataaacttccggaggtatggattgctaataatgtcatagtctgttaactactacagtatcattgaaactgctatgttttggtgtgcttggattgtaatattttttttctcaaggggtagattgtaggaatcggtgttaaacaacaatgttttagcaaactatctcaatgaggtttcagaatgttgtgcataaattgaattcgaatgcactgttactttttaatgtttggctttctctgcacattgtctactactccatgctccaaaattatcattgttgtggtcttttcaaaactactagcagaacaattaactattaccagattacttctgtagcattagctaatttgttatctcccgatatgagctttacctatcatgaagatgacctgtgatgctattttttgtggattgatgacatataaggactaaggagtaccgtgtgttatgaagtttggttaaatgtcccaatgagaaaaatgtatatccacttataagtcttttggtaccgcatatagggaaatttaagaaaaagcacttgacctgttggccactgtccactagtaacaatttaagtatattttactaagcagctggtccttctgtttgttctaagtgaagtgtgcattgctagtactctctgaatgctgaattattcaaacatgtttttttccaggatatcttgcatcatgtatattctctaatgccattgaaagatgccgctcgtgctgcttgtgtgtcgcatggatttctacgttgctggagacgctatccaatccttgtattaaatagcaaaacaataggtttggctaagagaaaacttagtttgtatgcggaagatgtgccattgtatgagccagcgcttaaagtggatgacatggaaagctatgccatcagtaaaattgaccatattattaataaccactctggcattggggtcaaagtgtttaaacttcaactgtttgcctgtccgaacatagatgcagctgttcttgacaaatggtttgtacatgttatcaaagctgggatcaaagaactctccttggagatgtctttatgcaaaaaaaggacagaatacaacttcccatgttccattctatcaagtaaggcaggtggagggacaattcagtcacttttcctctcctcttgttcttttcatcctacagtggctctaggttgcaacatnnnnnnnnnnnnnnnnnnnnnnnnnnnnnnnnnnnnnnnnnnnnnn

SEQ ID NO: 32155 - DNA, 715 bp, Oryza sativa
cctaatctgcaagggtgcgaccatcctcaagctgcttgccagcgaagatgaggcgctgctggtctggtggaataccctccttgtcctggatcttggccttcacattgtcgatcgtgtcagacgactcaacctccagggtgatggtcttgccggtgagggtcttcacgaagatctgcatacctccacgaaggcggaggaccaagtgcaaggtggactccttctggatgttatagtcagcaagggtgcggccgtcctcaagctgcttgccagcgaagatgagccgctgctggtctggtggaataccctccttgtcctggatcttggccttcacattgtcgatcgtgtcagaggactcaacctccaaggtgatcgtcttgccagtaagggtcttcacaaagatctgcataccgccccggaggcgcaggacaaggtgcagggtggattccttttggatgttgtagtctgcaagggtgcggccatcctcgagctgcttcccagcaaagatgagacgctgctggtctggtgggattccctccttgtcctggatcttggccttcacattatcgatcgtgtcggaggactcgacctccagggtaatggtcttgccggtgagggtcttcacgaatatttgcatgcctccacgaaggcggaggacaaggtgcaaggtggactccttctggatgttataatccgcgagagtacgcccatcctcaag

SEQ ID NO: 32156 - DNA, 6417 bp, Oryza sativa
  unsure (1)..(6417): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttggagatcagattaaattcattgggttaatagttcagcaagtgatttgcaggtaaagactctgctctggtagcagcaggatgtggaagcaaagaatttctgaatttgtattacagattcagctcaaattgaagtatactgaacaaacccatctgtttgaatcgattgatcatctgaccaagaaagcatctatttaaaatttgaggatccgatcaagaaagcatctactactacttgaccatctgatcatcaagatcgaacaaacaaccaatacaataaaaatactaataataataatgacagcattaagactcagatttaatttaattgtcctcacaccaaactttacctaagcatcattaatcaagctaccatctatcactgcatcacaagctcaagaagcctctcgcttcacgcgccggcgccggcaaattgatcggccgcggcgagctctcgccggcgagcgctacggcggtggtggcgccgccgccgccctccacgacgcggtcgccgtagatgtgcaccgtcctcgggttcggcccgcgggagatgacgcaggtgtagtcctccgatgacggctccatctgcatctccgccggtgactccgccgccgccgccgccgcctcgccgccggcgacgcgaagcggcagccacgagctcttgttcttgacgccgaactcgacgcggcgatcgagggagcacgacctgagcaggggatgctgctgctgcggttgcgcctgcagcttgaccgcccgcgacgcggcggcgaggacgctctgtctgtggccgtcgtcgtcgtcgccggtgcagtcgagcgcgtcggcgaggccgtgcgtgccggcgccccagtcgcaccacggccggcgcttgcttccgccggcgtccgggctgggcgcgaaggccgccgccgcgtcgatcacggacgtcgggctcatcgagtacggcgtctcgggctccgaaccgccgccgccgccgccgccgccgccgttcttggcgtggctgccggaaggcagcgaggcacagtgcagcagcctcggagaccccaacaacgcacacgccgcggtggcgctcttgccgccggcgccgccgccgccgccgtcgcacgaaaccgtcgtcgagctcgcgtgctggccggagaggtggctctgctgcacgccgccgccgccgctgttcatcgatctggacctcctcctcaggatcatctcctggaccttcgatctcaggaacatctcaagaaccgaaaccaactcaaacaattctctcaaaaacgcaagtgaatttcactgaacccgatcggctcaactcgatcggcaccttcttctcaaaattgaacagcaacagcaacaagaacagcgcagatgagatgagatcgatcgatcgaggcagagtttaagaacggagctcgaggccaaaacgaccaaagaagcctcagaagtgtactcagacgcaacctaaccaagctcagatggagaagcaaaatgggacctttgcagctcgatctgcaagcaactactcccaacacaagagtttggcaagatccttaagctatcatcaaaatcatcagcttcttgctgcactcaaaggaacaacacctcaatcaaactatcaaaggtagaagatgaagaagaagaagaagaagagggagaagaagacgagagagaggttggtgatgaactgatgatactaataagcatatagtagcacaatggggaggttgggagggtggcgatcttaaagaagccatctcctctcctcacagtgaatgaacatgatgtcagtgttggtttgtgtgtgcttgcatccaaaggggcaggtccttatcctgagttttttttctttttctcttttgtttttacacatctttttcattggcaatggtcctctcctcctgtcctggccatgcttctcttgctgctgtagtgtgtgctgtgctgcattcttgcgctgggtgttactgtccccgtttgagcccatgcacgcgcacacaaatggtagattccgttggtacagcaggtagatttgctgtcgacctatggaaagatgcgaggctctacgtcaatgaaatcattcatctcatgctgctgaatcgctgatcagatgataatttgagatgattcatcagtggtatagcagtagtagaactgtaaatgtcaggtagatcatgcaacgagctgaattatcattgttgttcagagcaacacacttttacagtagtacagtgtctctgagaaattactcaattaatcgtgcgttaacaatttatctcgttttacatatcatcttaatcttctgtttcctactctcaaacacacggtaaatcattcaccaaggtatctcatgctgctcatctgatcagatgagatgattcagtggctgcttcagtaaaaatcagtcagtaactagatcatacattcatactacaatgagctgaatctccatcgttttttttcagaacaacacgtatttacagtatttccgagaaattactgccagaaagaaccagattatttttgtcatctaaacgtttttttagtagaattagtactggtaggagtacaattagattactgcacgatgacaaaagatcgcaattatgtcctgtctctaactgtacccttttttcttggcatgtttgtcatctactgaagcgtatgcgatgcgcccgcctgcccctaccctcttttgttgtttgcttctcttcgctcgctgcccttaactgcaatgcttcccccacacttctctcgtcacgtctccttgaagagcctgtcctaaagtgctatatgaaaaatggatgatagatgaaagaagaattatttgagagcacaaacaaatgacttacgcattagaaagtttaaaaggttgatttaaaacagtttttttcaaggaaatgctgatgaaaaagccattttgcagatattgcaccatttagaagctaggaaaatgtgtccgcagtaatccaccatacgaagaatataactatgctaaacgatagaaatggcactacaagatcagccgccgaaaaccgctatagaacaattatcggttactagtaaaagatttttgctatttgggctcaacatcatcactaactctgtggcactacaagataacccaccgaaaaaaactgttactacaaaagatcggtcgctaattatagctattccctgtgtagccttgttgactccatcgcagctggtcctctgacaagcaaacgacgagtcgatattgttgctgcacgaagaaattttacattgacgttaacattgttctctacaagccgataatcggatcaaaaccatgtgccaaagccaccatccgtcgacctcgagcggctacctaggcttattgaccaaacacattttctctgtctcaatatgtagaactaaaggtatattcatattcgtagtcttagcattgatctaattctattctaaattgttacatattgaaacgaatgaagtaataaaattttaatgttaatgtaacggttaaattagattttttttaataaatacttaggcttaattagatttgtttgggctaaaaaaaattacgagttccatcgcggcttgcggcaaatggcaaccgcgtcaatcgtcattcccttctcgcctcgcccgttggggtgtccccttggcaagttggcttgccaattattggagctcagacttgagacatcgatttgataattcaagattagattagtaatttgatactatgtgtacagatttggggggtttgatttatacttttaaaagagagggggtgtatcaatttagtatagtgacaagtgacaagtgagtgattggtgcagaaagggattggcacacgattttaatcccaggagctacctgatagtaccctccttacttttatagtgctaggagtaccattttcttagataggagtagatgtttgctgatagagagtaataggtgggctccatgtctaaacaagatgttaattaagcagcagtaatatttactccctccgtattttaatgtatgacgccgttgactttttaatcaacgtttgaccattcgtcttattcaaaaaatttatgtaattatcatttattttattgtgacttgatttattatcaaatattctttaagtataatataagtatttttatatttgcataaaaaatttgaataagacgaatggtcaaacattgttcgaaaaatcaacggtgtcatacattaaaatatggagggagtaatgtactagcaaatcacccacgcatgagatcaccgtattatcccaatctatatccatttctccggtgcagcaattttcctacccagaagcaagaaagtgattgctacttcaatacgtgttgcaatctcatgacagtggtcaagaagtagacatttactctagaattgcccttatgactaccatatgagccctgtgattaacggcagtttaatttcagtaaaaccaattggttactctgaccttaggccagtgacagtagacagtagttttctgtcattatttttgactgaacaagtagacgccgccgggcataatcttgtgggcgacatggtgggctcatcatggcgccattgcacgatggaagggtgagagcaaggcaggtgtaaagaacttgtttctcctttggtacttggtccaaagaatgagaaaagtagtaaatcaataagttaacaatggcatcatcatcacactcacacatgattctctttttctcgtatacagtactcccaccatatttttaatgtataacgccgttgattttttgataaatgtttgacatttcgtcttattcaaaaaatttatacaattataatttatttttttgtgacttgatttatcatcaaatattctttaaacatgacataaatatttttatatttgcataaaaattttgaataagacgagtggtcaaacgttggttataaagtcaacagcgtcatatattaaaatacggaggtagtataattctaagaaatggttaaccctgaagttctttttttctctctcttttggatacaagtcacaacgcttgtaaatgaggggttctaaacttgctccatttttccttggaggacaacacaaatgcagtcttttattgacaacgggcaaagggtgaaagggaggggcaccaaacctgaccctcctggtgatgcaactctagactccagactgttgagttttgcaatttgcaaatactctttgcacatgcagcaacagtgctagtgattggacaggccctaatttgcttgattttttttttaaaaaaaaggacaaggtgatgatgaagaaagcaactgggcaaatcctaattagttaaaataaactgggccatgtcccaaagcagccgttttctgacattctgtgagcagcaaaatacagttgcagtgacagaaaggtatactttcacttaggtcaggtgaaatggacgccttgctgatgcatgcttattgtctccctttcgccttcagtgagaagcatcagcttaatgtggatgaaaagaagcaaagcttagcactgttagtcacagtaaaataaaattcaggttgcatcatgcaatgaagcttcatccagagctttcaggtaaagagaccaagaaaagcttctcactgcatgccaaggctgcttgctagccattgttgcagtggcggccattaattgcaaagtcgctggactgtcaaaacgttaagatcatatcgattttggcttcttattatcttaattgctcttgttactgttcagttggtagataggagtacttgtttagtatgttcatggaacaactgaggatgcagaccgcacaaactagtaatttgatgaacagcatgcaagaccgtccgatcagtatccgacgccctggatttcttccagttcagatactctagtgacaaaggattccacttgctatcacctagtagtatttagtatttcttcttgtcctcattgaaaacatttagtataaattatattggataggtgattaggtcaagaacttgaagtggtttgtgccgctggaactagaagacatacaagatcttcataccttcatgggaatcgttatcaatgaggctgacttaggtttgtttgtgccatt

SEQ ID NO: 32157 - DNA, 13344 bp, Oryza sativa
  unsure (1)..(13344): unsure at all n locations
atcaatgaactaaaaagcagtaatgcagaaagaagagaaagcaagcaacacctgtacctgtttttggaacctgggaaaagaatttcatccaaatccagctcaaattgcattgtttttctgtgaaattccactggcagatcagatgcaggcgacaaaccagtgatcgcagatgctgcaaatattcctcctgccagagaaaaacatttacatgtgaggtagtagctgctcgtttccagctctgcaaaaaccatcgggcacgtcacatactcacgttcaaatcagtatacatggaaagcttttgcaacgcaaagaaacagaaagcttgtccttaccgtcgtcatatcgtagatcatgtcatatactgtacaccacgattcagagaaagagacaacacagccggaatcctcatgctctttagtgattgatctttacgtctcagccatcagttgcgatcacgacaaaaaaagtgatcagcgtgcagttaaatcagcagcaatttgatgcattgcaaaaatgatattatagcgtgcaattatcattggatagcagcatggttaatatagggtaagtaacatttcaaatcacagataacagctgctacaggtagagcagacaacaagaactgcgggcatttcgactgaaacaacaggcatcagaattcagaagccgttatgctgtggcctatggataatgagaaaagtgtttgctagtagatttaatcttacagttgtgaatgtcaaaatgccttttgttttccaagcctctaatggtacaatgagaaacaaagaactggttttgctgaggctgtaggccgatctacttcttgatcttcttatcgtttctgccccttttcctctgctctctcctttcctccgagtagtgcttctttaccagcatcttgtgcattgatactttcagtgcagctagaactgaagctaacacctcttcttgctttgcaatgtcaagacttccttgcagcgccagaaggagcttctcaccatgtggcacctcactgtcttccaagactgtaggaacatgatcacatccggctagcggatcctttttgaagtgtgggatgattttcaaacgggtacataactgggaagtagcctgattaggcatattcgatgcgcccatgacggtccatagaagatctgctgagaagctggaagacaggctagtaggaatatagcacttttccgttgtaaccacctggtagtgcaggggaggaattattagtttttccagcaatatacaaaaaaagaaaaaaaaaggtactactattgaacagctgagccaacaagatatcttgctagtcaccaataaccaagatttaacaatacttttccagataaatcttaactagccccatcacaactggcaacaagaaacctagagctcgcacgaacatttctctcaagccaaagcctagcaagtcacaagcattggtaccaatctttgtaaagatcatttcaagaaataaggctatcaacagtactaaatagtaatgatgcgctaaatcttgttgtaaaacaaaatcctggtcaagtggtcatgctattaatcccaaaccagttgccttgaaaagatacattttcaaagagacatacctttagaaaagataacttctttgcaataaggtcacatgctaaaagcattactccatttaaactgcatcaaacagataaaaaagaaccccattttaccaagcaaatcatattacttttggagaagcgtaaccacacaagtttacctctgaatggctacagcaaccaacaaaccatcattagtcgggcatatatctgcaacagatagattgttgtcttcagtttcatttggctctaagagttctcccacctgtgaattgttttaagagcaagttagctagtacaaaataacacaaacaattataactggaataaacaacctattgacttttttttttagaaaactcaaataaacattttccagatgttaccttgtctcggacttgacatgtatcaaggaggcagccgtttatgtagtcccatagacgaacctaaataaatgaatgaaaaacatcacgaggagcattggaaaagcttgctgggaacacgttagcattccaaaatgattttgtacccacagtagaatcaccgcctccagacaaaagaaagctcggaccttctgaaaggcatgtgaaggcaatgcacgatacaaagctgcattattatccacaggaaatataaaatgcattaactaatacgttgcaacatttagctctaaaatttcactgggtttaatagataataatgcaaattcctagagatacagaaagaatgtagacactgtgtaaaataaaaaagtacgaaggcacaggatactgagcatactctgtatgtcctaggcaaaaactttgaatctcatgagcccctcttaaaggctttttcgggagtgatgtaatctacaaaacaaatttcaccaaagaagaaaaaaaaagagaattatgatccacacaaatgcagaaagtacagcaaagtataatggtttcatactcggattttaaagtcccggtcagctgtagcaatgaatcgtccatccggtgagaatttctgcattccaatacataatataagtgtgcagggatcggaaatttgaagcataatgtgttactttgatattttcagcaggacatacaaataactatggctaatataaaatatcaaaatttgtcataccatgctagtaataatactgcagtagtgaccaaaaattgacacaggtttattatcagttggctcctgctctccaccactttcccccatggtaactaaccaaataacaccaaatttatctgcaaaagttacatatgtgccatcattgctaatagcaactgcactgaccctcttttcagaagttctgcaaaagtaaagacattgcaaaagaaatcaaactcatgcatgaaggacttaatacattaccaaccacaaaaatgaagtttttaacataactaacaatactccaagctgctaagtgtgtcagccaacaattatgtgtggattctcataaacacgtagataagtagcagaagaatagttgtagattgactcactgaatacatgataaataaaatggtacactaatttggttaatccattatgctttcacaataaaacaaacagggtgacttacatggtccgaatgcagcaccatgaatcagtcttccagaccttaacaagcttgtcatcaccagcggatgcgaacagagcaccgtttgcactaaacgagatagctcttatagcatccgaatgagaaccaccgccagaattgtctgacaatgaaactgcactgctggccctggatccaaaaatacacatttattcgcacatttcaatattcaccaagtgaaatgaaggaaaaaataaggcatacatccatttagacattttcactgggcagtacaaaactaagcatctgagctgaaaattttatcagcagtgaaattttacacgaataaatatcaacagaagcttcatccttctatatgctatgcacttagactacagtacaatacgacagaccaatttaggctcaggtaaaaaaacgcatcacgtcccaatctccatcaaaatcaaactacttaactataagagtaaattgagatccgacaataggcaggaaggcgagccacgagcgaagagaggcgttccttacttgagatcgaacacgcggagctcgggcccgacggcgacggcgacggagcggccgagcgggtgggcggcgacgagagccggcgcgaactccgccgcgccgccgctcacctcggcctcctcgaccgcggcgtcctccatttgcggcgagcttttgcttcgcgcgtgggcttttgctttgcggtgggattcgaatcgagcgcgagaacgcgagatgggagggaggcggggaggagggggagttcgcgaggattagggtttatgagtggctctctcgttgggcccaccggtcagtgtctcggttggagatttggaggcggctttgagattgcagcccggcccatgaatacttgggcctttagttaaactcgagaagttttcttagatccactcaaaactcaattaataaattgtttcaacatccaaaacctctgctgtatctagatgccatatgttgttttttttttgtatttacaattttgccactggtttttttaattttgtaaggatgccaatcgaacaacagttctaattgcattttttaattatctggtggcaatcctacaatatatagatttaacccagtggcaaatttgtaattagttgttcttttttttttagagagagttccttttttcatcgtttgcttgttgatttataattcacaaccgaaacttaaatttttaagcctaattttaaatcattttatactattattgagttttccttttcagccttggattttaaaggctacaaatgtaatggttctactctcaaatcatttatcgttgctcgttttttttttgtcacagcttatcagctgaacccaaccaatgtgacacccttttttcaagaaaaggaaaaaaacagtatattactatattgtctagagaagatagcaacagaaaatttcaatatttttctcattcttttattttctgcaaaaacaccaggaccaccagtgatcgaaactctctcttatgttctttgggatttgcatctcctgcagctatctatgatcatccagcaatcagccattcaccagatttttgcaccattcggcaccaaagattcattccctgccgacaggcgacaggagccctgaagcctgaactaaaattggccgcgcaaccacacatttctgcagggaagacgattgatcgatcctctcttgctctgatcacacaagacaatgcagctgtcccgacaacgttgtccttgaatcgtcgccaaccaaaagaaaatctcttcaacccaacagcgatttgctcgaatctcattaaccgcgtgaaaaagaatatatatcttcagggatcgatggaaatgaaaactttgaccattttcgttttaacaatgttttgtaattctttgaaaaatacaccatattatcgaactatgataacctaactagactttttttttgttcaaccaaatatgataaatctaaaaattgttaatggttgaagttgaaacaaccctggtcagaggtgacagttgacaaagtaaataggagccgagggagtatcgttatcttctctctaaaatggattccgattaatcagaattttaatactggacacatcataccagggatgcagcctctgtcctgtccgtgtgatcnnnnnnnnnnnnnnnnnnnnnnnnnnatttactgaaatcttatcaaccgcgtaggagaaagtcttcagatatcgatggaaatgttcttatgttcagatatcactctcctcaaaccacatcttagattacagaaacacttgcagttagcatcatcatcttatcattatcactaacggatgccaattaattcgaattttaatcttagacagatcgtgcggatgcaaattcctgtcctgtccgtgtgattggtccatgcattgcaaaatctttcccaggactgtacgagatgataagggagaagacatcagggagacacggaggagcaggaggcagacatgggcaaggcgttcatggccatgtcaatcttcaggtgccttctggaccgagaattcgaagaatgaacgtcctatctcaccccgtcttcgtcgtcgttcgtcgtcgcatactactacatactgtcatactgacatgcagcgaatccatcagataagcccgtaaaaacatcgtctcgccatcagatgtcgctgcagtgccgcgagcaccctgacagccatactacacatgaactgacataagattcatcagcttgggccacattctgaatttcctgatctctgaacatgtttctgacagcacattcctctgacgaacgtgcagctgctagaattgtcatcgccggctgtcactccgtcagaacttgtcaccggatgatgcagatgcctggagatcgtttagccggttgattgattggataatgctcgagtcgcttcgttcattttagccaccattagtactgtattagcaccggtggctagtcatggtgtatagtgataagactgatggttacagcttcagcaatcagcatacgtatgcagacatggcatgtttatggcactgtacgattataccgtgttgacgtgaaccgtagtagagactttgtaagccgcgagtacgtggtagggtccatggatcatcacgacagccatgccatggagagggagtattctgttcggttttcagctgagcattatcatcagattcattttttttttgtttttgatagaggattatagtcagaaattggttggttaatttgtttttataatttaattgtacatggatgtctattaattaaatgtacacgacttggtggattttctagattccattaccccacttgctctctttgacaaaaatagcaaagaaatagtacaatggtgctcagcctagtacagatatgtacatagaacttgctctttccctgtaaaatagggcagagattcagtaaattctccgcggaagttttgacttggaaatcaaattagcgcgaaatctttgacatggtgtcagccatgtgcctaaaacaatcatatacatggaactaaagagagattcagaatcaatcaatcagagtatgaaatcgtgaagcagtaaacaaacctgcacaactgaagactctgcactctaaactatgtcaaaaatgctctttctccccgctgttcttttcccttgtcatcagggcaaaaaaaaaaaaaaacaataaccaagcagtgtactactactagtccatgaccatgttgagcagtagatggcctagatagcagtagcatgcatctgatcatctgatgggtactatccatgtgccaaaaagcaaaatctctcctttttttttcttctccataaaaaaacaatctgtacatttcattgccggtcgccgcgacagcgaaaggtgccatatcaaaacaatataaaggaaaccaacgcattgcacacgaccaacaaacaccaagaaaatcaatcagctaagcaacacaaggaaagaagaagaaatagctcaaagctagagagcacctactgctgctgctgctgccgctacgacctagtaatataattcagaaattcagaggcaagaacacttgtcatctctgatcaaagaagggagataaacttgttcagatactagttgttgcaagcatggaggaggagatggtggcggtggtgatgagctgcgagtgctgcgggctggaggaggagtgcacgggggagtacgtgggcggcgtgagggcgtacttcggggggaggtggctgtgcgggctgtgctcggaggcggtgaagtacgaggccgggaagagctcgccgcgggcgcccgtcgacgtggaggaggccgtgcgcgcgcacatggccttctgccgcatgctcaagcgcggcggccccgccgagcgcgtcgccgagggcatgtgccagatgctgcgcaccgcctcctggaagcagcggcggcgcgcctccggatcctcctcgtcgtcgtcgtcgccgtcgccgcgagccgcgcccgagcgccaccaccaccaccgcgcgccgtcgacgctctcggtccagctcatctgatcgggcgatcgatcatcgccatacatgtacagcgagcgcgcgcgcgcgcggtggcgtggcgtggcgtgcggttcttgtgacgaggtgcacgcagcgcacgacgcatgcaatctccatcgtcttcttcttcctctcgcatctagtagagagactagcagtagtaatatacataaggtttctatgtgaattttgaattttgatcaggtggtgttaaccacggtgaaagagggtgcacatatgtgtaatcaagttcaatatttttcacattcttttcaagtaatatttcacatgatcttgtactatactctcgtgcctttagctagcttcgcttctaggagtatagctctagctatccttcgatcatgatcatcgaatgctatatatggaccaaatgatcctctccgatagataatttgctttatgttttatttcttccgatttgatctactccgtacgtcttctccctttccgatcgagatcatcatcgccggcgcggaagctacttgctgcttgcctcgtcgaccgtcgtcttcattagcactttcttcactgcactccatgtaggaaggtacggaggcaccagtccttgttcagcacggcggtggcggcgccgccgccggtggactccggcgttctagctcggcgatctgcaccggccgccggccgccgttaattcttggcccaggagctagaattcatgggaaccattcgatcggcagtctacggccgtgatcgagtagaatcagcgatgagtactttgcataagtaccccttttaatactctatttttaacattatccgcaaataaagacacttggctttaaacaaaccgttggatcattttttaacggttcagattgagaaaaggattgtttcgcaaaaaaaaaaaggaaaggatttgcgagcaagatgtatttcccgaataaaccctcatactaatctattatttcatttatagccctatttcggaaccaatggtagcgacccgtacgccattggattagatttcaacagtgtagattaacagagattattttcactaagacccctatactattacatattacatatctagaccctttcgtcgtcctcgccgtccccttcctcccgtctctctccagtctccaccgccacagccgccggtgctccggcacggcggcacggcggcggccgtgcattaagggcgcgtggaactcgaaaaggtggccgtctccatcgccgtatagggctcgaggaatcgagcggtttgagtggtcttttctttttcctccatcactcactccattgttttggattcttgctaaccgaatggtgcagagtttatacagtggtatatttctctgaattttgctgctcgattttgcgtgaatctttatctccattgttttctctcaagaatctttccagggcaggcgttgcatttcagcatttggtttcttctttggattttgcagataaaatgttcattcttgtcaaagattttcagggaaaaagggcacccactcacaccactgcgttaattctctcccgacaaaaatgcccttttcaaccggttgttttctgaatcctcactatcaccacacgtgaagaaatcaagaaaagtgagaagagtcacgtccgaatttcctgtagctgcacaatgttaacatggtgacaaatgatcggagagaatgagagcaagcagaattcacgagatccagtccttttccacctccctgaaacctgaatatgttttcagtcagaaattcagagaaatgcaccaagtttatcctcaacacggtgctcaaccaccacaagtccacaatgacacctcatccatcttcccatgtttgaaaaaaatgagagtagctgctttcctacacctggccggctagaggtgctagatagagaaagatatcctgattttctcaacaaaatactctctctgaagtccaagaggacatctctgcagattactctgatgggagtatacttgatcagctgacagtgacatccttaagagtagagacaccgtaggcccctgtcctgcatggattgctgaattctgtctcccagaggaaatggcagtgctatcatcttcagaacggcactgcagtatactacaacagtacaaattactgttaatgatccttccttttatggtagaacttgatctgcagacttctaaccattctaaccattccactcaaagtctgaaattattagggatgacacagttgaagtgaaatcaaattagcacctgtctgatacatgtcactcaaagatgtgtgtatgttacaagcttctctgatcttgagacaaaaggcactgcattgctgcatctcagatggacattggtagcatccagtgtgacctggagaaagtgaaagtgcatgcagctcaagctttggatcattgtttctaagatgatcattttgcttaattttcgatgattgcaacgtgtaacatactttttcaggctaaagactgcgttccctttttctgatccgggatcatggcttcctagttccttcacagcaaagtaggagtatctactaattaacaactggagtattgattaaacactttggctccaaaataacttgttcattaatgatgatctcagtcaaaagagaacgagctaatctatctgcttgcatcagtgacatggacacttgagctttacgtgatttgaaaaattcagaagcttccgagatgtcagatgatcgaagaagaaacccaagaggatgtgatgtgctgacacttgcaaacaacctacggggtcgctgatcgggccaaggagaaagggatatgaaactttgtggatttaaaactgtgccgacatgtactggtcggtgtccagtgctgtcatgtggggccgcacctatgtgcgtcagcgtcgagcccgcgacgtcaggagagccgcggcccgagcgtccgcagcagactcaatcagcgcgcaggaaggcagggccgaggatagtagctagccttgattttaggagagttatttcctagtttaattatttccaaattagtagtttctaagtttgttggccggtggcctacttatcttgtattccgggtaacaattgaattaagcaaataattaccaatctaatctcctctctctcaactaagcctgcggcacggggcaacctcgccggagaagacgacggaccgaggctacgagctacgtagccgagggccggctacccgagggcctgacgcccttgacaacctggtatcacgttccagacgatcctcgccgcgccgcgccgtctccccaccacccgccacatcctcgccaccaccagccgccgcgccaccatcctcggactcgtcctccggcgcgtcctgcccacccggcatgggtgaccccaatgacctcaagacctccgtggaggctctcaccaccgccatgaaggagatgcaggcctcgatcgccgccaacgccaaggccattgccgccctctcctccggccgcacctcatcctcgggcgccacgacagactccggcgaaccccgcaccgtccggccgccgcgatttcagaaaatggatttcccgcgctatgatgggaagtccgatccgctcaccttcctcaattggtgtgagtcgtacttccaccaacaacggatcatggacgaagagaaggtttggatggcgtcctacaaccttgaagatggtgcacagctatggtacatgcaagtccaggcggatgagggtaaaccgtcgtggcgtcgcttccgggaactcctcgtcctacggtacgggccgccactccgttcggctcccctcttcgagttagccgactgccgccgcactaccaccgtggaggactaccaggaccacttccaagcgctcctgccccgcgccggccgcctgacgaaggcacaacgggttcagctcttcaccggcggtctgcttcctccgctcagtctcaaggtccagatgcagaatccgcagtccctcgtcaccgccatgagtttggctcggcagttcgagctgatggagcagtgcactgccaccctggccaaagcccctggccacgggatactgccgacgctgggtccgcgccaggccccgccccagccgccggcgcctagggccgcatcgccccctgtcctcatcgacggtcgcccggtgaagcggctctctcaggcggagcaggacgagcgtcgccgcctcgggctatgctttaactgttggaattaatgaatggaccttagcccactcgaagattaattctttggaaaatcacaaaagcccacctcatgggatggcatgcatgtggagtttagtaccaccttgcttattctaggagaggaggacctccttaaaagggaggatgccctcctagccacttgaagcatgtgtggtggagagaagaggggaaacgcgcgctcgctcgcctggcctggcctggcagggcaggcggcgcgcgtgcacgaagtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacacgcagcagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcaggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaaacagccggtcttttcgtcacctcggtacgtgttcaatatgttgcgcatatttgatctgttcatgttattctgcgtagtttacatgtgtagatctaatgaggcgttcatgctagttttcatctgtaatgtcatgatttatttatggaataaatttaatcattatatgcccataatctcaacaatccaaaaaccttattataggcactgtgattttactatggctggttttgctgatgcactgaggccggataaattcaccggtgtgcattttaagagatggcagatcagggtcactctgtggctgacagctatgaaatgcttctgggtgagtactggcaaacctgaaggaattcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcaagagatacaaaccatggctaaggaactcgaactccttaagtgtgtcttacccgacaaatttgcggccgggtgcattattgcaaaactacctccatcttgg

SEQ ID NO: 32158 - DNA, 808 bp, Oryza sativa
gaagcggtgctcggtggcccggcgaggagggaggcggcgcgcggcggccgggcgaggacaaaggcggcgctcggcggcccggctagaagggaggcggcgctcggcggcccggcgaggagaggtggcgcgcggcggccgggcgagagaggcgacgcacggcggcctggcgaggagctcggcggtgctcggtggcccatcgaggagggaggcggcgcgcggcggcccgacgaggagaggcggcgcgcggcggcccggcgaggagaggcggcgcgcggcggctgggcgaggagaggcgacgcgcggcggccgggcgaggagggagacggcgctcggctgcccggctaggagggaggcggcgctcggcggcccagcgaggagaggcggcgcgcagcggccgggcgaggagaggcgacgcgcggcagccaggcgaggagggaggcggcgctcggcagccgggcaacgaagggcagcttcgacccggatgtgaccatcgaggacgtcggcggaggcggccgggcgaggagggaggcggcgcgtgcggctaccgagtgaggaggggcgccgtcgtccggctaggcatcgcggacggagcggccgacggagtgtagctgtcgcgctcgccggcgacctcctcctctgcctcttcctcctccggcaacctccgccgccgcggcctactgccgctccgcccgccccttcgccccgccgccgttccgtccgccggcatgctcctgccgccgctccctgcgaggacgactggatgaggagagcgaagaggaagagaaaaaagagccgggagggacttgtg

SEQ ID NO: 32159 - DNA, 337 bp, Oryza sativa
cttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgattctgcaataagtctgtgaaccatatttgtggcagtgtggatgatgaggct

SEQ ID NO: 32160 - DNA, 6514 bp, Oryza sativa
cgggactgcctaagcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacataatggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccatagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaagctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctatattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattgtggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagtataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcatggcatggcatggcatggcatggcaggcggcgtgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcacgcgactgctccctgttcgttcgcgacggctcgccttcctcttcgctcgcgtgtttcgtgccttcgtagacacctgcgaaatgtttcgaccaagcagccggtcttttcgtcacctcggtacgtgttcaatatgttgcgcatatttgatctgttcatgttattctgcgtagtttacatgtgtagatctaatgaggcgttcatgctagttttcatctgtaatgtcatgatttatttatggaataaattaaatcattatatacccataatctcaacattaactgtgacgagaagtacagccgtggccataacaaaatctgcaagcacttgttcctcttggactgcgctatggatgacgacgacgacaccgacgcggctgaggaaccgcaggacttggagtccccggtgttctccctccacgcgatcgccggcgtaccggtcgccgacaccatgcaggtacaggtgaccgtcggcgccaccaccctcaccgctctcctcgacagcggctccacccacagcttcattgccgaggaggcagcgtgccgcacgggtctgccggtccagccacgcccacgcatgacggcgactgtggccaatggcgagaaggtcgcatgtcctggcgtcatccgacaggccgtgctctccatcgacggctcgctcttcaccgtcgatctctttgtcattccacttgcaggttacgacatggtgctcggcacccagtggatggcgtctctggggccgattgtttgggacttcacggagcggacgatgtccttccagtaccacggccgcaccatctgctgggcaggcgtgccgtcgtctcctgcaccacgcatccgagtcacaacagcggccagcgagtcgctactcgatgagctcctagccgacttcggcgacgtcttcgccgagcccaaggggctgcccctgcagcatgctcgagatcacaccatcgtcctcaagccggacgcgccccctgtcgctgttcgtccgtaccggtacccggcggcccataaggatgaactggaacggcagtgcgccgctatgatcgagcagggcatcgtccgccgtagcgactcggcgttctcttcaccagtccttctcattaagaaggctgacgggtcgtgacgtttctgcatcgactttccgctccaacgccgctccccgacatccaccatggtgctgttgtccctgagccgattcgggtggagagcgctcgcttggcgcgcggtgtccgccagcttcttgtgcactggcgtggtgagccggcctcttctgctacatgggaagacttggaggagttccgtgccgtgtacctggattttcagctcgaggacgagctggatcttgaggggggggagagatgtcatgtggggccgcacctatgtgcgtcagcgtcgagcccacgacgtcaggagagccgcggcccgagcgtccgtagcagactcaatcagcgcgcaggaaggcagggccgaggatagtagctagccttgattttaggagagttatttcctagtttaattatttccaaattagtagtttctaagtttgttggccggtggcctacttatcttgtattccgggtaaaaattgaattaagcaaataattaccaatctaatctcctctctctcaactaagcctgcggcagggggcaacctcgccggagaagacgacagaccgaggctacgtgctacgtagccgagggccggctacccgagggcctgacgcccttgacaagtgctcccagaagaaaccaacagaggatacgaaataaagaaactcatacaggcgatatgcagcgatgatcagtgaccgttccatgtaaattgtgtacaataggtagctaattccgtcctaaagcacttctgaaatttttcacgggaactaaaaattaatgtgaaactaaatgatgattgtgatcaattaggatgaggaaataaatgaagaagctaaaataaaaaaaatggcatgatagtttagatgaagatgatgaaataggtgaaaaaaatgctaaatctaggaacaaatttgaaatgctagaagttgttatattttttaactgatggggtgtgaattagttcagtttttacgaaatttcattcaagagattgttgttcaccaagcaatgaagggattagttgtaaagccctgttcttttagctgattagcttagctatttcctttttctacgttttctaagttgctaaatgggatattttattagaaactttctttcaaaaatcaaacaaatattttctaaaaatttataatagttattaatcatgtggtaatgtttcaactctttcttctgttctatttaggggagcttaaaattctaaaattctgctggttgatagtcagtttatgagaatcgggagaaactcagtttttgaacttatggtttataattcattttctgaattttaccatatattctcataatttaggtgataatttgaaccgtttaaggaaactgaaaattatatggaaaactgccgcagctagaaaatccttcaaacatgcccttcgtgacacattcagctcaggcacatgtgtagaaaggaataagttcatctgaggtcccttaacttgtcaacgaatccgattttcgtccttcaaccagaaaaccagatacaacgggttcctcaactatcaaaaccagtgcagatgaggtccctcgacggttttgagggtggttttggctgacgtggcgcctacgtggcaaatttgacttggtcttcatctgatgtggcattgatgtggcgcatacgtggcaatttgatccgaaaaaataataaacttcgtgggacccacatgtcagtctcacacataaattaataaaaaaatggtggggcccacgtgggccccacatgtcattctcagcatctccctcttttcaactagagcccctcttcttcctcctctctctcccttctcccatccccgaggcggcgggcagtgtccgggtgagggatggcagctcgcggcggccaggagaggagggaggcggcgcgcggcggccgggagaggagagaggcggcgcgtggcggccgggcgaggagaggcgacgcgcggcggcccggcgaggagggaggcggcgctcggcggcccggcgaggagaggcggcgcgcggcggccgggcgagaaggaaggcggtgctcggtggcccggcgaggagggaggcgg

SEQ ID NO: 32161 - DNA, 10476 bp, Oryza sativa
gtgggccccaccattcttcatttatgtgtgagactgacatgtgggtcccacaaagtttattatttttcgggatcaaattgccacgtatgcgccacgtcaatgccacatcagatgaagaccaagtcaaatttgctacgtagcgccacgtcagccaaaactaccctcaaaaccaccgagggagctcatctgcactggttttgatagttgagggacccgttgtatctggttttccggttgaatgacgaaaatcggattcgttgataaattaagagatcttagatgaacttattccgtgtagaaacgaacgggggcctaaactggtgtctggtgtggcccattaacacttcagtactgtaggttcatttaccggaaagccgaactccaaagtcagaaagcccccacggatcatccgtgggccccacacgtcagccacactgcaatcaccagatctcccaccccacgaccaggagtcgaccgttgctcgccgttgtgccaccacgcgatttcaaaatttttcaactcgtctcttcttcttcttcttctccaagccgccgcctcgcattaactcacagctccgagaaaccatccagccaagccatggacgagagggagatggcggcgaggagagcgccgagcgccgccaccacgccaccgaccaccgccacgcgctgctccaccaccgcgtcctcctgctcctcgaactccaaccccagcgtgtcggcggcggcggcgcggacgccgccgcccaccatagtcgtgccgtgggatggggttgcgggaggaggagggtgctactacccgggatgccgcaaggacgccaactgcgcgtgcgagatgtgcctcgccagcatcaacgccaccagggacctcctcccgccggaggccgcctccgcgcggaggtggttcgccgcggcggccagggacaggaagcccgctccgcgcccgctcttcggcggcgccgacacgacgccgcacggctcctccgtcacggagccgtggacgccgccgatgcggtccaccgcgaagtcgaggaggccccggcagcagcaggaggcggccggcggcggcggtggcggcgccgggaggaagacccccgggggatcgcatgactgggccctctacacggccacggttcttgggttcctcctcctcctctgggtggactccggcctcgtcccggagatcgcggcgaggggcttcggccccaagctctcgccggaggccgtggcacggctggccacggaggcgcgcctcgcgccgggcggcctgagccacaagctccgcgccctggagcggatgctcgggcagctcgtcggcggcgagaaggggatctccaactgcagctcgcacgattccgtctggcaattcgagcaggtattaacattttttccctttttggttcctgcgagaatgttgaattcttgatttgggttaaagagatttccatctcgatctcgcgcagaatgatcagcgcgtgttctactggcgctgcgccgtgtacaagtcggcggcggaggaggtgaccgtgtgggggagcccactccgcacctccggcctcctcccccgcgcgctcccggcacggcacctcaccatcctctccggcaagatcaccgaggtaaactaagggggtgttactaggatctaaagttttagcgtgtcatatcagatattatataggatactgcatgaggtgttcggtactaataaaaatactaattacagaatccataagtaattacgaaaaactaattaaaaaaactaattacgaaatgacatgtaatatagtggttacagtgacctgagtagtacccaaaagtcctgagtttaaatcttctatggagtgaatttcagattggattgtttgcggggctaacttccctatctcaatggccgtatatatccggttagatatggaggccgggtagaaaatacccttctctaaaaaaaaatccatcagtaaaccacgagacgaatttattaagcctaactaattcgttattagcaaatgtttactgtagcaccacattatcaatcatggagcaattaggcttaaaagattcgtctcgcaaaatagtcacaatctgtgctattagttttttttagcatatatttaatacttaatacatatattcaaacattcgatatgaattgatatgaattgtgatatggtgaaaaattcgatgtgaattgtgatatggtgaaaaattttaggacgagatgtaaacagggcataaccgatacaaactcccagaaaaccaatcttgcatttgcagctagctagctgagccccgcgtcgttgttgccatttttgcagtggtccgacgggagggtgtggccgacggtgagggcgagcaacggcagctcgtggagctacggtgggcggagctcgccggcggtgaggctggaggccgagacgtgggtggtggagtaccagaggagcgtggtgttcgaggggacgcggctgatccccgccgcggcggagctggtggcgtccaggtgctcggcggtggcgaggcgggctcgccagaggctggccaggcgacggttccacggcggcgccggcgggattcaggcgaacccgacctgacttcaaagactctggcttgaagaagggtggtgtttaggatggtttttattagcttttgctttgttcgtctcatctcctgtgagattgatggtggaacacactgtgtatccgttcttttggttgtattgatgtgatgtttagtcagatgaacggggtaagaactgccgaattattctgattatcaagatcatatcttgattattactccctccattccaaaataaacgcagagatgagtttctgtgtccaactttgattttccgtcttattaaaaaaaattataattaatattttattgttattatattatcaaacatgaataatattttatatgtgacttatttttttttaaaaaatagacgaatgattaaagttgaacacgaaaactcatggttatgtttattttgggacggagggagttgatcgatggtacatacgtacagtagtgttatcaaactcgattggtagtgtattctgagaaaatacgtacggttcaaactcgaatccttgccacataaacatagtactgttcttcatcctcccctctgtgtggccagacgcccagacccatcattcgtctcatgcccagggttcctttgttttggtgttaaaatgtcagccttagcgagatggtagatttcgtgaatttcaagagaaataaattcaacgaatttcaaccaagaacaaaaaagattggtttggggaactctaaatttcggtcatgaaacatgaatgaaactgtgccgtctgctcaaacatccatctctacatctatcacattttccaaccttaacacgtttgagaagagggctggcaaaggtggggaaaatccattcacaattccttgaaacaattcaggagagaacaaatatggagctgaactcaacgagcgcaacaatggagtcaggtgcaatgagccaatgactcagcacgatgatgctgaagattcgtctgacagcatcgagattccagatgaccaggagtcctaaatcaagtgatactccctccgtcccataatataagtgattttaagtttttacttacactgtttgaccgctcgtcttatttaaaaaaaatttagaattattatttattttttttgacttactttattatccaaagtactttaagtacaacttttcgttttttatatttgaataatttttttaataagacaagtggtcaaacagtgcaagcaaaaacttaaaaacccttatattatggtacggagggagtatattaatagccgcaaccaacaaatcaatcctcaggctgcaggctgctgcttcgagcgagacctgatgtcaccagctgatctactatttcatcagattactcagccaccgcagatttcatcaatcgccggggttccttcagctccatgaattcttcagtattgcgattccaacaggaatatcgcctaatcttacaactgacaagcagtaattactgaaaggaaaattgcctccgtgctgcgctgctgctcattctagtcaaaatctgtaaatgcttacctctccaacattgctctgggatcacagcagctgcagcagaagcaacctgtaatgtaaatttacttacacgacagaagaacacaaggataaacgacgctgacagtagaacgatcactttaagtacggtaaaactggtactgctaaacggtaaaactggtattagggagagcgaaggttcctaaaggcatgtccacggattaccgcgagtttcacggtattactggtttagtccaaaccagatgggttggtaacaaactcatacgacagtacaacaaagcaggcactctcagttggcagtatcagcaggtagcccgaaatgctcctgaatgactcctgatggcgttttcccaaatccatcagcgattcccagcatgaccttgagcttctcctcttcactcttcacttgatccacacgcttcataacattggtgattagtgtactatatagtgaaccatcatcatcagctaagggcatagggtctgcaaggacggatctttcagaatcaagctgacgataaagactcaggacatgatccttctgggaataaagcttctgctctgccagcttgtactctgcttcctgagatctcttcagttctttaagagcatgatctatcgaatcttcgaacctgacagacagtgtgtgttgatcctcggtaatgtaagctggaagattttcaacagccctctgcaaatcattgtcagccaaatcaacataatatggaaaccctggaggagcatcctcttctggagcttgctggatcccaagcactgttacaccaccggtagcaggggaaacttctgcatgagacatatggaactcaattatgcacaattatagcagcaaagcaatacataaagcaacaacagaagtaaatctgagatccaaattgttgtcagtcctctatggttttaattgtgcaaaattacagacaacatgattagcagcagtatatctatagcaatgaagccatgggcatgacaggggagctagactccacatgttacaaaaactaccaaaacatcacttacatttttcaaaataaatggtctgtatggaacaaatcgcagatggttttgactagtatgatccaaatatcagcataatctatagagtttccgttctgtctaataacataagagggcaccaaatatctgggccattgcagctaggctgggcgctgtttgagcaatggattgtcctctggatatctagagcaatatatttgcctaatatagttctctatgatcagttgcattcaaaattaagttacctgcacttggagttgagttgataccattatcttccattttccaaacttcagcaagatcaaccccacactttagctgcatatagttgtaaaccatcagtgcatagccacaaactacttataagagatcaaaaagaagataaatggtgaccaaaatggaagtttccacaagtggctaaaaaaataaaactgaccatacctttgccattgctgatctcataatgctctccaagctttttgctcttgtttgtcttgaaccacgcactaggcataagccagtattcaggataggttcaatgtcatcccttgattgaagagattggcatatttccaagaatttttctacgtgcagcatcaagttcgttttgttatcacaacgtctgcaacaatactgcatgtccaagtcaatacatcctccaactgttccagccataaaagtacggagagcacaatcaaggtgcccaatatgcccacatattttgttctcttctaggactgcctcacacttaatgtagctataacctccaaaggaatagtcaacaaccctgcggcagaaaacacagcagcactctcggcagaaatcaggcattttgcagcagaggtcacaatcctgtgccggagatgattcaatgaatccctctctctcaagtttacacaagttattcctggccttgcatggtccagctggatcagcttgccttgcataaggacaaaagaccctcctcacttctccacctcctgaagacatttttggtgttaaagaacagcaaaaatacaagggaaaatcaacaaagtagcagaaaacatgcaaaggcagtatataggatgcattttctaacccgttaacacacaaaggaaagaacacacatctcaagtgaagaaaaaaatccctttggctacatgttacaaccaaggtattggatcaaacctcacatcaataccaggttagatatgaataaaagtaagacaaaatcagtttatatgctacatatgaattccgaatgaggcaaatgatctattttcctttatcggtgttacgatttggggaaaaacaccacttgaatcaatggaaaacaccacttgatagaaaagaatggagcttactgtaacttgactccagaatatagacgtaaaaaccagcgtcagtgttactctccgaagggggaaggagatagcgttcatggatccgcctcaatgagttggttcgcgcaaatggatccatcggcaccacgatgaggtagaggcagaagcaaggatcagattggcggctagggtttaggagcagagagtgcaagaggaaagctgtgtagaacaacctatatatacagtggcggagccagaaatgggctttacccaggctgggcaaacaaaccatcctggtatgggccctctatacctgtaaaatatactttctataagggttacaagggtctttcaggaccaggcctggctgaagcccgagcagcccagggcacgtcgtcgctaatttatggataaaatatgtgtgctatacacaggataaacattaacatgttcagagcgcatccaccaaaaataacaaccgaggctggaaccacttcccagattacacatgaacaaaagtatttagcaaatagataggatatcattctggctaaacaatattgagaacatagttgattggctacactatataggcactgtaacaggagatttatcacatgataacagatatcgacattgatggtgcataggcacaagaaaaatcaaaagtgtggttagtacactgagaatctattgcattctgagaagcactgtggcctatcgactttattatttccaatgtatactttttccatttttatttccagtgtaacatggcaggtaacctgtgatgttttcacatttctacactagattatcctgttagttaggaggtatgctaagtggtagagctgaataaagttattgaagaaggtgcatcaaagtacaaaaccaatcaaagtgtttataacgataaggaatcgatggcacagactgtgtcaaaagaaagtctaaaaatgtggatcggggatacatagggtagagttccagtgatatgttagctacttaaaacataaaagattcaaaatatggaagtttatacaaaataacagtgaaaaaggtaagccatacaaaaatcagattttgattacacgagaaggtcactattagatagaggaaaggaacacagaaaggtcctcaggcaggtaggcatttttagtaagtaatgttgtatattaattacttcaagagaatcaaatagtaagtcacaaaaaaatatagtctcctatatgaaatgaatgtttttccaaaaagaaggtctaatcctacataagaagcgcccaatacacacaatgaaatgaatggtgtatggcactggctacttggtgaatatctctacaaataagcacctggtattatatgtagtccaagccgctagtcactacagcgtctgtaatggtctgctatagtattctaaaccgcacagaatccaatagtcaccacaactgccagtgagctgatgtcagagcccagtctctggtccggtggttgtacagcaccgctaggaaatactgtaaaagacaatcttacatggaaacagcaactaaaagaacataaaaggcaacagaaaggtttaacctctttggatacagtgtcctttagcagggatcttccaaataaacatagaaaagaatgtgttcggatccatatctggaaactctgtcttgataaattcttcaacctttagtctacttgtgaatgatgtctttttaccagtagcatcacgaaaacgtgagggcggtgtaaggtacctgttcacagatgtatccataacacaagttaatagtactgctaaaattcattttctagaccgaacaaccatagataactcaaacaattttggtggggaaggccagcggcctgttggtgggaggctgtttaaccttgccatcgacccagttcaagtcctaccactagcatgagtgtcccttctccttaatggaatgatagagctactggcccagttctaaaaataataatgaataatagcatacgagccttccaacacactagaagaattcacctaccaaacttggtctgattctaattaagaatcagtgtcctgtgtttattttcttctccttatagcaaaagtaaaaaacttcagatggaagctatttaggcctagaaaacagcattacctatcaagccagtggccagttgcagaagccctgtttcccactttccagctccattgatctccaggacatggccagttttcgggagcatagggcatacctgtaccacatgaattaccttcaactggcatagcaccattctcacttgtgaacttttctgatagatcctgctcctcagctatgttaatttctgttaccgcctcgctagggacctgaaagaaacaggaatctcatcagtcaagaacatatagccgaaattttactcatgtactgaactcagagactattgcgcagacttgcattcattctttgatttggtcaagtgaaagagaccaaaagaacagttagaacaatggattatctcaatgcagagaagcaattgtgtacagtgaagttttggcgagatgcaatggattacatacaaccttgcatgaatgaaatgatagacaatttgatgacagcagatgcacaaaataacaaacagaaattgtacagcggtatgagaacatgcagcacgcaggtaataacaaaaagctcaaggtacaatttatcttatttgcatttttttttaaaaaaatgcatatgcacctactgaacaaaaggatctggttaccctattttatcatagactactttgcatagattactgttgggccaagtgtagcttgcagctgcgaccaaatagtccacggaataattctgaccaagctagtaaaatactgtgtttatcacatgtaggtttatagggctaaagaaacactgcatgccacaattttggtgacgaaacaaacacttgcataagaaagcataacaaatagttagaggtggaaaaataaggattcaaccaatcaccctaccaattttactaatgctaaaccctcattcaacgaaatgaaaacaaatcatgtcagcaaaataattaattatatgtctcatatttattcagtttcagagatagatacctcgttttcattcaccatttctttcgaacttttgataataatgggtgacaccaaaacatttgttggtgtccgttgagattccatgtctttcaaacttttgacaatgggtgacaccaaaccatttgttggtgtccgttgaggtttctcctttggtgggtctcttcgcgccttttttgccggtggactctttgggctgccagaagctagacatctttctctatccttaccgaatagctctagtaacctatcgtaatgatcaatgggcttgttgatccatttcctggcttccggtttcctctacaagatcaaagcaaagagttcaaaacagcttgagaaatttcagcaatgctgattgattgacaacaaaaaataaacagacctcgatgtactccctccaaacagttgggtcagcataaaacttcttgttcatcgcgctccacttaaagccactctggttctggaagaggttctcgcattcatggaagttctccttgatggacttgagacggttcttgatgtttgacctgtcgatggccaccccgaacctctcggcgaccccggagatgatgctatcgaaggccgcggagtgaaacctcccctcgcccctgttcccgatcgcctgctggtgcagcaacgcgtcgatgagatactcgttcatcttctcggaccacaccaccgtctccctgccgcccggcctggggcctcctcccgcattgccgccgccgctgccgctgccgctgccgctcgcgccggggctatacttgcctttcttcttcaccatctccccagccacaacgccgctcccccgcgagcgctccgccgccgccgcctacaccgcacgggccgcagcgggcgccgcgcaaacgaattgacgaaattgaattgaaccctccacccaatcccctctcctcgccccccccc

SEQ ID NO: 32162 - DNA, 11792 bp, Oryza sativa
tggtgcgatctaccagcgaagaagcgtagcgagaggtggaccagcgtggaggaggaggaggaggggaacgaacgagccaacgaacgcgacgcgagagagagagaatgggagtagccgtattctctctccgttgggtgggggtgggggaggctggtggtcaggtctactgatctctactctaccaatatcatatacggtgggcgtatgtatggagtatgtgtatacgtaacgtacgtacgtagacggtgagtttggctaaaactggacacgagttaatgctgggatatgggccggttgggccttggctggacttggtctgccacatcgcggtccagctggcacggcgcgaccgccacgttgtacatggagagggtttttgggtgtcgtggaggttgaatcggaggacgacacgtagaatttatgatgtggcagtctatggtggattaggtaagtctgaaaagatatagaccttatcacatatctatattattttctaaaaaataataataatggtaatggtaataataaataaacaaaaggtccaaacaatctaatggatcatttcacatttgatgttgctataagtttcggattccaatgagtcaacatggcatgacgtatgttataaaaccctcgcatacgacaaaatatagttatcataactcttcatcttttaacataacaaatcacaataccttgtttatttgtgtttaggtaattacatctttctttttccaatccttctgtccggtattagcaacaagttttcccgctaaaggtgagatcaaaatgtagttttactactttctgaaaaacgacataaattatttttaagtatagccggacatattaaagacaattgtttttatttcattgaacttttgtataatatggtaataaactaagaataaagcacaatcatttacatggtctattattgccatataacttctccatagtattgccactttatcacatcagcggttacattatattaattaaactgtcatatgtgttaagcgttatgtatatttcagttatttgaataaactcaataggggcggttcatgtttcttgagagttatgcatatttcagttatttgaataaatcgaataggggtggttcatgtttcatgatctcaggtgaggaggacattaatgatatgggatgctaaggttcatcttccatcattatttttaccgagattcatataagacgtgtgttatatatgtataaaattaaggggttgcacctctctactaacaacagaaaaatataacgagaagataaaacatcccaaattaaagcaatttaggaaaaagtatgatcaagttaccaacagtctgacaatacactttaaaattcagcccttctaaccgagtgtggcaaggcatgataggtatcaaccccatttgttgtcttgaattttaattatatcttagatgaagtggaacttgctaaccgacagaagcttgaagcatatttgccataaagcgattggatgagtaatggtatagcgttcttatatataagtggattttataatgtctaaccccgttgggttttatgtagttttttttagtcaagagagaactttattaatgactaaatagagggttacattcttgatttaacaagtctaggattgatgcgggggcgcacagcctccattccccacacgacctagtactcgttgccatttgtgctaacacatgagcaaccctattagcttgtctcttaatcttgtgcacttgcacccgttcgatacaatttagttggatttctatcattagaaagaagtgcatatctcacacgttgcatcttgtatttagacattagattcaaggctatacctcactcgatgtgtgttaccatatttttaggattcaaagttgttggcaacttttttgaacaagtcacaaaatacgatcgaaacacctaaacgtcatatggtgacacggagtcgccaaccacctcgatctaaacaaagctaaggctgcgttcttttcagtggattgggaactcctttcctttgcacggaaaacggagcggtccattagcgcgtaattaattaagtattagttaatttttttaaaaaaatggatcaatatgatttttttaagcaactttcgtatagaaactttttgcaaaaatgcactgtttagcagtttgaaaagcatgcgcgcggaacacgaggaagaggggtggaacattgagcaaagaacacagcctaaatcaagatgagttttgtaaaattaaatcggccagtggagccgatttagatgaaacagggataaacacccgtctcatgggcaaatgaaaagtttacaaaagggtatttgcactcttacagcgaggatagatgacagttagttcaaaccgacaaaaatggacaaaactaggctagaattaggcagaaagtatatgcgacattgaaaaagtgattcaattggctaattgtgctagaaacagattgtgtggtcaatcgaactggtcttgacccttataaagaggtttatcttgctttctataagacctcctccacgtctaacttagggtagagatcaattaggactcgaaaaaatagattaccaaacaatgaaactcgagactcagactcggacttagccggtctgactagtcacaagtcgtcggtcagactggtcatgtgaaagaaacgtacttttcaaactctgacaatgatttcctatttcgtgtcaaggtgttaaatttttggtgttaacaaaaaccatcgtatctttttcatttacagtagaactcaactacgagtaccaacttatgacgaaaataaaagattcatttaaacgggaataaattcgtgtgcagtggtgggtaagtgtaaaaaaaaaaagccaacaatcccaaaaattcacctgagcattaacctgccaagtcgtgccaggccataccggccaacattacacggacgcatacgtgcacagggcttccacgagaccagccacgcaagcacctcccctgcatcacccaccgtccagaactcgatcgacggcccagataatcccacgtcgtatgactgcaaaaggaagaggagataaaaactcgagaaattaagccctgaaccggaaggaccccgagaggtcgtcgaatggcaactccgcctccctcgaacccgacgacgacgctccgagtcggctctcactgatcgcttctagaagcttccggaaggctccgaccccccgccatggccgcgcccttcttctccacgcctttccagccctacgtctaccaggtggggctcctccgctgcacgatctgatccttcaatttttcccttcgcacacacggtctggtcttatcccggcgtggatgttagggctagattcgagctcgtcgggctggatccgcccgatccgtagcgtttggttgctgattggaatcccctctgatctaacctggtttgaatcgtgtgtgttggttccagagccaggaaggatctgtgacggcgttccagatatccggcggcgatgtgcaggtcctgcaggtagctcctggttattcttgtttgctagctcttaatcttcgatccttaagaggaatcgaaccctgctcattcggaattgttgtgtcgaaatgatattttaggtgatggttaagtcacaggaaaagttgaccgtgaaaccaggtactctccagtaacttgattgaacttctcttttgcagctgaaatatctgcagcttgcccgatttatgaatactctttgtttcagatgctgaattacctgttgtttttaaggttaactttgtaataattgggatcagttgcagaactatagattaccaccatacttttagttgtatgttatgataaaaccagataaatctaatatacatgagtagtttcattactatcatggttttgtagtgcaatttactgtaacttgtcctgaaattcctagtaaattaaggggctatgtgggttcctttacctacccaggagtacctaaatttggataaggatttacatgctcatagataggcaacggagccaaacatacatttatgcggttattgtaatagtaaatccaaaactgttgttgtaaacatttcaaattgtcttctttagatgaatggcagagctcctgccctactccctcgaaaaaaacatgtatgcagttgttactgctagtgcttgtcatatggcttctgtgaatcctgtgatgttcttagagtttgttagtgtgtagctttcatcattgttgtattcttcaggtacaatgtgctacatgtctggtaatattcaaacggacaacaactacttgcctgaaaatgatggaggtgtgtggcagtggatttttgggaaaagcataagcagcagtgttttcttcaaccctggctctgatgatggatatgttgggatttctgcaccatttcctgggagaatactgcctgttagtatcttttttgaaaatagagtcattatgtcattcaaatccctagtatcatctttcacctacttgtagcttagctttgactctctgcaccattactttacttactgtacagaactgcatatgagcatatcgctcatgggtaatcatcactgttgtcctcttacaattagcaagattacatatcttattagtgacaaactgacaaatttccatcattcttctataattatgattcagaatttagactgttggaggacttgcttcattcttttgttcaaaatttcaaatgcactccccagcactcagttgtttccaatctgaaccatatgttttacctatagataaaaaggtcaacagttcattgtgcatacattagaatttggtcctgtagcaattaataatgaggtgtaatgtgcatactagcatgataataacatgtatgagttaatctagtaagctgcatgagatgtaggttctggatgactagatgtgatattatcatattattccagcaaaccattgccttccgtgaaaatgaatacctggttcagtgttcatataatttactctattaaattttatggaaagtggtacttatattattgaccaacctgctttcttagtcataaatggaaaatgtttattatattacagatggatctagcaaactttggtggagaacttctttgccaggtaagttatgtgcgaagttagttgtttggctgaaaacaatcacagaaacctcatattaccttattgtcctttcaggcagatgcttttctctgctcagttaatgatgtgtcagtcacaagtacagttgagcagaggccgcgaaacattgaaattggtgcagaggtagggtaattaactaattatttaggtactttggagatcatgtgggacctgttagttctttgcaagctagtacttgttaactttttgttgggaattgaaagatgtgcattccctctacaggtgatcctcaaacagaagcttaggggtcaagggatggctttccttgttggtggtggatcaggtataattcatttcaccctttgtgtcagtttcatggactggagattgattttggaatttgaaactgcaatactgttctgatctatggagtaaatactagaatatattattgttcatactataattaggagctatggttctgatgttctgtaaaatttttaggatgcattgaggatatatactatctagtgctaaaggaacataatatggtgccacagtttatgctggcatgattttaatgttgtcaacattggcaatacctgcggcactatccaattcactatatatttacatattctgtcataagttagatagtgaagtatgaaatctccgatttgtttcaaattagcatggaaccttttgaactcatatcgtttttgttttgacataagcaagttattttttaaccctggccaacaaagcccctaactctggcagattttgctcttcacttttgctagtcatgcagaaaattcttgcccctcgtgaggtgattacagttgacgctgcttgtattgtggctatgacaaccaccatcaactttcagttgaaaacccctaaccaaccgagaagagtagtcttcagtgtgagtacatccgtcccccctactgcctatcaactaaagtttcttgttgaaaataactaatttccttacactgatgaaccatcggctatgcaggggggtaaccagcttacagcatctctcacaggaccaggcgtggtcttcatacagagcctaccctttcatcggctttcacaacgcattgcaaggtaagatatgctgcaatgcatcattttgtaccacacctagctcatcaccgactgtacataactgaatttattcttgtattctcaagcagtagatcagtggccgctccgagcttgagggacaatcccaagttcttcatccagattgtcatgttcttcttcctcgcgtatgtcatgattgtatcatcgataattctgacagatgtttagatgctgcaacaagctactagtcgcgtatgtcttagagagtcatcaaattgaaagagtaaaatctcttgcaagtttgcaactcaaagtgcattctccaccaccgacccccttgtagatgtgtctcactggctccgtttcaagttgaaaagaaggcagtgcacaactgttgttagaaagttaaatgcaaagttcaatgaatcgttcttttgtaatacttgcagcggcgagatcttgttggtcaatgagttcaattttcacagcatatggtgaatatacactaaggagtgattatatctgcacttattggcagtacatatcgcttaatagattgtcaggattatgtaactagtaatccctccttttttaatatataaacatttgttaatgactacaccctcgtctcaaaatataagggttttttaatatataaatatttgttaatgactgggaatataaatatttgttaatgactgttccctcagtcccaaactataagagattttagatgaaccaaaccataagagattttagatgaatgtgacgtatatctataagagattttggataaatggacgtatctcaagagattttggatgaatttttggatgaattgacgtatcttaagagattttggatgaatgaacgtatcttagtattatgaatctatacagaagtttatataggagtttgtagtactaaaatacaaaccattcatccaaaatctcttacaaaatctcttatatagtactattatatttatatttatataatatatttagggatggagggagtatatatgtattatattgctgcttcgtctagaagatcgatcattagtgagtagtgattgatgtcaaatatgctcgttgtaaactattagcactctggattacggtaacacatgcgacgactctcttatacggaggagaatgctacacataacagttttattcatagtatatagaacatattagcacgcacatttttgctaaaaaataaaacaaacgaaaagaaaaacatacttagcaccgtaaacacatatgctcgctaaaagctacgggtcgggcgctcctggttgagccgcgccgccgcggtcaccgcgtccgccacgccgcccggcgtcgtcgccatgtccggcctgttccgcacctcggccgacggcaccctctccgcgtcctccctcgtcgccgccttgtccgccggcagcttgcccctcgccccctgcgtgcacacacacacacacaccatccaaggttagctatagctgctgtacggtcaaaagaaagcggacttggcatcgcagagcgcggcggatggcaccgtgaggacgtcccggagcttgatcctgtcctcgtcgcgtgccgcgggcgcggcgttgtggtccgccgcagcctgcgccgcggcggcgacgcctccggggacggtgacggtgcgccccgtggcgagcatctcggcggcctggattgccgccgcgtcgctctggtccaccggcttacccgccgccgcggcggtcgcggccgccactccagagcgcggccgatcgtcacggcgtccttgtccagagagccggacggctgggtggccaccacccgcggcggggtggcgagccgcgccaccacctgcccggcgacggactcggtgacgacgcggcgcccggggagctcggtctcggcgacggcgacggcgacgccctcgtcggcgatggcgccggtgacctgcgcgcgcccgacgtgccccgcccgcgcgttgatcgccgcggcggactgcatggcggcggcgggcccgcccttctgcgcctcgccgagcacggcctcctcggccgactgcagcttcgcggcgtccctgggcgccacgggctgcccggccagctcgccggagacgtcgaacacgtcgccgtacatcaccggccgggccccgctgccgtcgggcggcggcctcctcggctgcccctggctcatgcttgcgtcaaaagaacacacgtgacgtggcacgttctcgtggcgcaagtgcgcgtcgtgcctcggcggcgaggtggcgcgcggcgcgacgagagtatttgtacgtgacaacgtgagggcgcggggcgagagaccgagagtacgtggcgtcgtggggggtttacaccagagcgcgccggtggcggtcgaaaggggtaaccagcgagagccgagagggtatgggtatggcagatgcggcgtgttttgattctagctggtagattcgagtgcttgagccacttcacggactgcatgcacagtgagcgttgtgctgctgcgttagctagctgaaagagatggagatgggtttttcatcttttgcctcgtcttttacataccgcttaaatagatatattttttaaaaaataattaatataacatatatcattttataaatatatattatttttgaaggaaaaaaatcttttttagaaggaacatttataaatatataatatcaaataatactgacgtacttttcttataattttagaagtttaatttgaagttgcatatatatgatagatatattttatattaatctttcttattattctttttaaaaaattgataactgtttaagataatactctaaccattttatattagaggtcaattattcaaagttctttagtttaaatcaaattcatagaaaaattagcaaaatttataacactgaatctcaataaatttaacattaaatatattttgataagttttaatcaaattcatagaaaaattagcaaaatttataacactaaatctcaataaatttatcattaaatatattttgataatatgtttgtattgtattaaaaatatttgtatatttttactataaacttgatcaaacataattaaagttaaagtttaatagtttgacaaagaaaagttataagatttataatatgaaaaggtgaagtatttagataatatatgtaaagaataaggaggtatccgtaagcataaaatgaggagatatcttaagggataaaaccactttcccattttctacgtgcaacgtgccatgaaacagattttttggaaggcgcgcgcgagacatgttcgcagcggattgggatcgggagcggtcgacacgacatgccaccaccgtgtgctgccatgccgagttcggcgctcccaaccgcctttgtttcgagcgtggcacgtcgtgccgatcggtcacactggtctcgctctcgcaacaggcaacatggctcgagtagccaagacgatttattagcagccctgtaattctccatttatttacgataaaaaagtctaataattcttgcgtgttagtaatacttgatcaaacgcatattattaattattttattggattcaagcactcgctaaattcgcttagcgttcggcaaaccgcgcgctaatacataatcaaacgcatgctaaattcgctagatttggtcgaactgctcggccagagcgggtgtacattcgtcggctgcccgtggctgcgcgctcctcttcgactggcactcggcgtcctcccggttgtgcttcgccgccgcggcgagcgccgcgctcacaccgtagggcctggtcccctcgccggggtccttctccacctccgctcccgccgccgccgccgcgtcctccgccgtcaccgcttctcccgtcggcagcatcgccgtcgcgttccactagaaacgaggcacagatgccatggccgagtgagatcatcaggtgcaaatagaaggcgcggcgggttgatcgatgctgcacgagacgtaccggaggacgtcgccgatggtgatcgccgtgtcctccgcgggcggcgcggcaccggcgttggcgtccgccgccgcctgcgcctgctcgggacgcccgccggggacgacgcccgcgcccgcgctcgcctcctcggagcttatcgccgccgcgtcggacccgcgcacgggctggtcgccgaccgccctggccgccgcctccagcgcctcgccgatcttgaccttgctgtcgtacgcgtcgtcgacctccacgacggggccgccgcagtgcgcggcctgccccgaggcgtccgccggggcgatgagccgccgctcggcgtcgccgtcgccgccatcaggctgtactacctgatgaccttggcattctcctcctcttggtcgtcgggcttgaacttgcgccatggctctcgccgcagcgcgcgccgtgcaatgccgcaagattttataccgtggtggtggcagccggcgtgacatggagaagaaggacacgtggaactacgcacgtgtcaggtcctggatgcgttggctgcgcaagctcggcacacgtgggagtgacggtaggagctaaggccgagagttattttgggttaggaaaggggtttcataaggttgcgatttgaaggccatgccctgggctaattcactcctatcttacatcttttaacttgaaggttgcaagtcttattattactcaccgtaatgtcgtatatactaaaactaaaaacatcgatgaggctgtagagaatatgtgtattggacatccacacggtttctatattcgactagagatagtaggtggaccggattcatatattatataatagagtagaactcagttgctcagttgttatgttgccttgtatgttaaggcaggtatagagctccgaccgagtactatcatataatagattaggaaactaatgttgtatccggctaggtttctcctttgtaattcttcccccagcctatataaaaggcaggctcctctgtaatccttcccccaacctatataagacgagctgggagagtccttcaagagcaagaacacatataaccacaattagatcgtcagatcaatactacacccagtagatacaatctccaaacaagagtagggtcttacgtacctcttattgagatggtctgaacctgtctaaatccatctaaatccttgtctccgcatctatttacttttaggtctcgtgtgctaccctctttcatcattgctgaattccaatttcgacggagccattgatacttcttgctatgacttatgggtagatttagagatagacaaaaactaagagatacatcatattagtgtgggataatcatataatgaaatgcgccgaatggatctttagttttgagtgtaacttcatcgcacttgtttatccttactatgaccaatatgctttttatgaaataatgttatgggaaatagatgttgctctattaaaaaaggattttatccaattaatcaaattctagtttattcattcctactagcatttactcacatgttgctctattaaaaaaggattttaatccgattaatcaaattctagtttattcattcctactagcatttactcac

SEQ ID NO: 32163 - DNA, 5093 bp, Oryza sativa
ttttaatagagcaacatctatttcccataacattatttcataaaaagcatattggtcatagtaaggataaacaagcacgatgacgttacacttaaaactaaatggtcatttcatttataccgctccatgcgaggatgacttggcatgctcacatggcacttttttgggtccaaggactatattaatccaaataattaatttagaggacttgtttggacgatttgaaacctcaaggactaaactgagcccgaagcgaacttcagggaccatattagttattcacaaaaaaaaaagacaatgacttcacttcatttacttgccgtattttcaatattgatcaattagcaaataatgcttgtgcaaccaccaaaataaaaaaaaatagacaataactccacttcatttacttgcagtattttcaatagtgatgaactagcaaataatgttggtgcaaccaccaaaacaaacaaaatagataataactccacttcatttacctgtagtgcattagtgcattcaatttgaaaataatgctatggcatccaaagaaagaaacaaatcacaaaataactccacatcatttaatacatatcaataataaaataatgccaacatatacaaagaaggaaacaaatcagtgaataactccacctcatttaatactattatatcaatatgatcacctaaaaaataatgcgagcacatccaaagatagaaacgaatcagacaataagtcataactccagttcatttactcgtctctatctctttctcgcgcgcacgccaaacaataatacgtaaggaagaagcaatcgttaaattgtcacaccgtttttaactatttaccgcttcgaatacatggactacaagggtcactcccaccatcggtttccaagagctcaggatcacatccacatagacatcgaacctcaaggctgcaaagcatccagcagccatagtccatacgaatatacgatcgatacggcccgtgagagtgaacaaaccaaagaaagaaagtggagggaaaacttcaaatccgcaccccaaacattcaaaaaccaaacaagttccacccctcttccaccggctctcctcgcgcttcgaaaacccacacgaaaaccatcggggtgacgctgacgctggtcaatgacccgtgggccccaccccgccagttaccaccgcgaaacccggctcgcgagactcgcgtgtcatccggcctccttcccccacacttcaccataccaacgccggaaactgacaagaggccgcagcacgcagcacgcagcacgcagcacaaaccccctccctctcccaccccaccccacccccaacccttctccgatttaaaagaaaagaaggtgagagagagagagggattaaaacccaaaccaaaccaaagccgagggcgagcactcgaggagccaagcctcttctctctctcgtttcgtctcgtactcttgcttccccctcaattccccccctcctcggacccccgcgtcgccgaattgggcgcctgattcggcgtccccccgccgcgccgcggccggatcgaggcgccggagggtgccgctccggtttgctcctggggtggcggttgtggggggtgtgaaggagcggaggtggggggtggagtggaggggggaggctgcctgggggccgttgccgtggcgagggggtaggggtgctcggccgcgcgatctgctgatccgggacatgcgtgaggcgggagtgttgtagcaagagccattccgctggattttgtatatttttgaggggggtgagttgctcgtctctgattttgttttccccttttttggaatcgttgttctgctcggtggtataatctattctgagttcatcacccgctcgggtttcctttttagtggaggaggttgttaattttggccatttcatgtgctttatgttgcattgccctaagtttcttgattaggcatgtccaaatccaaagtagggtttagggtggatcatgctgttcgaatctaagtttagatttacatttttatgagaaattgatgacaacaagttaagattttgatgagtttctggtcatgcacagggtgttggaattggaatgggccataacggttctaagcggagtccggtgcctgagaccaaagacggagcgatgaaggatttggagaagtctacctccttggaggtggacgactctaccattgatggtgatgtggatcttggtggagggctcactgtggtggggaggaagaggaaagatggaaggggttccgtggatgagaatggggcctcgacaaagaggattttgaggtccaactccatgaaaatgcatgtggatgctgagacagcggggggtgtggctttggatgtttgcaagggtgacattttggagaagaaacagtgtgatatcatagcagagggtgatagaggaggggtgctgacagttgatacttgcaatgctgaggaagatggggaagtgactggtgcggtagtgagcgatgctgtggttgaggcagttaggtgttccgcaaataatgtggaaagtttgggtcttgctgaggttgaaattgctgaagggaatgggttggacgctgacattcaggaatctgatggtgagatggataaggcagatgacaaactgtctacaccttctgaggagcagaatgaatctggaggtggaacaagtgttgggggcatcaatgactcccaggaaaacaagggggttaatgggctttgccagggagaggtcatagacccattggctacagcaaatggagatgaattgagcatgggtttaagcagaagcgcaagtggacgagaatctattgagcaagaggataccgttatgtgcgctagtgatgatcagaaagttgagaaccattgccagtttgacgataagcataaagaagctgaaatttctcagattgagctcgcagttgataaccacattatgctaactgattgcactaaccaaaagaaggggatcgacagtcctgtgaatgaaaccaagggggattcaactcctgacattgtttttataaggagaaaatcaataactagaaaaacatgtgaagcgaagcaggtgaaatctgaagatgaggttcgatttgagaagcgagttacaaggtctgctactgttagacagagagaggtttctgctagcatgtgcgtaggtgctacaaacgatgctaacttggaaagcaaagaaaggaaggaagatgttcatcattatacaaggaaagtgggcagcaccgtgcgctcaaaagttcatcacacaggggtggcagaatgcgacactgatacaaagaagaaactaaaaggaactgttaccactcgaagaaactcagatgccattgctaatgatgatcctccaagtatcacgcagaacaaggaatcaaaaactcagatgaagatcgatatcaagtctcaaccactcacaagaaggggcagcatagtaaataaaacagaagacgcagtttctgggttagaccagaatatctgtagttcagccatcactgataaaaatgatatagagctcacagattctgaaggagttaaatctgagaacaaggccgctgtgaggaagtcaatattatcagttggcgctaagattgttgccagtaagaagaggatattggaatcaggacttgataagctagtggagagtcaccagttgcaataccatccctaaagaaggcaagagatacatcctcagacactgagctagagcaaccaaaaatgtcttctggaaagaaacttaccagaaataactgtggctcaagtaagaaaggtatgtcgacaagacggcaacatcagagtcaaacagctaagttgagtacatctgtgaattgctccaataaaaacgaatctaagctatcacagaatgaatccgatgatgatggaactggcagtgatacttccttgaagaacacttgtgtaagacgtactcgaagtggtggtgttgtccccaaaaaacaagaggattctagtgaatctgaggaaccgatcatactgagaaaaaatcatcaaagaggaaaatattctgggaaaagggctggatctacaccaaggaaagttaaagctcccaaaggcaatagaaaggaagtcaaggcttccagtttgaaatcttcgggtccaagtgagcagataaatacaggaagtcttcgtgaagaaaaacaaaaaataagtgatcatatcaagggcatgcttctagatgctggttggacgattgatctgagacccaggaatggcagaaattacttggattctgtgtatatacctcctagtggtaaaggatcttactggtctgtcacaaaagcttatgctgtgttccttgaaggtatggaatctgagaagaagggcagagctaaagatcagcgaccctcaagaaatctgtaggtagccctgggaaaagtcatgtttcagaggaaatccttagcaaattaaaaagaatagtcgttaataaacgaagaaccaaagtagaacttcagaagttgaaaaagaggaaacatggtttactgaaaaagcagaaaacttccaagcgcaactcaaggggttccaaaaataaaatttcaaattctagaaagttgcatttaggcagcgaaagaaaaaagcgaggtggttgtgctctacttgctcgtggatcaaataaggatggtggaagcagcactaacggttttgttccatatgaatggaaacgtacagttttatcctggttgattgatcttgatattattgatatcaatgcaaaactgaaatgtgtggatgaaacccactcaaaagttttactggaaggtgtaaccactagggatggaattaactgcagatgctgcagcaaggtctttacagtacttgaatttgtggctcacgctggcgggccagtcagcaaaccttatagaaatgttcttgtagatgggctggacactgaccttttgcattgtctcattaatgcatgggataagcagtctgattctgaaaggcaggcctttttccctattagcactgagactgatgaccccaatgatgacacatgtggtatttgtggtgatggaggcaatttgatctgctgtgatggatgtccctcaacatcccacatgagt

SEQ ID NO: 32164 - DNA, 19030 bp, Oryza sativa
gcctgataacgtgatctccaatttctttttgcactaaggcttgataatttgatgcaatgttttctaatggatataaacctcttattttcaggctcttccatctgatgattggcgttgtgctaagtgctcctgtaaattttgtcaggaacattcaaggcaggatgctcaagacattgctgaggttgactcttcactctgtacttgttcccagtgcgaagaaaaatgtatgtaatctctgcttgtactcccttttatagcgtgtcagtactttagatacatgcacaatttgtttagctattgattaacttcactgaaatatcgtgattgccaatcatttgtttttttgacacaatgtttttgatttcttcacaatgattatgtctgtagatcacccaggttgctctcctgagactactaacacatccaatgtctccagtcaggcatgcgatttattctgccaacaaagttgcagactggtaatactaataaaaaaattgttccttttcattcctagtttcgccgagcatgatttcagaactggttgttgtagtttcagctaagttagggtaggctagatatgaaatccaagtcaaaccacacgaaccaaaagattgaacttaaaagtaaggtgccaaaaaataataagaacaaaactcacctgttaaatatctgcagtgcattagggtttatgctgccacctttattcgtcagttttattgtttccttttgtgtccaagtagctctacttgataagcaactgacattgtgtaaagcaatatagatatgtaatttcaccaaaatcattaacatttaattctcctttagttttttttctgtatcttaatattcctacatggtgtctgtttactatttgaagtacacgggtcgttatttgttatgaatttctgtaccaagtgatgttttaggatggtgtgctactgaacttattagttttcaattagatttctgggcggcaatgatatctatggaactgtcaacagtgctctcatgcagtcattaagatatatctatagtttattttcctgtgatattcattataggggaaaggtaatgcactttggatgatgagggtaactaaaaagaatcatattttacaatgaagtgactataaataatatgtttactataatgcatggaaccaattcttttttgtatccctttagtatgcttttttgccatttaaatctaatcacataacacatattaagttactgtgttcatcttgtatttgaactcgtttagtgacacgtgataactttgtctttttattatcctactggtaaaatattatgaacttatatcccctccctcaaacctcactccacccatggagttactaagagtgatttacaggatctgaaatgacatttatgtgatgcagctgtttgagggattgcgtaatcttcttgctgtgaagaaggatcttgaaccagaattttcatgcagaattattcagcgtattcatgaaaatgtaccagaaacagttgttgctttggatgagagggttgagtgtaactccaagattgcagttgctctttcgttaatggatgagtgctttcttccgattgttgaccaaagaactggcatcaacttgatacgtaatgttgtgtacaactgtgggtatgcaccactctttctacactgctcacattactccatgcaattttgaggttatcttgtgaaacctctgtgatgttgatattgttttctctttgtaactctttgcgcgcacttcccctcatttcttcctctctgcttttggtgagtgggtctatggtgggagtttatcttacattattgctatagattcaatctggtgacggcaccagcatatgatactacgaatgggataatttaggctgatttgctagaacatctgcaaattcatttagaactgagtgcatttgcaagtaaccatgctgactatgtatgcaattagtgcacatatcaccaccagtgcttatatgacactgttcactgttgtcctgcaaatttctgaagataattttgtgtcgatctagttcactgcatgactctttaatgagccttttggcgatcctgagttttggatctggtgtatgcatcagctcaatgtgggaattttgagcttttggcatatttcctaatataatagtatgctactgtagccaagtaaaagtttatggaagccttaacattgtttcctccatcttcaatgcatgatatggtataatcaaatgttttttaactcaagagtggtagatgagtattcaatcactgtatatatgcttatgtggattgtggccttatgtgagatttaactaatcaaaataaacatatttatgcatctaaaggtgtatatgctaaatctaaactatatatgaccaaaacaacagaaaagtccctacccactgaagcatcagctatatgtgctccatataaaaaaggtatccaaatgaaaccatgtgattaatgctagtaaggaaaataaatccgtagtagctcacggtgagtgttttttatgattgacctgtggatctaccagctattgctagttttaactgaacacgtatgtgatactgcgacttgtttggtttctgtttagtatacactgtatcaaccttctagttcacgttttgctgatttactggactacgttattaattttatgatttttagttgacatcggatgaagtggccatgatatatttaatagttgcagaatttcttctggtttgacaagttgaaatggaaattttattccttgaaggatatttgattgccatcctgtttttgcctatgtgtaggtcaaattttgttcggatggacttccatgggttttatatctttgtttggaacgtggagatgaaataatagccgcagcatcggtcaggtgagttgccttcctcttgccctttttggatgctttgtcctgtgtatatatttcatctagattgaactctgtgctattcaaaaataacatagatgcatgccatcactagttctccgcatatactgatcatggtctagtgcatagctgagttgttttgtttcagttgcaaggttgcaagtactgcaagtgctttgattgcagtgcacacgcactaattgcaatcaattgtatacagtcattgtgccttttctttgcctgaactctctaatgaaataggcttgctatggttacttttatgtatgtttttcccaatgaatcactgggcactaataagattttctatttggtctcttatcctgaaacagaatacatggaaccaagttagcagagatgccattcattggtactcggaatatgtatcggcgtcaagggatgtgccgcagactgctagatggaattgaaatggtatattgatctgagcccaaatctaggcatgattcatggtgattatataggacaactgtttattgcagaaatcctatttgcattgtgtctagtttcaagacattgaggcactgctcaaaacctgacttcttaatttatgcaacgtttttgtcgctagctgaaatatgtgacaaaagtaggaacaataacagactctagcttgtaaattgtagtgctctgatgtggttctgactacttcaggcatgctataattggtctttacaaaatagcatcttagatagtatttttctatatggtataatttgtaatacatatgtcggatgatacattggcctttgtattacatctctgaagagaataagtaaactagcttgcctgtctgcgtacctcattgataatagtttatatatgggcttacttcattttgcttgtttgagcatttgttatgtactgtgtgtactaacgtattctgatatttacacttcagatcctcagctccctcaatgttgagaagttgataattccagctatcgctgaacttgtggacacctggacatctaaatttggatttagttcacttgatgtttctgaaaagcaagaagtcaagtctaccagcatgttagtttttcctggaacaggtcttcttcaaaagccattgctaaagaaaacttcacctggggaaaattcaagctctcaagaaggtcagcacataaaatttaaccctcatatatcaatgagttattctcctcccccttttatttaatggtgaatggccatttgtgcagttgatggtgttttctctgagctcgagtctgggaaaacttccaatgtggccaatgaagactctctttgttctgcaaatgctgagactcaaggttcggctgccccatgttatggggacaacagcaaagatgctagtgcttgcaatggtaatgtttcacaataatccatgtaatgttactccatgttctcttttccttttcatggcatgacccataaattgaaaactcagaatacccacttgttttgcaaaacatgtcatgacatcttctacaaatctttgaagaacttgaaccgacatactgggtttcttgttgtttgagaagataggaatgcattacatgattgattaatgacatgaacaataggctacaaacttatgttagtggttcttagagaacaacgcatacatttgaattctatgatttcaatatcgttatgtttgtctaactattttgaatatcttttgcagattgacatgcttcctttgcattattttgtccctgtcaaaaggtgcaccctggtagtttcaagcattgacagatactattgaggacatgaagcacaccgatccttcattgttactattattctcttttgactcggcatgcggttcgtcggttggcagaagtagcctggatagagagggcgagtttttgaagatcccttgcagagcagcagcacctcggttctgctcaatattgatgattcaattgactctttggtttcggtttgacttgaaaccagcctgtgcagtgttggactccgatcacctaactttaagtggtttacctttacctgtaaagtcagcatgtagaactgagatgatagttttattccgtgttttttttttctggatggttaacttagtaccaaaggccaacgtgtgccgcaaaatcttcgtacatgtttctttacctgctatgtgacagtagctttgtttttgctagcccatttttttgcagccagatctcatctgtaagacactaatgcatgggcaagcagaaaaaaaatctcagatatgccacctgttctcatgttggaagtaaatctgataatgttatggcatctatcctcgtgttcatgcagatgcaaggtgcttttgttcgctgaatcgaactactgatcaggtgagatgtggtcaaagatcgcaaggttataatcactctggaaagcatttacttgtaatcatatgttctatctgctcttttctgtctttgccaatgatcttttcgcaggcaaagtgaaggctggctacaatgcaattatcactcgttgattgttggcagatagtactttttttttctgacagaagaaaataaatctctacagaaaggcgtctgcagtgttgaggttggcgaggatcttgtccttgacatctttgggcagcgaggcgaatggccctgccttggagtagaactccgccagtgatctgatggccttctccagcgcaacgtatgactcctggatgagcaggcaaacaattttgttaacaaatcgtcaagtaagcaacccagttatgttctgatgtttgcaaaattgcaactaaaaaaatcatgccatctcctgttccccaggtgagtgaacttgagttcaaacttgctttgaatttttttcatgatcgtttacttgtgtgttaattttcatatttattttaatttgatcggtgtaactcacttcaagcctcctttgaaatatacttctccgtcctgattcagggttcaaaatttgtcgccaaatgtaaggggttttggacggaggtagtttgaattttggaggattttcattagaattaaactatggagctagaagataaatcatgggctatatgtgtatccataaaatactacgggtaagtaacgataagcaaatggacgtaggtgaggattcagccttccctactgacaataaaaccattaaaaccatgagagtttcctagagctcttattaatttctttttttgaagtgagagctatagctttgtctatatttcttcctagatccatcacttcctgggtgtgtgaatgtggttagcagcgttgcaaaaatagggggaaaattggcattattacagccgaatgataacgctgagatgcgcgaaccaaacctcagcagcgacggcttgctggcctcgccagccgccgaggaactcccggatggactccttggcggcgtcggcgcctcgccggaacttggccacgtcgccgccgtcgtcctcccccagcgactcccggagcgtccgcaccacctccctcgccgccttcaggtacgccttgggcaacaccttccccgacttggtcctctcgttcgggtcaaatatcgatttgatcgccccgaccaccccctccccctcgccgccgccgccttcctccgtcgccctggcgcgccccgccgtgccggagcccacgacgacgatggcggcggccagcagcgccctcctcgtcgtcaccgccagccgcgctccgcctgcactgtttgcgacacacacaatcacgcaggaatcagagttaagctgtggattaaccgcgagagacgaaaatcgaaggcggcggcgataagttacggatgtgctgctgctgctgctgcttgctctcggcgtctctccgctgcttcggcgacggcgaaggcggcgacgaacagcagtagcaccggctggccatcagcgacatggggccatgaggaggaggagacggcattgcacgcatgcgatgctactccggctgcgacatgcacgcgaggggcgatcggtggtggtggccgagatgggagaggtgggcgaggagagattggtggtgagctcgagcacgagcacagccaccttatctcatatctgcaagtagcttcagggaggaggagcaggagggaggcgatgcgagttggagagacttgggagtttggcgcgagaagacgacccggcccgcgagggatttccctcgcaaattgagtgggcttttctttggaggcccagaatttgttggaaatgggacgacgcagcaaattctcactagccagaaaatatgcaaaatctgctactccaaagaagtattatcctaacatgaaaaattcccttattttgtgtgtgtcggtgagaagtttgaagtttgaacgcagggaattcaaggagattcgacaaaatctgccattggaccaacataaagatatgtgctttcttccaggtcttaaatctgcagcctctctcttgttttctcccccccccctccccctctccatcgatccgccattacctggcttggacagatagtcatagagcgatacttctagtagttttttttaatcctccctaaccacttcgatgtatgagtaaactccgtacaacagatcacgactttgtaatccccaatggtgatgggatgatgtcattgcttacatttgcacgagctaccaaccaaccagcactatctgcgtgtgctctgagctcttttgtgttgtttctgcagtctgcaacgaggtccacttgagcatcagaattcagaacggatgaccccctgtttgccgcacacagaaagaacgcacggctcgatcgagcagagcccttcctctccaccgggcaattttctgcgagattttcgaaggttcttcgcaatattttttatagctaaacacgagaatacgatatcacagctgggttaggaagcagttgagagaactgaatgttttctcatgtttcataaattaggcttcgattattttttaaacctttgacctactgttacaagtaacaatataatcaagctgtcaacgaatagcgaagtgagcgtagctcagtcgattaggtttcttatggtggaatcagttcacccgtatttaaattctagatttgagacgagtgcttacatatacagctatttatttttccagcgatagatggcgtacctataaacaacgagacgtccatagtgacttcatcaatctcatgatatgctggcctaatcttccaaatatgctcattattgtcgataacgaggcatctgtgatgatttcgtcaatctcaagatatgccagcccaatttttcgaaagtgctcattgtggacatctttgtttgtaccgtgtttctaaacaaaattgcaacaaaccttacgggatttgggaggaggtgggttccgtcaaatgtacacgtaccgggttaactgttagtggggattgtctgcaatattgcacttgtagggatccaacatgtcagtggcagctactgtaagtgcagcactgcagataattcacgtccgttatctgcacatcatacatgcaaatgctgttttagaaaagaatagtttttctctgtttatctggaaactgaacaaatttatgcaaattcctatggaatcttgagtgcctgttcactttgatgccatttgtcaacgtttgatgtcgcgattccggtatttgcatggtatggggatcgttggtcctaggatatatgcgagacttaggtaaaagagacggagacaaggatttttatacaggttcgggcccctgaattgttaggtaataatcctacatcctgttggccgaagccggtgttgctctttattcatctagatcacacaagtacaatatttggggtagcctatcaaactgttgtcgacatggcgatctgaagttctgactcatagtcgacaacagggtagccttccttctcgaatccatatccggcgagatcagagacagcgctatatctctcctgacgatattcgtaggcaccgtaggggactagccatgtctatctctgaagtcgatatccggcgtcttgtcttggcgtatgttggcttatatgttgatcttgtgtcttaacctattgttccgtgtcccctctcctcctagggggccttgtatttatacccatagttgtccccttatccgagtagaactagggaaaccaatatggatataatccgagtagtccttgtcgtttttatgtagaaccctattcatcattccttatgcggaactcctcctatatccgaagtttgtttccgtataggacatgatatgtggtaggtcctgtcgagatttagtcaactactattaggtatatggtatccataaccctgacatcatttttaaccatacctttttttttgtaaagttgccaaaattttggctacgtttagtttattgccaattttaataagtacatataaaatcttgccaaaattttggcaactctaccaaaatttgacaatgccaaaacttggtatggtttaaaatggtaacaaagtgaaccatccctgaatatcgtcttaacctcttttaacatttgtttaaagaaataatagtatgacctgcgagtaccgtgacatatatacaaaaatattttctgagcgagaggagatacagggactagtgacaacaactgacaactgacaagtggagcagcactacataaaaagggcaggaggggatgatgcgggcgctacaaagtgcttcacatctttgcctcgttcgtcctccggttttctccgcagtttcttgatccatccgcctttcctctcgcagccgtcggcggggggagtggtaagttggttactggttagtactccatcggtaaaaaaatccctccttttcatatctttttttcgcttccaatcttgcgcaattcgggacctttcctgccatttcgttctgtccaaattcagaacattgatacggttgtttggttgttttctcccccttttctgtgtctgtacactgctgttcgtcggttgattcttgtgtgagttgtgaattttggcaattgaagaataagaccttgatgtgtttgcacgcctatgctgttgttatccgtgtccatgcgagtgaaatgatccgctgaatttttgggtagatctgaacttggtaccttgaatccagtagcatttggtgatcggcgcggggattagggtttaccgttcagaggggacgcggatatttaccgttgtgctccaaaatttcactgattgttttgggctcaccaaccttttgctttcttgcaggcttgcagagttttcagagagatttaggcaatggcggaatcaggccaatcgattgcgagtgatgtgactgcagtatgtagacaaaattcgccctttttatgcttgggactagctgaattgtgctttaattcgcctttagtgatgctgattttctttggtgctcgttttgggatgtcagctgatcggcaatactcccctggtgtacctgaacaaggtggtggatggatgtgaggcccaaatcgctgccaagcttgagatcatggagccctgctccagtgtcaaggataggtatctaaagtaccccagtctgtccctcctgctgatagttttgcgctttacttatttttattctggtggccatggtttgcaggattggttatagcatgattacagatgcagaagagaagggtctcattactccaggaaaggtgagacactgagacctgaaagtataaatcaactctcagattagaatatgatggagtcactttgcttatttgtgactaagaactcctaccaataaaatctactccctctagtcaaacatatttgattggagagagtagcgtaccattagaagattaatgtctcagacttctcatttaaggaaaataagatgttttggtctcaccatccctcgtctagattcactaacatccatatgaatttgaacatatatataaagctcatacataaatctattcaaaacctaaaacatcttataatatgaaacagaggaatggtgatgtcatggttggtaaattaatacaagcgtgcgtgtgtatctgaccttttattttttactggaatacatctgactgtattgtctgatcgatcctccctttcttatagagtgttttgattgagcctactagtggaaatactggtattggccttgctttcatggctgctgccaagggttataagctaatcctgacaatgccagcatccatgagcatggaaaggaggatcattcttaaggccttcggtgccgagttggtccttaccgatccacttctgggcatgaaaggtgcaatccagaaggcagatgagctggcagcaaagatgcctaactcttacattctccagcagtttgagaaccctgcaaacccaaaggtgctaaattgctaatatattattatccttgctagaaaagcacaatagtttaattactgttttgttttactggactatgctcagatccactatgagacaactggacctgagatttggaaggccactgctgggaaagttgatatccttgtctctggcattggaaccggtggtacagtaaccggaacaggaaagtacctcaaggagcagaaccctgagatcaaggtaacttatatactccctccgtcccataatataagggattttaagtttttgcttgcacggtttgaccattcgtcttattcaaaaaattttagaattattatttattttctttgtgacttactttattatccaaagtactttaagcataatttttcgttttttatatttgcacaaaatttttgaataaaacgagtggtcaaacattgtaagcaaaaactcaaaatcccttatattatgggacggagggagtacttgtttgcatgtttttatggttttgtgtatatgtgatggtgacttaactgtgtactaattttgtcttaaagatctatggtgttgaaccgacagaaagtgcaattttatctggaggaagacctggtaagatactgctctttgtatagctcaacttgcataaatcacattagtaatactagtactatttgtgatgcataactatggatgtcaaaaattatttgaaacatagggtgcacagtatggatggttcacgtatttgatgtaataatttagctgtctcgattctgttgaaccatcatgacattatcactgttccatgtttttggtttcaggtccacacaaaatccaaggtataggtgctggttttgttcctggtgtacttgatgtcaatctcctggatgaagtggtccaagtaagcaaatccaaattttctgttccaggccactaatcaaatgaaaaagatcttgtattgtttctatttttctgtaaacaatggcaatgcagtatgtgctgctaaacctgccacaaggcctgcatataaaaactctcttataaccacgtctctgtcgaatgtccagttccagttcacctgatgaaccgtttgctaaccccaacgttagaattcaattgttgatccacagatccagacatgcgcacggttatgtatatagaaacaaatgtacggaatgcaattactaaattgatctgaacatttcttgcaattctactctggtaggtctcaagtgatgaagccatcagcatggcgaagcagctagcgttgaaagaagggctgctggtgagctcagtaccccttaagaatccacccaactcttctccacctattgctgcacatatagcctatggtttaattccatgacaaatatttttcaggttgggatctcatctggtgctgctgcagtcgctgccatcagggtcgcgcagcggcccgagaacaaagggaagctcgtagttgtaggttccctcctcagaaccctgttttgccaggcatttcttaaaccgttcatgatctccattgttttgcaacctacaaaaacctcttagattctctgctctaacatgtccatcgccgtcatttgtgctcgcaggtggtcttcccgagcttcggtgagcgctacctgtcgtctgtcctcttcgaatcgatcaagagggaggccgaaaacatggtgttcgagccatgaacggctccagcattgtgcaaattgtgcttccatggtttagggggcttggagagaatggcgtcccgagtgcatttcttcatgttggtcgcacttgccatcatgtagtcgcttgatctgaataaagaacttacatacatcaatcaaagtctggggattcgatcagctttcctggtgttatatgagcagttcatatgtgtactttcttccatactgaaatgtgtatcttagctactgaagcttccatggattgctgggctgctcgagtgacaagaacacgcataaattaattcggcccgctcatagattcagcccacgcgagcgcggtcgtactacgaagctactctagtttattttcttgagcgagggtagctagcttcttctagtttattttctagaagaaactcgactatttttaggagtttttgattctgaaagaagctgtaatcactaaaagtttccttaaacatgtccctggtcatgcttggcaacagtttaatagtaataataaccaaatcaattctgaattttaaaatttggatttttgacctgttgagttgacagtatcttttcccggcgatttctgacctgaaagtctcaatcagacagctttcgaaaaggaaaaaagaaattccaaatcacacatggtttggtttcttcactggcacagagaaaataaataaaaaagataaaaaagtttttatttaggtggcggtagcaatccccgggcttcttttctcccaccgaaagggagctcgaaccagctcacacccccgcgaccgccaccccactccttcgcaccatcaccacaccaccctgtatattcctcctcttcttcttccttcgctttctccctttccagttgttcgcttcgcgtgcgcattcgcagctaccagtttggtttgcggcgccaagaattggtggctatagccttgccttttcttttcttttcttttcttttttgcatgtttgggcggcggcgatcgagctgagtcgatcggccggagtggatcgacgacggaaatggtcagccgctagcgttgtagtagtagcaagctactagctctgttcatcgagttgcagggcttgcgatcgtgttgtgttgggttgggtcttgggtttggtggtttgaatttggtgtggcgtttttcttgggcaggggacgccggtgaacatcatcgtcgggtcgcatgtctgggcggaggatcccgacgacgcgtggatcgacggggaggtcgtcgagatcaggggcggcgacgccaccatcgtcagcaccgatggcaaaacggtcggtcgcttgcttccctgccactgagctagctgatcattctttcgttgtccccggttcttgatatgatcaagaaccccgagtattgcagagctcgaagcgaactgttctgattttctgaattcgtattttgctgttgaaccgtgcgcgctaggtgtttgtagaattgcctgaatggaactgctactgaagcagcagctgttgcttttttgtgggcagattgtggcgagcctcgcaagcatttaccccaaggatacggaagcgccacctgcaggagttgacgacatgacgaagctggcttacctccatgaacctggagtcttgcataacctcgcttgtcggtacggtattaacgagatatatgtgagtgtttaccattcagaattctccatcttgatatttagtacttcgttcaggaccatttgggcttagccatctttccttttaccatgaaaatatatcgaacagacatacaccggcaatatcttgattgcagtcaaccctttccggaggctgcctcatctgtatgacgtgcacatgatggagcagtacaaaggtgctgcatttggggagctcagccctcatctgtttgcgatcgcagatgcttgttacaggtgtgttctgtactcctgttcacgcctttggtaatctatggaccgtgtcagtctcgaattgtgagtttgtgactgatgttcttttcttcattgtgatgctatcaaactcagggcaatgatcaatgaacaagggagccaatcgatattggtgagcggtgagagtggtgctggtaagacagagacgaccaagatgctcatgaggtatcttgcattcatgggaggaaggtctggaacagagggtcggactgttgaacagcaggttttagaggtacaaagaactccccatttctcaccatcttatttgttttcactatcttttttagaacatctccattcactctattgatttctctgcaatgcatatagtctaatccagtactggaagcatttggaaatgcgaagacggtgaagaacaacaactcgaggtgtagatttgaatcagcaactacaaccatgatatggcaattgatattttgtaatttccaaatttgatatgttgaatttttcagtcgattcggtaagtttgttgaaatccaattcgacaaatatgggaagatatccggggctgctgttcgaacgtacctccttgaaagatcgcgagtatgtcaggtctctgatcctgaaaggaactaccattgcttttacatgctatgttctgcaccaccagaggtaattctctagaaacacttaaataccacttccatcatctgcatgctcagagtgccatagtactgattacttctgaatgttgaactgatttcaggatgtgaaaaagtttaaggtgggagacccaagatcattccattatttgaaccaaacaaactgctatgaagtagctaatgtggatgacgcaagagaatacctagaaacaagaaatgctatggatgttgttggcattggtcaagaagagcaggtatacttcatagagtttttttttaaaaaaaggtccttgcatagactagtaagtactaaataagttgcggatgctataattgattcatcctttttacttctcaaggatgcaatctttagagtagtagctgcaatccttcatctgggaaacatcaatttctcgaaggggcaagaaattgattcatcgaagctgagggatgagaaatcagtctatcacctgaaaatagtagcagaacttctaatgtatgtataaattcttcccatggtttataatctatcatctgcaaatatatatttctgctgtaatcaagtgtaaaatatattttaggtgtgatgaaaaggctcttcaagattcgctttgtgagcgtgttattgtaacacctgatggaaatatcacaaagccacttgatccagattctgcagcactgagtcgtgacgccttagcaaagactgtgtattcacgactgtttgactggtaagaatgaaggtatatcatattcatcagtggacagtgatcaaatagcaagtgctattactcttactgcctggtacgtctagatctgaatgtgacaaaggaacttctttctgagctaacaggattgtggacaagattaacaactcaatcggtcaagatccagatgcaactaatattataggagtacttgatatatatggatttgagagtttcaagattaacaggtttgccagcagactagtttcaattatgcaagtgtgctattggttttgtttcttaatacctgaaacacaaatcatactatacttatctggcagcttcgaacaactatgtatcaacttgacaaacgagaagttgcagcagcactttaaccaggttagcgagacctttagattactactcctccgtcccctaatataaggggttttgacattttacttgcactgtttgaccactcgtcctattcaaaaaatttgtgcaaatataaaaaacgaaaaattgtgcttaaagtactttgggtaataaagtaagtcacaaataaaataaatttttaaataagatgaatggtcaaacagtgcaaacaaaagtccaaaaaatttttaaataagacgaatggtcaaacagtccaagcaaaatgtcaaaatcccttatattaggggacgaagggagtagatattaagaaaaaaaatattgcagaatatttatgactaataaggagactggtgaattcctgttacagcatgtattcaagatggagcaagaagactatacaagggaggaaatagattggagctatgtggaatttgtggacaatcaagatgtgctggacttaattgagaaagtgagttcctgaagcatttcacaagtgataattgtatctattgatgaataacacctgccaattccatgcagaaacctggaggaataattgcactactggatgaagcatggtatgaatagtcatctttccagaagaaaaaagtatttttatcaagaaactctgcatgtgcatgctgacacctgcaacagttaaaaatattacttcttatgttttgtccataaaaaaacattggggtagtttttcctagcaaaaaaaacattcagtagcatcaaatgcaagtttccatgtgttaccctatgacatgtgcctaactgcctatccatgcagcatgtttccaaagtccacacatgaaacatttgcccaaaagatgtatcaaacatacaaggcacataagcgcttcagcaaacccaaacttgctcggacagcctttacaatcaaccactatgcaggagatgtaagtgataatcagcgaaatgtgatatatcgtgtttagatttaccatcaaggattttgaacaattgttctagtaaacaggtcacatatcaagctgatcagtttcttgacaagaacaaagactatgtggtggcagaacatcaggctctacttaattcctcaaggtgcccttttgttgcaaatctctttcctccattacctgaggaaacctctaaacagtccaaattctcttccatcggtactcgctttaaggtgtgtcatgattgtagccagaggcttagagttatatgaattagccttggaattttctgtaacccttcattttgctacaatatgtgcagcaacaactacaagctctcatggaaacactgagtacgacagaaccacactacattagatgtgtgaaacccaatgctgtacttaaaccaggaatctttgagaatttcaatgtccttaaccaattgagatgcggggtatgatgtgcattttgctccacattgttattcagaagccttgtttttttttgtgttattttactttctataaaagctggaccgtgaaggtcttttgtctaaaaaatgttaaaaatggttaatgctgcagggtgttctggaagcaatccggatcagttgtgctggctatccaacaaaaaggacatttgatgagttcattgatcggtttggaatgcttgcagcagagcttgtcgacaggtatggatactgatgttatgcaaccagattaggggattgagacatgtgaaaaacactcttaactgaaatatgtccatcaaatgttctcttattcttctaaatggataatacagtgactctaatgcttgtacagctctgatgagaaggctgcctgtgcagcaatatgtgataaaatgggtttgaagggatatcaggtaatctttgtgagaggtgaaaatggaatatatagcaacaattcacagaatatatatttgcaactcattgcatgcaaccttttgttttgatcagataggaaaaacaaaggtattcctaagagctggtcagatggcagagctggatgctcgaagagcagaagtattggccaatgctgcacggcttatccagagacgtataaagacacatcttacaagaaaggaattcatcaacttaagaaaagcctcaattcagtctcagaagttttggaggggtatttcttcactgatgtgcctttagtaattcatatcttccgtattagtaataagttctgacttggcattgacatacaatgtaattcaacactgcagcacgcctagctagaatatttttcgagcatatgagaagaaatgctgcttcaatcaggatacagaagcatgcacgtactcattcagccaggaaatcttaccttcaaatgtatgagtcagccatagtaatacagacaggattacgtgcaatggcggcttgcaatgaacacagattcagacgagagaccaaagcttccataataatccaggtttgtagtattattaatttattatgatggcactgaattaactttcatgaaaa

SEQ ID NO: 32165 - DNA, 12535 bp, Oryza sativa
tgcagatgacgataaatcaaagcaaatagagaggtaatttttgaaatgtttgcactgcaattcttatccactttgtttttgaaagcctcataacttaacataacaaactcttcttctagtctggaaagcaagattgccatcttggagtcagaaaaccagttgctccgcagtaaatcttctgtagctgttcaagcagtaattactcctgaagtgattcagccatcagcaatggaggtataatcctgtcagtttaacattaataaaacacatctcttatctgataagatggatgatatttctgaagtatagtacacagttgcactaaattttctatcaaaaatctcaccagggccttgtgaatcgatatcagcttgaagaacataaaatcctcattgtacgtgtttttatagctctctattacccaacatgagagcaaaaaaaaaacctcagttggacattttatttatatggatttatatatttgctttgtttttttttcaggaggaggtggttgttcctcctataaagaatttaagcaaacaaaagtcgctcacggatcgacaacaagtatgtttcagtgccttcaaaatttttttatatcaatgcaagaaacaagttccacgttcttagttaacaggcattgtgcacattcaaaataatttttttctcgatttggttttcctgctctttcacaggaaaatcatgatgtcctgatcaaaagtctggctgaagacaggagatttgacaacggcagaccagctgcagcatgcatcgtgtacaaatcactcctgcactggcactcatttgaagcagaaagactaacatatttgaccgaatcatccatacaattaggtcatcaattgaggttgttacttccaaaatactatataaaactttccgtttgcagtgacattatatagttggtgagcaagctctcatgaaactcattatctgagtatttacagcacgctgaaagttctacagaactggcttattggctgtcgactacatcaactcttctctacctattacaaaatactcttaagtctagcagttcagcaggtaaaggatcaaatcgcagccgaaccacaacaggcaacctgttcagtaggatggtgcaggcaagttctttatccatactcatgctttgcgtaaagcaaggttctttattggcattgcaagtcgaagttttcaacatactttcgtactgattaaccaattacttatatatacaccacatcaacgaccaaagtgatattcacaacataaaaatgagcttacatcccaaaaattgcgtgtcagaatgctcgatcgtcgtcattaggatcaggcatatcaagtggatatagtggaatggttggaaggcctgacactgcatcaaaggtagaggcaaaatactcagcactacgtttcaaacagcaattaacagcatatgtcgagaagatatatggaatgatcagagataacctgaagaaggaaataaacccgttcttgattatgtgcatacaggtatgcaccccagacatttccatgccaatcgtgaatataaggcgatacaatttcgtaacaatttgtcaatttcacaggctccaagggctgttcgtgtgagatcatccaggggatcgttgaaaagtgtacattctaattcactatcaggcaaacatcaagtgtgcattggcaaagcatcattaagtgcctgaaccatacactcgaaacaatgaacaataatcacgtgagtatggcaataattgttttcagttgtcccatgatcagggagttttccttatgaattatctattcgtaggtacctccaatgataatcaggaaaacattcaatcaagcatttgcctttatgaacgttcaactcttcaataggtatctcaccacctctaagtcttgtaaagtaacttcagttaactctggttgactacacaaagtcatatgaaatatcattagcatatgggggaacaaattggttgattctggactataacaaaatctataccttctcattcagtttgctactccgtcgagaatgctgctcctttagcaatggggaattcttaaaggctggtttacaagaattagagcagtggtgctctgtaacaactgaagaggtgaagtgaaaattgtgtataattttgtttggtgacaaatgagtaaaaggcaaggaagtatttgaccaaatgcgttgtgataatgcagtatgcaggaacgtcttgggatgaatttcagcacatcagacaggcagttggatttctggtatgcttgaaagttgaaaccaattattttcaaattatatagatgtttggttagcatcatgtgaattcgcgtgcaggttttgcatcagaagacacataaaaccttggaggaaatcactgatgagctttgcccagtaagtcctgaatatgactaacttgtaaatacttgaatttctgcaaaagcgtatagtatgaaacgtagtgccactttcccaggttttgagcatcactcaaatatatcgcattggaacaatgttctgggatgataaatacggtgcacaaggtctatctcaggaggtaagttgcaaacttctcaatacttaggcatatttcccttttcaactacaatgactacttccacgcaaaaaaagtaaagaaataaaaataaaatcttcatatgatgtgaaacacaccaacgtggtttcaggtcattggaaagatgagaacaatggccactgatgactcaataactactccaaatagttcgttcttgttagatgacgactcaaggtatgaatatgattggctgctcagtactgctattaagatatgaacctaaaatgggagaaacagtagccattgatctaacacccaaactgaatcaaattgcagcatacctatatcgttggatgatatagcacgactgatgcttgacatagacctatctgacgtggaaccaacaccactgctcaggcagaactctcagttccactttctactgcagcaccacgccacacagactgatggcattgtttgttaatgcaaagttgaaaacataattaaacaggttccgctattttgtgaagttcctcggtggtgatttcccttttttttatgggagtgcaggcttgccttttttttgttggcaatttcaggtgggagattttacaagaaagaaaaatatagaagatttttttaccattcttttcatttgttctgattgtttgaaagaggaaaggttgtatttttaatgtaaaagtgtacaagcgaaagtaaatatatgtatattttcagctaaacctgatgtaaaatttctgatatgattgtttctgtgtgtgtgattgtgagagtgtgtcaattcttaccattcttcatttactctgattgtttgacaagatgtatttttcgtgtaaatttgtacaaacgagagtatatttatatatatgtatatttcccccaaccaaatatgtactggtagagtggtgcatttctggtatgattgcctctaatatatgtttagaaggtaattttttcatccttaaaaaaatataatgaaagataccatattgtctaatataaaacttaatatttttatatatgtatctaacttttcaatataaaatttagatatgttgaggaaccataaaacttttcatgtttgggacacaatttttactattaccaactaacagcgtagtatttcagagttgaactgttcagttcagagttcattacaaaaagcaattcctctggcgcacacgacagagtccaatcacatgtggactcaaaaaatcattcacatcacaaccggaggaggaggggtcgagaagctcatgggcggtgcagctgccgccggatgcttcggtcggcgccgaggccaacccaggcccagccacaaccaaccacggcaagcacacgtcgtaggcggcgtggcgctggccgcatgcgcgagaaaagagagaagaaaaagaaaaaggagagatatttgaagggggggaagccgcgagaacacgctgaaccaacaacgctcccccgtcgccgtcctctcttgttcattcattccaggccgacctcactgacgaccgcccgttcttatcctctgaagcgaagccagagcggcaggcacgcagctgctacaacaaatgcatctcctaccaatttcgtcctaaattatactattaacttacacatatttgtattttacaaaaggtgaagtctattttaattttattattgttatatagtttaattaagatgaaattcactctaagagtttgtttggatatatatattttttaaaaaatcatgagctgtagttaggagtccgatcatctcaagttagcacataagttttttaaacagatttcttatatgattccttatgtattgacaaaagtaaacgatcttaaaaactaactcaaatacatatatgtatctccaaaagcaaacgaacttaaaagcctcatcatacacggatgatgtatcaaaataccgccaaaaacatcttcaatttttataatagtagagataacttacataaccaactactggctccaaatcatctatatccgattcatacaatagttacctataaacggagtactacacaagtcatagctggtcccatatgtcatatacacatgtattttaaaaagtttgtattgcagttggctacaaatatatagcatgttactctcctctatcttattttatattagtctgctattgtacctgctcttagatagtttgttatattttaaaataaatagtactaacgcatgagcacatggaaacaaaggaaacaaagttcaggtccacttctttattcttttataatatcattttggaatttactctggaatgcctcttatttgaatatttctggaatttactgagattacctcttttcatatttttcttggaatttactctggtccacgatggcacaaaagagtttttcttttttttctctttaagaatttgaattgctcaggaaaattattattatgttctttcttcatttctctactaggcatttcaattctggtcatattctattattacgatttctatcctacatgtcagtcaaaaatcgattatacagtatagtatggatgcttatgacatcgtccaacagagtttgccttctctaataaaaagaagaaaaaaaataaaggtttgcctttgttatggtgtttgaacagtcttttgtaacaagaagaaaaaagaaaaaaagaaccttgtcgattctctgaatattcatgttgaattggagttcggggcaatatacgtggccgtgaattgatggatgataagaagacaaaaacaactgagatttttcgtcaagcaacaaacatcttccagatatgaacaaaaattggacctttatgagtatggcagttgaacgagcagcatagcatagcagtatgggcctgattgggtcatgggctggcccaatggaagctagggtttctcttgctttttgtggaagtaatttaatagggggcaatgctatggccacacagccactcccactttgtaattaaaacacactacaaaactgggatgtttggaaatacctgaactgaaattgcaagaatagtatgattatggatgatttattagccctggatgatttagtttgctccactagccactgttaaatttattccctcaatgcctaactacaactatctttaacttttattatgacaagtagatatattgggataggatttccctaaaaattgtgagccacctaaggctgtaatattcctagtataaaaaaacacatttattggatgtgtatggcatgccacaaacttaccaaaactccgttacgtcttcttccatcctagtacactgcaaaaataatgactatagattatcacggacgcatttctcaattttgtaaacaattttgtttttacacaaactttcttcctcattccaccttataaaaactctttaaaaattgacatatcaacttcctaacatttaatcaattaatttacgcccttccataacctattacatctatcaatactttcaacacatgcccagatatctccctaagaactactaccaccaataatagaaaatccttactaccaccagttgtcatttatacatgacacttctgaccagtaaatcaactagtactacatttttgcctcaaacattggctgtgtttagttcaacgctaaaattggaagtttgaagaaattggaataatgtgacggaaaaattggaagtttgtgtatgtaggaaagttcgatgtgacggaaaagtaggaagtttgaagaaaaaagttggaatctaaacatgaccattatgtcgtaataacaacatatattatactccttccgttctactccctccgtttcacaatgtaagccccctgttcgtttctcatgcaatctgaggataaaatagatactcgtggcacgtttttcaaactgctaaatagtgcgttttgtgcgaaaactttctatatgaaagttgctctaaaatattagattaattcatttttcaagtttgtaataattaaaaattaattaatcacacgttattaccacctcattttacgtgaaatacttaatcttcatcttcattttcatctttaggagattcaaacaccacctaaatcattctagcatttcccacattcatattcatgttaatgaatctagatagaacatgaatatgaatgtggtaaatgctagaatgacttatattatgaaacggagggagtatagactataaaataaggctgtgtttattggttgaaattggagatgatgtgactgaaaagttgtgtgtgtatgacaggttgatgtgatggaaaaagactgaagtttagatccaaactttggatccaaacacatcctaagttaatcattaatacatgagacaagtagagttgggagagtaatgaaacacttttgggtgggtgcccggagcagaggtggggaagataaacgagcggtggggatgtgccgggacaggtatttgaatcaccgcctctgaatcgcctaaaaccccccttctttggctacccctccccccgtctcctcctcttctcccctcccccctcgcgtctgtggcggctatcttcgtgtccctctccctcctcctccccctctcctagggtttatccaccaccacctatcgcctctacctaccacaagaattttttttaccatctatattccacccctgccttctttgccccccgtacctcctggaattttcgccttcttgggatccaatccgcgaggagggaaagaaggcgggtttagatcgaactgggacggagggaggaggaggaggaggaaccatggcggccgttgctcctggcgctggcgaccgtatcctttttatttttgttttctttgatgtgtttaatctgttttagcagcggggggttgcggtttgtgcggcagttcttcgtaaagatttgaacttctttttttttctggggtgataatttaaacagcctttttttttctttttctcgtgttcgaatcctatggctgtattattgtttagttgctcgcttttgaatcgaagtgtttcttccttgattcgcaagctacagaggctactgacatgatgcagaagctgtcgttggagagcaagaaggaaggcgccacccctgacgctaccaagaaggtagcttttgctggcgattcttgtctgtgatgtgttgcttgtgccatcctttttgtttgtttggaggagaggtagctaaaaattatggtcctttttgtgaattgcagcctgccgggatgccctatggatctgcaagcgccggcgatgcgcagaatgcggcgtcgccggtggacaggtcgatcactcccctgctccaggaggccgtgaatgccaacatcttgtatcagaccaatggatatggaccctcagcatattactatcctactggtacaaacacctagtactttgctggataatcaggtagtctaattaagtgctgattttaatgtttgtgcgttcgtgtatataggttatgacggctcagccaatgaatgggactccagatatgctgcccatgatggaacggagatgcctcctgtaagttaatgcagttatttatagttagttcatcactttgcgataggtattttaaggtgtaatgtgatatcacgagttcacctgtgcctagaggaggctaaggaccaaatatggagatagaaaccgtgggggacatatgttgttaatttggaatttaatgaattgcttgtctactcatgctatgtgttggagataaattaactcgattctgttacaatgatccagcagagtgtttatggtgacatgtatggatatggctatgctccctatggcccatatccttctggttctcctgtcccaactgttgggcatgatggccagtcatacggcgcacagcattaccagtaccctggtcaatattatcagcaaccagctccaaccaatgcaagccatggcgtcaatgctgtcaattctcagtctgagatgccctctgttgctgctcaccaggcacgtgttccggttgaatcagcaaaagctagtgccaatgggactgctaatgggatggcaaatactaacagtagttcattagcacgtaagcaaacccatcaaaatgtatcagtattaaacaatggttcatatggaggagggactttgcaaggtggaccatctgctaacaattatggtcacagtggtcttcattctccagttcagtggtatgatgggccagtctactctaatgggcatcagagatcaaatactaattccacatcttatggttctaactcgtattcagcaaaaaatcagagccagcgcccaactgcaaacctcatggtatgttctaggactgtccaattctccattgcccccctccttcccccactcttcttctttttccatagcttctcaaagcagtatgattgtctcacaattatttttttttctgcttattaaatgcatttacctagtattagattctgcgattactgccttccccttaagttgcacatagcaaaaatgatagtgatgcattatgtggctctcacaaagtacaagtattagcctaaaatatccatttgtttcagggtatgcatgcacagataccttcgtcgggaatgggtttgacatctcctagttatcataccaggatgtacccagacaacagattatatgggcagtatggtcagtatgggaacgcacttaaaactgggcttggtttcggatcaaatatgtacaactccagaaataatggacggtggggaattgttgatagcaagtacaagcctagaggtcgtgcatcttttggttttggcagtgagaaccaagatggcttcactgagcttaacagaggaccaagatctggaggattcaagcaccaaaaacagtttggaccttctgtcactattgctgtgaagggccaagccctcccctcagtcgggaaacaggagaatagtgccattccagataagggccaattcaaccaggaaggttttccagtaacatacaaagatgcaaagttctttgttatcaaatcttacagtgaggatgatgtgcacaaaagtataaaatacaatgtgtgggcaagcactcctaatggaaacaagaagctggatgctggataccgtgaagcgcaggagaaatccagtgaatgcccagtcttcttgttcttctctgtaagtattattattaccacattatgtgatccatttgtccctcatatcactctttattgacattgggcatggaatataggtaaacacaagtggccagtttgttggtgttgctgaaatggttggtcctgttgattttgagaagacagtggattattggcaacaagacaagtggaatgggtgttttccaatcaagtggcatgttgtcaaggatgtacccaacaacatcttgaagcacattacattggataacaacgacaataagcctgtgacaaacagccgtgacacacaagaggtatcctttctcaataacttgccaagttctgttgattgtacaatggtcaattgcaggccacgggccattaagggtactattaatgtctctgttattttagatagttaatttcatcgtcattttcttgagataattcaaatttcttgctgtggaaccagattagtcgttcagtaaatgagaacttaagacatgatatatatcaatttcttcatcatgcttatggtcatgagtggaccttcatgtataagaagctgatgaattttatttttatctattgatatggcatgacaatgtgatgatcctttcagtatgctccatgtgcgttacttaccaagtagatgtaatgcttcaggttaagcttgagcaaggtcttgaaatgctcaagattttcaaggaccacatcagcaagacatcaatcttggatgattttggtttttacgagaaccggcaaaagctgatgcaggagaagagagctaagcagcaactgcttcaaggacaggcaagcattctattcacacatagagccttgtgtggttaaaaaacctgttcagaatgttagcaccactcagagctattggtggtgataggttctgatgcctctgtttttatgcactttgtacagggctctcttgacaatgcttcacatgaaaaggagaagaatgcaattgatgggaaatccacagctcagaagcaggcattgagcaaggagggcacccctattgtcggcgaaatgctgaacgcctcaaaatctgcagttgaaagcagtgtaacaaatggcaattagcgcgatatattttctgcgttaattgccacagccgagcagtcagattgtgcaaattctgaaggttcgcggcgtggctgagcgatagctacttgggttgggacttggcaactaaatttcgtaacagactttctataggcttggtgcctggggagtgggtcagttcttactttgattttagctcgtgtgactggttttttgcgtcgttaggtctcatatattactcttatgacatcgggttttatgtaacccttatcctttttgttttttttagccttttcatctattgttattgttagcgaagcatccaaatttcgataaatctgaacaacagtaaggtagttttccgagttttgcagcactggagaaggtaataagacaagaactctggttttggttggtcctcccttgtgttgtgtactatctgctttcaagtgtcaatgtgccaaaatggcatcaatcatctcgtgcattttaggcatccacgatgtgcatgagaagaggtcttactacctactttacaattggagaaaatcctctatatatccttgagagagatgctctgaattttgcctattcccttatatactctcgagttttcattttgatcttctctatgtaatcgttaaatgtttttgaaattaactatataacccctctcttatacctgtgttagtttaatgataaaagcacaattcttatatggaaaaaatctatttgtaaataaacaaagggaatataattatttgacaacaaattttaaaaataaaaaaaattaaattaacttttatgatatcatcaaaatttgaacccaacaaataaataattttggttcacaatttcttgctaaaactcttctatggattttgtccaaaaaaaataaatttgttcaacagtttaaattttctattcaataaataattatgtcccatttgattttatcatgaattacaatttttcacattggtgaattataaagtagagtagatagcatataactgtaagaatgggaaatggacgatagggtcattttagaaaaaagaaaattaacaggcaactaacataatagggatagaggagattaaatgaaaagttaaaggtatataggggatgagacaaaattcagaggtatagaaaagattgcgaaacttttcagaggtatgtggaaatttttttactattgtggaggtgggtaccagaggatgtagtaattccatccggcaagagcattactagtacctggtaagaagcaataaaaaacacttaactctctactctccctttttcaaccaaccaatgttttagacgtgggccctagcttactactatctacacattgtactccctccgtcccaaaaaaggtaacttagtattggaggtgacattttctagtacaattaatctggacataaatttatctttttttcgacggagggagtaggagttaggaataactataacctagtttcgtgggtttcatcttagagcaagttttttaatagtatagtcaactattagctccaaatcatctatagttaatttaatagccaattcatacaatagttatctataaatatatattacactattaatatatggttccacctgttatacacatattatgtcttgtagtcagtactgcaactggctataaatatgtagcccgctgccattctcttttatgtattatctcctcgtatgtgtttatagctggcttataatctagtattgtacatgctcttattgggcctgtttggtagagatttgctgcggctgttca

SEQ ID NO: 32166 - DNA, 8945 bp, Oryza sativa
  unsure (1)..(8945): unsure at all n locations
taattttcatttgtacaccgacttctgaacttacaaatggaattacaattccagttacaatcacagggaataagcaatacaaatagctagagttatttacagagtctgctgtgcacatgtatcatgtatggatattgcagtgccaaactcttttgtttctgacgagttctactgacacctgacctgatcattgtcctgatcgggttcacctgcatgtgatctcaatcgactgacatcgttccacagattacaagttcatatatagatccggcaagatttttcatggctaaaaacagttcagacatcgattccccataaaaacaaagaacagttcaggcacacgcagagtggcagatgcagaactcggaatccgtcggaacatgacatgttcgattgttcaggcctcccaaatcttaataattacgtgaagtgctaagtatacttataattagtagtaatataattagcagtataactagaatgataaagcccataaaacccgtaaggtcagaattaaggcttagaacgaaaagtaaaataacacaacatgcatgcctaatacataaagttaaatctactgaactagatattattatgttctatgaatcattgtgattgaccatttgttcgttttttcccgttctaaaagttatatcttgtcaatcatgataacaagaacgtggggatttgactgtcaaattttaagacctcactatgtatttcgaacaggaccttcaaatcctagctatgacgcggccccttcacatgcaaagctctaaccttcgtcaaggagaggctctacactgcctagatgagaagcaggtatcaattcactgttgcacaaaagataaacctgccaataaacaaggcaaataggagtattgaatatcacgcgtgccgatttcaccatcggaaggaaacgaatagaaaaaaaaaaggttcataatgtccaatgtatgttgaacacataattgtgtgagactgttaattactcactacatcttaaaatatgtacgtttgaggttttgcacataaatttaaaaatagataaaattatagagaggagggttacggttaatcgagatgaggaggtatgtgaagaataactatattttaagataaaaatttaaataaagatagtgtgtatatataaatgtggaggtgctaatgcaagatattgcatcgtaacttcagtgttagatggggaaccgcctatgacaggctggtttgcatgaaatgcaataaatttaatggacaacagtacacatatagcagcagattgagattctctaacttaataaatttaatggacaacagtacacactatagcagtagattgagattctctaactcaattatttcccactgacgtgggtcactgacacgtggaccctctacccaacggacccatacatcagtgactcaaagttagaggagaataagtgagagtatccttttcagtattcgtattggagtctggaaaatgttctcagagctgcagggaggacatgtccaggttagaaagcatttgtgagatattatctcccattcttatagaggtgtactcctgtatacctctttatacttgagaaatattttttctaaaaaaaaagataccaaaactaatctaatatattagaataggattgagaactaattattttttaatttatcttacattttgaggcgtataaatatttgtgccaattaagatatatttttagtggtatatctagaggtagagatacctctggactaacgtacacactataaggtatatatataactctcatacctcaacaattagaaaagtcttgtcattgcttatcataaacttgtttattaatcaaaataattagtttaatttatttacatctcaaatgcagtgcgaaggtatatacgtacctctccaaacataggaaagaacctcaagctaccaaccgatggttccaccactagctaaacaagacccatgtggaacagaaagataaataaccttgagcaacctcaaagtcatttagtatgagaatattttcagtcacataccttccatatttccaaataaaggattgctaggtttaagataggaactgcaatcaccttttaacctagcactgaatttggaaagacaagcaggagggtaattcactagcaatagcgatagtggcatgaacttccaagtggtggtagcgatgactttccagctatgacgatggtgtgttggaactccgatagagaacgtagagtttaggtttatgggtttggggtcaaggtgggagaggggtttgggagaggtggaaagggtgtggccaatgaacacgggaggtgaggtggtgacgaaaccacgactatagaggagggtgctggacaatgtcggtagtaggaaaaagatgtgctagatcctaattgttaagaggtgaggatagtgatgacttcccgatgacgggggaactgtcgaaaatgaaaagcacaatagggccgagtcacctaactgttattgggcttttgggaggaggagagaaaaaacaagttgagggtgatactgtaattgtatagatcttagtgcaataccagtgcgagctactcaaaataatggacctcatgtgccatgtaggccgagatcacacctcctctcccacaatgcagagttgctcttggagtgttttcaatttttcatgtcaacccttgccatcttgtattttagtcctaatgtgttttcaatttacataaagtcaaaaatttagcacgcacacacctagggatggcaattgtgcccgtttgcccgtttacccgcgggtaaaaaccctattagggttgggtttgttctccattttatacccatgggtatcttattggttcaaaagctatgcccgatgggtaaatgggcatgggtatgggtaatcactacccatgcccgctttgcccgtttacccgcgaaatctaacttacatgtaggctaggagtaaaatccactagaatacataagccacgttctttgttttctacggtttcccttttatttcccttattatttctctcctcttactctatcgccgccagaggagagacacgacaccgaggtggagaatatttgatgttttaagttcgattcgaagttagtagcttgtagactttttgttccactgcttttgttgtggcgggtaaacgggcacgcccgcgggcataaggcgcccgcgggcaatgggcatgggcaaccatccttacccgtcatgtagtaatgggtatacccacgggcacaaataatctcacgggcatgggtatgggtaggcactacctgtgcccgtcacacccgattgccatccctacacacaccctaatttccagaagcaaatataaaatctctcccctctactctcctcaatccaccgatggcagccagtggcaaacgagcaccaactgacggctcccctactccacccaccatgatccactagaggccggcgatatatagctccatggtgcccctcctctctcctcgcagcggcgacgtccaaagaggctgggaacgcggcggcggattgagtaggccgaggtggtggtgaagccaccgagtagcgggggttggggggggaggacgacagctccatggtgcccctcctctctcctcacggtggcagcaaccaattaggaggctagggacacggcggtggcggagccaccaagtggaaggcgacgtgacgagctcggtcgggaggggggggagggagaggacgacgacaagctctgcggcgcatgccagtgcccctcctctcccggcccgcgatgaggagacgaagcccctcctcaaaggacgacgacctcgacaacagcggcgtgtgcgctcggctgccaccatcatcgcctctctcctctcaagcgttgaggaggagcgggattcggcctagagctcgacggcgccgcctggatctagccaaaggtcagcgacagtggctggcaacttgagctccaccatagccaactctctcctttcccgcgcctcagcggtagtcagctcgctggggcccctcccctcccagccgacgacgaggagatggggcttgagggctcggagggcgacggcgacagcagtaatggagctcggtagtggattggcgtcctcctcgtcgtccattgccggctcccctctcttctcctccaaggatggggaggtggggatggtggggattgttgcagcctcgcagtaagattccttgtttttcttagctttttcagctgaggctctcggctctcaagttagtcttgtgttacccacgaagtaatggtctctcaccgccacgatagcatgctatcctacgtggtgagccgtggccatgctccacgtaggaacactgtgaagggccacacgattccaaaaatccaaaagtaactaaattttgatggcattttcatgtgattaaaaaaatagacaacaaacagtcctttccaaatataatcaagagctagcgatcaaagttctggctggaccacacagcatacatgctgcacaagtgcacagtctacactacttgtgcggatctacccactcggccactcctgtctgtagtgctgtagtagatctccaatctcaatcgagaaaaggccatcgagtcggtgagattctttcacatatatagttcgccgtgaaagtctatttatagtaaatccggtgcctatatatacgtcaaatcaaatcaactatcagtgtgtgagctatacacactgacagtgtagtgtgctgctctcctagctagctagagaacgccacacactggactggactggatggaggcgtcgtcgaacaccaacgccatggccggcgtgatggcgccgctgatgctgcacggccgcgtggcaattgtcaccggcggcgccggcggcatcgggtcggccgtgtcgaggcacctggcgtccctcggcgcgcgcgtcgcggtcgcctacatcggggaccccgcgccggcgaacgagctggtgagcggcatcaacgacggctacttgcgcgcggaggaggaagagaagcgcgggccgcgggccatcgcggtggaggcggacgtgtcggacgcggcgcgggtgagggcgctgttcgacgcggcggcggcggcgttcggcggcgagatccacatcctggtgacgacggcggccgtgctggacttcgcgtacccggcgctggcggagacgagcgaggcagcgtacgacgccatgttcggcgtgaacgcgcgcggcaccttcctgtgctgccgcgaggccgcgaaccggctggcgcgcggcggccgggggcgcatcgtgacgttctcgtcgtcgggcgtcgggtcgctccggccggggtacgcggcgtacgcggcgagcaaggcggcggtggaggtgatgaccaagatcctggcgcgcgagctgcgcggcacggggatcacggcgaacgcagtggcgcccgggtccacgggcacgccgatgatgtacaccggcaagacagaggaggacatggcgcggtacatcgccgaggcgccgctgggccgcctcggcatgcccgacgacatcgcgccgctcgtcggcttcctcgccagcgacgccggcggctggatcaacgcccaggtcatccgctgcaacggcggcactatctagctaccctggcctgcgcgccaaaataaatgatttctccgttctaaaatataacaacctaaaataaaaaagatatatcatgtactaaaaatttaaacgtaagatttataatattagaatatgtcatgctagctaggttgttatatttgaaatattttgaagtagattttctggctatgaattgcattatcctggtacacgttgtgctcttaccttcagcttgggagagttgtgcgtgacagttataaacagtatttgtctgaatgttctggtcaccttatgagcacctgtttgttctctgtccttttggaatggttacttcggttttgatatactaataggtgacgtttttaactttttatttgtaacgtttgaccattcgttttatttgaaaaattagtgcaaatataaaaaaagataagtcatatgtaaagtacttttgataataaagcaaatgacaaacaaaataaataataattccaaatttttttgaataagacgaatcagctaggaccatgtatcctcgctactttctccgttttacaatataagtcattctaacatttcccatatttatattgatgttaatatcaatataaatatggaaaatgttaaaatgacttacattgtgaaacggatgaagtatatcctttccgtgttcgtgtgcggtgccgaactgccgatgcgatgcatccaatagttgcgctagctacatgctaaaattcgtcgtcgtcgttgtaacttgtgtttgttcgttcaatgtaagagtggtttcacggtactctataagtaccatgatttttacgctataaaatacgataatcttccggttaactttttaagaaccaaaaggatccacctaataattattttagtaaactgttaaactactataataattgatgactagttgagtagaaaggatcgactagactatttgaaaacacattatatatcggattgtcgtcacgaattatctacttatattcataaaagtagattaaatattttttaaaaatatcttgacaaatactcttctgtcccaaatataatgagttttggttgtattagtttagattggatgggttggatgagacatgttttagtaatataaatctagacagaccatatgcccaaatttatagtattaagatatgccacatccaaccaaaacttttttacattttgagatggagggagtactataactagtgatgtactctctccatctcataatataagggatttggacggatgtaacacatcctagtactgtaaatctggacagactatctgtccagattcataatattatgatactccctccatccacaaaagttacacctataaatagatttgagttttttccaaaaaagttgttcctatttatagtctttatatttttttcgacttaaatgaagagataaattaaatgttttattagaacccaaagagtcatctaaatactcattggttgtatgcttgcattcacttcttgattttggttgtatgcttgcatttcctatatttatattgatgttaatgaatctagacatatatatctatctagattcattaacatcaatatgaatgtgcaaaatgctaaaatgacttacatcgtaaaacggaggaagtattagctaaatatggacccacgtgttatcatgcacacgcccacatcacgttcaaggatgcttaaaacacttggagacattattgtattgtcgatgttgaagcaccttaataacttcatcaatttcaatatatactggctcaatttttaaaggtgttcttacgaaacaaagatagatgtaaagtgtgtgtgcatattcatagggatgattgtgtgcttgtgtcaaaatcaatagtctataatatctttcataaaagaatactcaaggttatctgaaagcatcctcatcatctatggttctgagttctgacttccgagccaccgtcgtccctcgctaacttcgcatcatctcttccgccacccaccaatagattcacgtttatagtccaaacccaccaactctatattacctagggttgaaaaccgtcaaattttgaggttctgaagttttacttgggatggaagtagattccacgtaaaacttgaatggttttcaagaattcaaatttgaaatagtaaaattcgacctaatttatcaagatctggtgaaaaatatcatacagatcagggaacaggaaaggcccatgaggcctccacccgacggttcagagcccacagaaccagacaagcccactagcccagtggatttctctgaaaaaaaatgtttttttgctagccgccgtcctccccgaaaccctaatccccaaatcgaaggatcgggagccgccggattggtcctcaaatcgaccccaaatcgaaggattgagccagggacgccgccggatccgtcctctaatcgaccgccatggcgatcgcccgcaccggcgtgtacgtcgacgactacctcgagtgtgagattgctagctcccgtgtcagaggccgtcgaatttttttttgcggttgccttcgatttgcttctgtttattggctccatttcttgtcgcagattcgagcacgctggccggcgacctgcagaggattctctccaccatgcgcgagctcgacgagagggctcatggtgatgatcttttttacactcctttttcatttttctaaaatacagattatccaaaaaaaaatttaaaaaataatcattttgggtacttctgatatgtagtaatttttaatagttgatacaaggctataatgtcatgtgattgttttgtatagggctagtgcccacttatagattaaatttatgtgatattgatagttttctcaagtttgtagttgtacggattatgtttctgttgatgcaggcattatgggacagaccaaagaacagataaagtatctactcggagtgccatcccatgggttcgacaggtcaaacatggatgatgatgaatctgcctcagagagaatgaaaaaggacatcgaagctagtcaggacaatgcgttgagtctctgcaccgagaaagtgttgcttgcacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntg

SEQ ID NO: 32167 - DNA, 576 bp, Oryza sativa
gatttttgcaccattcggcaccaaagattcattccctgccgacaggcgacaggagccctgaagcctgaactaaaattggccgcgcaaccacacatttctgcagggaagacgattgatcgatcctctcttgctctgatcacacaagacaatgcagctgtcccgacaacgttgtccttgaatcgtcgccaaccaaaagaaaatctcttcaacccaacagcgatttgctcgaatctcattaaccgcgtgaaaaagaatatatatcttcagggatcgatggaaatgaaaactttgaccattttcgttttaacaatgttttgtaattctttgaaaaatacaccatattatcgaactatgataacctaactagactttttttttgttcaaccaaatatgataaatctaaaaattgttaatggttgaagttgaaacaaccctggtcagaggtgacagttgacaaagtaaataggagccgagggagtatcgttatcttctctctaaaatggattccgattaatcagaattttaatactggacacatcataccagggatgcagcctctgtcctgtccgtgtgatc

SEQ ID NO: 32168 - DNA, 9207 bp, Oryza sativa
  unsure (1)..(9207): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagttgcttcctgtttgtctgagaagacatcattcacataccgcagcacaagagatgttttgcctactctccctgtgccaagagaaaagtaaaagttattgtttgtgttaataaatatgaaatgtattcaatcacatgtcttttcaatgaaattgaaaaaatggagcatataattatgatcaattcatcctaagttaaacttaggtttatcagttttcacattgataggctgggccaacagaggactggttacaagacagcctaaacacctcttccattaaaaatctgaaatcaatgacagaaagttataacaataagcaaaccctaatgacccaacctataagatacatgcccacaagactatcaacaatgcttttatgcatggaaacacatatatatcttcattcaaaaaatgtaaagccaagtactaaggcatggttaaagagtttcagcaattgattatgctggcgctatcacttatcaagtactgtctactgtggtaaaaaattctttcattgtgctcattgcctcagttcaaaactactccaacttttttcttttccaaaattgaaattagccaacttcaaatgaaacgtgattccgctttggcaatgcacaaactgatttccaagcttgcttctaagctataagtaagctgatcctaaatcaaaatgagtcaatgttcaacaatgctaggaaaagcaagtgtaccatgttagatcaatgcccacccgtgcctggtttcaagaaaaattctcttgacattcccatgtatgacttacatgcacttgctaagaagcatgcccaaataaagactgtagtactttcccatcaaaaccccctcctcccaaactacatactgtatcatttttccaaaaaggcacacatcactttctctagaggaacatgggtaagacccatggcatcatacacagatgaccaaaaagctgagtcatactgaattttttttttctaggaccctgccttcaagggttggttaaggtaatgacaagaaaagtaaaaccaccaattaatatagaactagatcagctggacattacaatccaagcttaaaagcggacagagagcacggatcaaaatgaaatattatccacccctattgcataagacgaattccctgccaccagctccatggccacccttcagctgccactttgtgtccacatgaatttgcagcagtccccgctgcagctagcactagacaaatcttctatataagaacgaatatgcttctacttgttagattgtttctatgagtagccctctcggtctaatcatctcctggactccgctaagcctcgaaggcaatcaagtaaaaggtaagcttagctcaaaaccgctcaactccctcgtctaagctatagatttagctacctacacagggtaccagatcaaatgattctgcggctttcccctaaccctagctagggctcagcacgcaccacaagagcagccaaaattcacccagattccgtggctattttcttgcgcacgccaaccccaaactgaaggatcgggaattcggcagaaaagggggttgagaagggggggaggagggttcgcgggatcggaagggagagggagatagccgtaccgtcgccgaggaggacgagcttgaaggagacgctgggctgcggcggcggcggcggcttcgagcccatcggaggcgaggcgaggcgagaggggttccgccggaggctcctacgagcctctagaaggttccagaaccttccggatcgcccgtcccggtgttgcgtgtgtgctgtggtcagagaggagaagtgtgggagacggggaaaacgggaatcgtgcggcacgttacccttgcgcggagcaaggctcgggccgggccggcccgggcttggagataggttgctggcgttattttcataacatggatgctaagcaatattattaatattttttttctaaataaaatgattggcccaattgtcacactcttctcctataagccactaatgggatgtttagattcaggggtgtaaagttttggcgtgtcacatcgggtattatggccctctttgtttaatcttaggtttattagcttagggcccctttgaatcaaaggatttatgtagaaatttcataggattcaaatcctataggaaattttcctatttggccctttgattcaaaggattgaagctttccaaatcctatgaaattcctatggaatgacacattgcatgtagattttggagaaaatttagcaagagctccaacctcttggaaaatttcctttgagtctatctctcatccgattcctgcgtttttcctgcgctccaatcaaacgaccattcctgtgtttttcctgtgttttgcaatcctctgttttacacttcaattcctgtcagaatcctatgtttttcctattcctccgttttttctaccctgcgattcaaaggggcccttaaacttttaattcaacttattggcttatatgatttataaaccggtagatttaatgtcctgaatttagtggtgaagtcatatatctacctcatataagccaaaaaagttccaccaacctagcttttggcttaatagtattagagtggcttatggttttaaaaagccaaacgaaaaaactgtttgtttaagcttagactttccgacttataagttggcttataagcctatacaaagagggcctatatagggtgttgcatgggggtatttgggcattaataaaaaaactaattacaaaatctgtccgtaaatagcgagacgaatttattaagcctaattaatctgtcattagcaaatgtttactgtagcaccatattatcaaatcatggagaaattaggcttaaaagatccgtctcgcaaattagtcgctatctgtgcaattagttattttttaacctatatttaatacttcatgcaggtgtttaaacgttcaatgtgagggtgtaattttttgcggtgagatctaaatggggcctaactattttttctctcttccttcggatggagacggcactatggtccactagtcactagatcatcctctctcatatatcgtcatcattaatatcatatagagagatataaaatcatcggtatcaaatatttattacttgcagtcccaattgaaggagctctctaagggacgagtgtttgtagtctgcaaacacaaaacaagagctcatctcctacgctctatctccgtctctctctacaccttatctttttctctcaaattaaatgcacgtggcatgcagccacgcatccatgatagtgaacacacgaggaaagaagtcacaggcgagccacctcccttggcgatgacgatgacggcaacctttatccggcgagccccttcctccccctccctccaacgagcttcctcatacggagaagagaagacacagtcaagtagctccctccagtgatgacaatgacggcgaaggcctccctaacggtgagccctctccttgtcccctcgacgagcttcctctgacgagatcgattaggtatccatgtcagctccccacccttctcttcgctccggtgccgacccatagccctggcagttgcaacgccgcttcagtatccaccgccggtctgctggccctgaaaccattcctctaaacccgatttccctgacttacccctcgctatcaccaccccctcccccctccccaccctccacctccgaaaccctaactcttaccctaatcagtagcttgtcgtcacgcaacccgaaagagttcgtgcacatgaggagtgcgtgcgtgttacgtaggcctctagtccgcacgtacatgtcagctgcttatgtcgcgcgcgcctccccacctaggcacctagcctccacgggccacggctctctcacaccacgcgctattaacactaatgatcatactgctagtgcttacaattatattttaaaagaaatatatttaaaattagtcaaaagtttgaaattggtagttgaaagattttaaaatttgagttgaattttttcaactttcaattgaaagatgtagatttgagttgaaagttttcaaatgggttgaaagtttcaaattttgacttaaacgttttcaaaaattaaattgaaagttttgaatttgaattgtaataaatcaaattttattgaaaatatcttctaatagaaattttgatgacttttaatatatcccaaatcaattacatgaatataaaaaggagagaatccactcagtgccactgagttcgtcacggttcaacaatatgccactgactttgtcgacttccattatatatcatcacctttcccttaacctctacgatttaccatcgtcgtccacagtccgtcaactatacgccgtttgtactgttatttttttccgtaatgaccaaaataccctttgagtcatctaatgcttcggtgcgcgccgcatggaagaatgtcgtcgattgcctgctcaggctcaagcgcctcaagctgttgccgccgtcagtggtcgaccaggacggcggcaccagtgccgtgagcagcagcacggagcggctgggacacctggccaagtcagagtccggcgtcatcttcccgtcgtcgcaccgtggcgccgggacgagcaagcacatgtctggcgtgatcggccggttctcgcagttcctttctctggacgccggcggcgagtcgctgctgtccgtgggcagcgagttcgagaacaacatcaagatcatccagcaatgccggatcgggagcatcttcacggagagcgtgaagctgccggacgagtcggtgcagaacctaggtcgggcgctcatcttcgccgccactggcaaggggcagaagttcagcacgccggtggaggaggaggagacggtcggcttctgctaggacctcatcgtgctggtgtcgtcggcgaacgtgcaccgcttcaccacgttctggccgcagttgcacgactgcttcgccgccgtgtcccagttgccgctcttctccccgtcccgttcgccgagaaggcgatcgtggcgctgttcaggatcgccgtgaggctgctctccggcgccggcggcggagaccggatgtcggaggagttggtgttcaagtccggctactctgacccgggcaacgcctggagcagctcaagctcaagcttctcctcctcgtcgatggtggcggcggcagcgacgatgatgatgatggaggacgcgtcgcggatgggcaacctggcgacgagcatgttcatcaagctggccgaggcgttgcgcaagacgagcctagtccagcgagaggaggtacggaaccagaggagatacggaaccaggcggtggcggagctgggccgagccattcgtccccacgccgccgtgcgccttggccgccggcgggaggtcgccgggacctcgccgcaccttccccggccgccgccgtgctagtcacgcaccgtcccggctgtgcttggccacacacgcgctgcctctccccggctggaggaagaagacgatgaagagagagagggtcgggcccacctgtcattagctgtagtcgatttctgtaagggcatatttgtcttttcttcaatgcaaattaacagtttgtggccgtgatggtaaatcgtagaggttaagagaaagacgatggtatataatggaagtcgacaaagtcagtgacatattgttgaacgtgatgaactcaatggcactgagtggattctctctataaaaaaaatatgaacgaaaaaaagtcatgccagctaaacacatgcatgcgtgtgtgtgacgttgatgcatgtgcaggtgtgggaccaatgcaggcatgcatatgttgcacagctgggattggtgcacgcatacgggtgcgcgctacttgctaatctagcgcgtatgcatcaattagcattcctggcgtgttgctcccttcgtttctggttataagatgtttttgattttggttaaagttaaactgattaaagtttgatcgaattatagaaaaaaaatagtaatatttcgaatcgaagtttgttccaagttaaattaattaggaactcaacgaatcgaagacaaaatctaaggtgcctttacgtgcatgtccgaattgatgtccaattccgtgtggccgcatgctttcgattgaggtccgaaactctgatgatataatttttcgttctcgtgctttgagaagagatcgagtcctttttctcttactttgccggccggccggtaagagattttcttcgttcttcgttctcttcttccatgttgttatatatataaacgtgaaccaaacctttcatagttataacttaaatttgatcaaactgaccttaaacaagttgctcttgtttagttcccaactttttcttcaaacttttaactttttcatcacatcaaaatttttctacacatacaaactttcaacttttctgtcacattgttccaatttcaatcaaactttcaatcaaacttttgacatggcggcgccagagttgaatagtttgatggacgacgtcgtcgaagagatcctcctgcgcctcccgccggacgatccctcgtgcgccgtccgcgcctccctcgtctgcaaacgctggcgccgcctcctcaccgatgacccgtgcttccaacgccgctaccgcgcgttccaccgccgccgagcgcgcgcgccgcctccgctgctgggcttcatccaccacgtctccgacgaccaacaccccggcgcccccaccgtctcacggttcgtcctgaccaacgcgttccgccccgccgagccagagcgccgcaggggctggtggtggccgatcgactgccgccacggccgcgccctcttccactccgccggcgaaggcctcgccgtctgggaccccatggcgggcgacgtgcggtggcagcaggagccgcgcatcccggcctccgactgcatgtactccaccgccgccgtggcgtgcgcggcgcccggctgcgaccacgaccacgaccacggcgactgcggcggaggccccttcgtcctcgtcttcgtggccgtcgacgagcgccacgagaccgcgtcggcgttctcgtgctcatcggagaccggggagtggagcagcgcgccctccaccgtacacctcgaccgcgagtacctctacagaagcccaacgtcctcgccggcggcgccgtccactttctcaccgactacggcaggaccgtcctccgctacgacctcgccaagctggagctgtcggcgatcgagccgccggaggtgcactccgacgtgctcctcacgacgacggagggcggcgacctggggctggccatcctggacgaccagcgctacctccgcctctgggcgtgggccgcagaccatggcgtcacgcggcggtgggttcgccggagggtggtcgacctcttcgccgagctcccgttcctccagcacgtactcccgctgaatctgaccggcttcgacgagggcaccggcatgatcttcttccaagcgagcgacggcgactacgccatagatgagctcatgtcgtcaccacgtgccaagaagctttgggggagggacaacttttctaatgtcttcccctacagaagcttctacgttcacagtaatagccttcggaggcgtttgacgtaaacggtaatagtaataggtaatacttccgttccaaaattaatacttcctttgtttcataatgtaaaactttctatcattatccacattcatatagatgctaatgaatctaaatatatgtatgtgcctagattcattagcatatatataaatatgggtaatgttagaaagtcttacattatgaaacggagggagtatataaacagtaatatgtaacatatcctagtaatatgagatatgttccatctaatgatgtgttgttatattatgggatgaagggagtagcaacgataatggaatcgtttgaagctgtttatacttacatggttaattatgtttggttgtcaagttcaatactctaccattttagcgtttggacacactggtggagaaaccttttgtagtcctggttcgtaacccccctttagtcccggtttctaaaccgggagtaccaatccgggactaaagatcgctatctttagtcccgggtgaaataaccgggagtaaagatcgatctttagtcccggttggtaacaccaacccggactaaagatcgagctgaccttttttttttttgcatgcccctgttgctgcatggtttatatatatatataaatatatatataaaccatgcatatatatgtttcaatacatatatatgcatacatatatatatatatatatgtatatatatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcaagctctcttgtggtgatgatttggtctgcaaggcagtggcaatactcgcacacgtaatagccgcacaagttagttccctgcttttgctttgcgcactacaaataaatgacaaacaatgagagatctaattaatataca

SEQ ID NO: 32169 - DNA, 1226 bp, Oryza sativa
caagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttccttgcgcgaactagagccaagtgctcctcgatgtaaggagctaccaatgaagagtgttgcagaacagtgaaatgggctttacggaataaattgttgtctaccgtcgttattgctttccttccgagagttctctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaatgcccatgtacctctcgaaaggaaacatgttgtgtaggtacataggcccgagaatacggatctctttcacaaggtgacaaagtagatgcgtcattatattgaaaaatgaaggtgaaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaattggtagcagttgtgtcatcaacacgtgacagtcatgagactttaggtttgtgaacttcttctccttcgtgcttattattcgcttgatattcgtggagtatccagatggtacctttatgctctccaagcattcaaacatactttccttctctgccttgctaagagtgtagctggctggactcaagtaatggcttcctttctcctttggtccgggtgaaggtcgccgcgttgttccatatgcttcagatcattacgtgcttccagtgtatctttcgactttccgtatacacctaggaagccaagaaggtttacgcaaaggttcttaatgaggtgcatcacgtcgattgcgtggcgtacgtccaaga

SEQ ID NO: 32170 - DNA, 13139 bp, Oryza sativa
acaggttgatcaatagaagctttgctgattggttggaacaaaaggtaaagttgtgtgcattcaaatttctgttgtaagaaattatttagacagtagagagtaatgatactcttatgcaggttttagaaaatggtgcagaaatagatgaaaagacgagcattggctgcaaaaccgaacaaaactgttgttcgctacagtggatacattattaatggttttaggttccacactgagccgtgaggctggccgctgcactcaaaatagtggtgttgtgaacgtcgctgatgatggtgttaattactatggcagattatcagacattgtagagctgtcatatagaaattacaaggtagtactctttagatgtgattggtatgatgtccaccacagagctggtatgaaaaatgatgaatttcggttcagccttgtgaacttctctcggaagatacacactggagagaaattggatgatgatccatttgtgttttcatcccaagtggaacaagttttttattctgaagatccaaaaactgaaggatggcatgtggtaacgagatttaggcccagggatctttttgatatgggtgtggaacagccatctgatgaagcagagcagatcatggtaagaaaactcaggctcagggatctttttgtcttttcgttttttttctttagaggaaaaaggcaggagctctgccattcatttatagaaggaagcaagcaaacatagagaaatccttttacaggatggtaccaaggatttctgtttacttattgtcttgttcattgttgataattgtcatccgaaattcagaatattagaaatttgcatggcttgtactttctattgataaaatgtagaaattcagtctggagttaagcctggagttaatactgatgacatatatttgaagattacatccacttgtttttgcagcaacaaagtaaagataaaattaactgattcttgtttcatgtttcaggtttgccaaatgcagggtatcaatgcaaacagaagcaagatgtccacactgccagatgatttctgtcagagtcctgatatcctcaacagtggtgttctccggcctctaggacctgaaaaccaatgctcaacaaatagcgacattttttatatgaattcccaagtgaaaatgggctacaagtattgtttgataacttttagatgatacctgcttcggacttatttttttaataatacttgggtttcatttgttgggatggacttttatatatatatatatatatatatgcttgctgctcgtgttaagttatggactacaaagttttatattaatttccctacatatttccataaatttgattactgtctaccgcgcgcaagacatttgacctgccgagggttctattccttcccctagcacattgcttaaaatttttgttctccatcccgcgcacaaatgttaaagtaaatccggcggtgaaaaacgtaagtttctcccctaatttttttttagagaaaacaaattaggggaaaaaggtacccctatttttcgtgttgagagattttgtttttaaaaaatctccattgattttatgtcacagagaaaaatagatgaaaaattgtaagtttctccctttatttttttagatgaaaatgtaggtttctttttccactgattttacgtcagagaaaaaaaggagaaaaagatttaaccgtgcacaaattgtaggattcaaaagtcgaaacctggacctcacacagcatgcgcctccaacattatgacttaaaccgctgagctatgcaaccttttgatatttagttaagacaaatttttactataggacacttcgatttcgtagttgtaaccatgggacaccgcccgaactcacttttgggggaaaacacttcataaacgtggtaatttgccaatggacaccacgccaatagcgtcctcgctgtcctccgccgctcccgccgcgtgtcgcttcgccacgtcctagccgtcctccaccgctcccgccgtcctcgatctctctcgccgcgagcgccacggtggccactcccgccgtccttgccatctcctccatcgcgacaagctcgagccccagcgaccgacgccgccccgtcctgcttcgccaccgctcgcccgatgcttcctcgtcgcggcagtcggcgccgccttccacctccctgcccctccacacctgccaagggagggctggatgatgacgaagatgacgggcagcatggcgcccaccttttcgccatgcccccgccatgtcgacgtctctggccgccatccgcctctccgccacgcgcctgccacggccaccgccgttgctaaccaatagatcataaccaatacttacgttaacttagatcgtattgataaaatacaagcagcagcattcctaaatctaattcgttttggcacccaggtaaaaaactttcacggcattcttttttcgccgggcaaaatttttcgcggcattcttttggataagttgctcagtatatatatctatccctccatctccccactcatctcacactcgtaacagaacacggatctggcgacggccgccggccggtgccgttgcttcgttcttccttggatgcgcaggtgactcaattgatctctaccaattcttcttgttgtctcttttattctttattgaatcaaactattaggtaccccttctgatatccttcccagaagatcgatttattaggtgatgacagaaaccccttctccatagtctgtccttaattaaattcgtccgtctcctgcagtctgctggctgccggcaaggggtaggggtcggactgtgtcggtcagaccttgagttcttgacatataatttataatgccctaactaccctctttcttgattagtacattactgtttcacagaaaaaggttacatgcatatgtaaatttgtacatcttgtatttctagtaattccctatgcagtcaattacttttggttagatgtatggttgacttcagagtttttcttcttcagttaacaattatggtgagagtgccaagacgtttgcggaagttgaacctagatgtctagggtgcagaacatgcagaacatgtggaaggcgaagaaggaaacttgcactacaactttgaagatcaagatgaaagcgataagcaacataatgatgataatttgcacttgcatcttgaacttcaggatggaggcagtgaacttgaagaggaaaattcagaaagtgatgatgatgcaatagcagagttgccttccgcaattaaaaggccaattaatataatctgtaagttttatattttcctactcatgtctttatgtatatgcttttccgtgtgaaccatagtttaaatgttcctacatgtagttccgaatggagaggtacgacagattctaggaaattttaatgtcaaaaacatggagcaattaaagaatggaaaggtaattgtggagacagatgaaaatggtgttcccaatgatagatcaggttcccttcttggctcgtaccttggtaagatggcacaaaattcaacatttgcaccattgcacattccaaaatgggacgatgatttatttgtggagccacaaaagtgcatagtcgcccacgtggaggtgaattctttttactaaatactaacaaatatcatgtttttacttttcacaactaacatctgtttataaatgttaataaagacgaaatttgtctacccatctgagacgaagctacttacaagagattgggtcctaatgaaagttagcaaaggttggaggtcttacaaacatcgtttgaaggatagatactataatcttgatgtgagaactctgaatgaaataccagaagatgtcccaaaaggtgttaatgcaattcaatgggttggtcttcttgcaatttggggtcaagataaacataaggtgatgtctctattttcattttaaaattgtagcccaagttagttggctaatcatttatattttctggtttctatttatagaaattatgtgaaaaaaactctgaatgtgcaaaacaacagaggaatccacatacaactgggagaaaaagccatgctatgctttttaaagagatgggggtaattgtttgactaaaacattgatcttattataaaccagaagcttcctaatggtataattgatccatcttctgatttactttgttgcttaggaagcaaaaaagagggggaaggtccatgagattgatttatgggatgaagcacataagaaaaaagatgcacatatgaaggcagtactggtatattttcttgttattagttgctttcattatatacaatttgtttcacttgtgatgaactacatgcatgtttatttatatgtaggacatggcttatcatgaattagctaaaaggaaaactgatagtagtggtgttctttcacccaaagattatgatgatgtttttcgaagtgttgttggaaaaaagacaaaacttcgagggtactatgatcataagaattggagccatttaaaggtttctcagggactagatgttattgggcaatctgaggaacaagcaatgcttaaattaaaaataaaggcaatggatgataaattagaggatatgagtgatgatatgaatctcatgcgcaccttcatagaacaaaaataccctggagagaattggagaaacattgtggttgcaagaaaaaataaggaagtaagcatctgttcaccatattaatttctttgtgaaaaggtcaatgaaccaaaacaatatgtaagaatcatgtggtttatgtttttgtttcaggtggatatttctgaacaagttggtaatgatattccacatgagtttgaaaacattcttgacaaatcatatgaaaatgtccatcctacaccaaataatttgcaggttgtgcagtattaccttgataattttaaaattgatgttttattgaagtccttatgctgttctttttcataagttgcaggagctgcattctatcagttatactaaagctaaagatggtcgtggcaaaccatccttaccacatgaacacatgataaccaaggtaccttatgcaagtctcattatgctgtaccatgtgctatttttctggtgcatacaatctaactgactttcaattgtagcaatcaggcattataagctctgccaaagtgtctgaatctagccagatgtacatagaatctactagggcacatgacaatggaaataaaaaggtatatacaaactaagtgtgattagtgaacattgaagctctatatctaccaatcctatgattaatttatattgttgtaggttgatatatttgaacaagtcgataacgatagtacaaatggatttgatcataaccctgataatttagatgccaatgttaatgctacatcaaattatgtgcatgttaggaagtgtttacttgataaattttaattcaagctttcacattttctaaatatggtcctttatcataacttgcagcaagtatgttctcttaaatgtactaatgccaaagatcgtcgggccaatccatctattccatatgaacgcacaaatgccaaggtgacctacagaaatcccaccatgctaatcgattatgcttgattgaaacatgtacataactttactgtattttaattgtaacaactgagtttggaaaggttggcccaaaggaccaaaacaagtcagaggaacgcggaatcatcactggtgacccatgagcatgtaaccaatgaggtatgtaaaaactaaatatgtagagatcaattaatgaatgttgatgcactgccatgggttggcaatactatggttctttttaaaaaaatactgcagggttatagttttggtcaagacagtcgtaatgatattacaaatggatctgttaataactttgaggattcacataccaataggaatgccatacaaaataatgtgcaggtacagaagtatttacttcataaattaatgaatcaaactttgccaaattcttaactctattatttatcatttcttgcagaggttacagtctgttagttcaactagacctaaagagagttattctagtcaagatttaccatatcaaaacttgactacaaaggtgtgctatgaaaatcttcctctattacatgtgaggcatttttaacatttatatgatagagtcaactttcaattgcagcaatcaatcattcaaagctctgtcaagaggcctagaaccagtcaaagttttgtggagtcaattttaccacatgataaaaccaaacaggttagattcaaagaattctggtcatatacttgcttgcaatatatagtgatgctaatcaagtaagcacatccatttagtttgattggttaaaatttctaatacaggtccctcagagaaaggaagctgtactcaagcatacttcatctaaatcagtatgtgtttgccattgtttatgataaaaccaagtacccatatgttcataaacgacaatgctctagtttcttgaatgataatgtcctgtttctcaaatttatagggtcaaagggaggtttacttgttttcactgaatgcaataaacaaagacaaactagtggcaaagggaaatttagtgaccgcaaatgccacacatgtggttggaaggaacatgcttggaaatgagtattatggagtggctattcatactgttacaaatattggtgatgaaaggctacctagaccaccatttgaaaattgcaatacattaagagatgcaattggttatgtcattgcttggcctcgcgcatatgtaagattaattatgtcaactctaagtataattttcacacagtaatatttgcatatgtcacattatttataatatctacacttttcaggtaaaaaagcttaggagtacaaattctacccactaaggttggccaattctaacttgattaattgaatttgcgttgttggattttattagtgcacatgtccacaactttaagttattattgctttctctgcaggatattaatggaggattatgaaaaggaaaaagaatagaggaatgcctgatcgcacaactgtctatttgaagaagtcatgtggaatgattctagcaatttagaaaaagaaagagactcgagtcaagactgcagaatgtttatatgttcatattgcacgttaattatttctccatttagtttgagagctatggaccttttatttagttgtaaactccctgttcctacaacattttaatttttaatatgagattttctctttcaatcaggaatatgatgcacgtgcaattgttccatgtacatatagataatagttataaaaaatacatatagataataaatatatgaaatatttaaatcagaatacaagtttgtatacaaataaatacaatgtactagcaaaaaaatacgtacagtattagccagaaaaatcctattgagacagcaaaaaaagtctctacgtacgtgcctatattaattaagacgttgtgcaggtggttctataaaagcgtctctatatttgtagagatgcaatttacacgtctctagcaacgtcttaaataatgtagatacgctttaaaaagcgtctccataattttgagacggtgcaaatagagacgttcctacgacgctttataaaagcgtctcagttatctgtggaagacgaaataaaacgtccctatcctacaaataagatgtctctgttaggttgttttgttgtagtgcatatacatatacaaatttttttatattattttttaagtcacaaagtatctttttgtttttagttatcacacaaacatacacctatttgtgtaaaacaaaaaaaatatattttttgtaaattaatagaaaaactccaggttatactaaagttgaatactgcaagtctgcaactgcgagaaaaggaccgacacaacattcagcttcaagaacgtgggccacggaacccatttgatcgattggatcagctcggcctgcttgggtgcatattgcccggccagcgcggagcccacgtgcaatatccatatgcttgaagtgaaccttaaggttcaacttttctgcttaattccttgaaagaaaaaaaaagacatatctactccctaaactcaacccgatccatcgttttgtagcttaatattttgataagcagctagttagtaactagcttatgagtaggggtggatataggagttggacagctaggactagagccctatttctatgccaaaatatccattgaaattatactttaaaaatggaagacaaaaggcaaatttatgtagattatactagttcggtcatgctcttgagcacattctagctccgctactgcttatgagaatctgaaaatactaggttttacagcttctagcttccacttcatattcgtagattatataactataatttttaaatctaagtaacaatctgatctatttagaggagctgaaaaattttagaaaaagcagcagcaggtagaagctatgttaaacaagaccagaagtggtggcggcaatgttggtggtggaggaggccgggaccgcctagatcatgctggctgccccccttgtctcgggagcccttctcccttctcctcctctagtgtggcgcgagcgagaaagcggccggcgcggaggttgacacaacaaggtggtggtggcggccttggtggtaggttgtggtggatctcttcggccctccttctcctcctccaacgcggtgcagcggtggagaagccggcgcggcgaggtggcggctccatctactcttttattattattattattattttattaaatactatagctaggtgccgaatggattaagaaccggcacctataatctcacctatatccaggagtatcggtgccgacaaatagatatcggcttggaaaaccgatatcgccgtttgatggctgccctacagttaatcctcctgatctcaccaagctgtgatgagccagctgctgcatgccggagatgattgatatgcaagtagctagagtagctagcatggacacgatgatggagctaggaagacgcgagttgacgccatcgcttgcgaatctttgacctccatcaacgtacaccgacgacagggtggtacagctagcgcgctagcagctggctcaaattggctgacaggaccaatcaatcgatgatacactatcgatcaataagaattcagaattaatgatcgatatcggtcgtcgcgtcgtcatcgcatcgaccaataatcatgtcgatctcgatcgatcggccgggtggctcgatcaatttgcatatatgcacgcacgaacgcatgtcaggatctgatattcaactctgtttgataggaatttaatttctaaatttaattctaagaattggattggagtggagttgtgaagcaattttctagcttcacttctctagtttattttgtgatagaggcacttcaacatactctgctcattatttttctggtgaaagtgaaaccatttaagcttcaactatatactagaaaagttgtagtttcaactatggtaatggaccatatagtatatcaatagtctcgttaagctggagctatattaaatagacctattcatcatatccgtcggcagcctcattaataattatatatatgtaacataataattgtgtcagcatcctcgatcgatcttgtgtcctcgtgccggcagattcattccatttgctcatatcgtacttcgcatgatgcattagagcaaatttaatagcatagctaactactggctccaatttatctctatagccaatctaatagctcgtccatacaatagttacatactacactattaatacctggtcccacctgtcatacacacactgcgtcttggagtccgtgctacagctggctacaaatttgtagcccgctgctcttctctcttcttatttatccccttaaaatatatttgcagctggcttataacctgctattgtacctgctcttattaagcagccgcccgctatggaatcaaatcgatcatgaatgtattaattcatggatcgatctagatttacaagatcgtcttgggactaaacacagcctaaacttctaacttttccatcacatcaaaactttcaatttttgcgtcacatcgtttcaatttcaaccaaatttttaatgttggtgtgaactaaacacagcctatatatcgatattggatgcactcatgcactgttcagggacagtgcatatatgatcgatgaaacaacgtcgcgatctgtcggtactggtccagctaattacacgcacacgattttgtcaaattaagttgatcagcttggagaggaacctcgtcgtcgttttcaggctctgatgatgtcgatcttgccatgcatcgcatgcacacacagcgagctgaaaaggccagttggatggtgaagttattcattaattagtggcggaactagatcgacatgaatgatatgatcatcctcattcaaagctactccagcccggtcccgcgcgccgcaacactgagtatacgtttttttttttctttttgaacacactgaggctacaactactttagttttaaaattgttctataatataatataagacgtgcatgtatacatatcattaactaacctatcttttccactaaaatattattatttaaatcctccacaatcaacatatctaattttattgggtgcatgcattttatttattaggataatccaaactatgaggtaataattatttgttggttttgagttaagggtgactatgccttatattttggaatggagggagtactaagcaagcttatagtgcagcaagtcttacagagaggcccctgatagatgggtaaattacactttaacctggaaatatgcaaagaaggacctagaaagaaacagaaaaagcaatcgggtccttctctttgtcatgtccataacaatgatggttggatcgacgcactggtggacgacaataggagcagagaagccatggctagctgcatatgctgatgcctagatgcgaacccaaaaggagcctccctaagatggaggttgaagcacctaaggcaaacggagaaacacctcaaccgcaccttgtaaaaccttcatcggagacgaggaatagaagaccaacgtggatgcagaaagctcgccagagaagaaaaaagtggccggcgctaccttcatttgagcaaaccctgcacgctcttagcttcaggcatagatgatgaacctggaaaacaattgacatggagccatcgtcgaagaagaaaccgactaggaagtcatggccgatgaaactaggatgaaggagccggacacccctttgagctgtacaaaacgggattaacccaactatgggagagacccgagaagtctaaaactaagcctactagtggaggaaggagctagaccccctcccccctcgctagtggccgggaagctgccgggaatggaagggaaggggttaggagggaggggattttttttctgcctatggaaacactctccagccttcgagagaaaggactcctccactgagtgcacgttcaaaatagttttatgactgtactatgtacataaagagaatggcatatgtaagaacgtattacactactcaaaaaatagcaattacactccccaatccgccgccgcctccccaccctcatccctcctgctgccttattgctgtacaatagttcgacaagccaggatggtggtggtggggcccaatttatcccggtggttcatcgactctgctgtggaggaggaggtacaacacgtgtcaaagcggtggtgcacccggtaagtgagatcgcgaatccggtggcaccatggctagatctagcggcccaacagccagacctgcacacctccatatcgggtctgcctggggtcaagcagaccagggaggccgatacagctggacatggtcggggtgacgatagcaagaagccaacgtgcgtgacaataacaggcgagtggcatggctgacgagggtgggaaaggtcggtgtggctgattgcacaatagcatgagaggccagcatggctttgatagtagatggccgatgtgggtggtggaggctggcggccggtggccaatgcggacgatgacaggcgtggcgaacgttgacggcgatccatctacacccctattttctctccatggagctcttcccctactatatagccgatccttccagtcatgaggaactctattggtgagacgatagtggtggtagctgaggaagaggacactctagcatcgcagctttgtgaagggatggcatttctgcaagaggtggtgttggcttgcactatagacccgacgaaggcgggtctgagctggccggtggttggtgtctgtgtggtggagccaagggctagcagaggttgttcgggtggaggagcattgagctgacaatggcgggtgagatacgtgaaagcctagctcgggttctcctgagccgacaacaatgacgaatttgagcatcatgttcctcccttagggcattggtgagcttccaccctttcattacgtgataagactctctgggtgaaaactaagtctagatggatggacaatggtggcgcctaagatgtcatgatctccctagaggcctgtctagaaggtcttagttactcaactttgctgcctcatctcggtttggtcttagtagttttttctgggttgtcgtcattaggttggtgcaagggatgagtggatcttcttctctctcaccccctccctccttaacacctatatgcgaggatggccgggaacttgtcaactatgtagagtgagtgtttccgcggggtgttgatcggtcacgcttagtgatggccgacttggtgccagtacttctttttttgttcacgtgagtaatacgagtactgtctgatgtgggtcgtaaaaaatagcaattgaagcatatactggtttaatttgtcttttttaataccagtttgtgataaaaatcggtaaaccgacattaaaacctgccaatccaagcgaattaagccaaccaagcggtccccttttgcgggcggctaatggtcagttctttttaaataaataggcaagagcctatgcattgcaatggaacataaattgagtttcaacattattaagttaactaaggctgttttcgggaggaggggttg

SEQ ID NO: 32171 - DNA, 3786 bp, Oryza sativa
ctcctcccctcacgcaaaacaaagctcgtattattgcatgattaattaagtattaactatttttttaaaaaaatgaattaatatgattttttaaaacaactttcaaaagtttttacataaatcacaccgtttagcagtttgaaaagcatgcgtgtgcaaaacgagagagatgggttgagaaaatagggggagagggaacacaacctaagcatatatttagttattttagttattcagtccaagtagtgctcttatgatattctttattatcgaacaagtacattactttgagatttagcgagaaagccaacagtaaaaacgggagataactcgttggagcgtggtgtaatagtataaatgtggggtctaaatgttagtggtagaggtgagatatggacatcagtattactagtatagagggcttgttcggtaggcctaaatatggccgcaatacagctagccgtaacagtattgcacatataatctcatttgctactaaggcagcagctgcagcagcagcacagctgcagcaagaattgcagccgaacaggcccagatttgttggcttgttgaaacggattattcgctccacgcttaaaaatatacacttttagtttttaatatattattggttagatttatttattaacatatttaatttaattttcctctacaataagtagatatctgtagcaacaatctatccagtaatctctttcgagcaagagtctaaaatccattcccctctctcgatctctgctctttccaccttcctatatatctctttgcatcagctagtgaaaaccacgtagctatcccacttgcatccctacacggcagcaggaagatcgagctatgtgaacgaggtcacgctgtcagcatcgtcgatccattcgatctgcaatacatgaatgtattcgattgtagccggctgtgacaattttaagaggatttatggaagcaatcatgccatcgtgtccggcatggagaaaatattggggatcgatcgatcgatgcatatatatcctgtagtgtgttcaaggacagtttgatggaaccacgccgcgctctgctctgtcggttagtactccagctaacacatgctcttcttcatcattcatcaattctctctttttccaaagttcaacatggaaacgcaaccagtcattttagatctaagagcgagtacaatatcgagataaagttagctgtaaccacacgtagagaagagaagagagagaaggaaatcgggctacagacttgtagccagctgcaccacggactctaatagtgtataagaggtgggaccatatattaatgatataatagtatatgattatagataattattgtatgaatgagctattagattggttataaatgaattggagctattagagcaagtttaatagtatagccaactgctgactgcaaatcatctatagtcaagttaatagccaattcatacaatagttatctataaacatatactacacaatcaatatctggtcccatctgtcatacacacatgcgtattggagtccgtactgcagctggctacaaatctatagcccactgctgttatctttcatcttttatctatttaaaatatacttatagctggcttatattctgcaattgtacctgctcttagttgtctattaaacttgctcttgccaccagtcgagctgaaaaggccagggatagcgaaatttcattgacgatgttagacatgaaaattggtcatcgactcatcgtaattcaagcttgttttgtcaatgatccgagtaatgtgtgcttgagaaaaaaaatatataccagtgattcagacgtacggacgaatgcagataattacctcacctgaaccaaaattttttgaaaagacacgaaatatatgaatcaacatatacgcgtattggtactaattgctagtaagtactcgtactatatatattacagtatactttcagcgagcccaatttttctagagtaggtacaatagcaaactagccagttataaacatatatattttaataagataaaagatgagagagaaaagtagcgggctacagatctgtagccaactatagcacggactctaatatgtaatgtgtgtatgataagtgggaccatatattaattgtatagtaagcaacttattatatgaattgattattagatcggctatagatgaattagagctaggaatgggctataatattaaacttgctctttggctgctgctacgtaggactggcgtacgtgtcacccagaatatcaccaccgtttcaatcatattcataatgcacgatgattcttttccgagaaagaaactgctgaattgtttgtataaaaataaccttcattagtccaccattagtttcttcactggatcagttcacgacttcacgtacagacatccattcaatgattgcagccgaaagcatcaacaagtgattaattatgatggttgaaaattaaagctacctaccctcaagtcttaacctttgactcgtgattcgtgaatatccccatcatgcatccgtgctcgtgtgcaacaaacagagtagtacttcctccatctactgagagcaaatacaatagcaggctataaatcaactataaacatattttaaagagataaaagaaataaaataagagcagcgggctacagatctgtagccagctgcaacacggactccaagacgtaaagtgtgtataacaggtgggaccatgcattaatagtatagtaagcaactattgtatgaattgactattacattggctatagatgatttggagctagtagtggcctatactattaaacttggtctatggcattaattatattgccgtgtagaacttttagtttatgtggcactattaattaagagagagagtgaagagaggaagaaattgggtctcatgcaagacacagtttcaacacgagaacctatgcactaaacactatcaagttttacattgggagagaatagtgtcttcataatagatgaagaataaatatgattggtagagaagagagatgatgtatttatcaatgacccactttaagaaatcatgggttgtggagtttagtttctattgtgatgtcttattgacattgcaccatagacactgcttatgtacactatgagttgggactgccctgatagttatattttatcttggcacatagaccaagaataagtaattctatcattcatttaatgttcctagttattcctcgtaaacaaacgattcattaatatttacatttctcgaagtccatgtagccaatcttacgtggaaaaatggagaatcacgcattaaatccgagaaagttattaagatgataggttgttggattgaaatatgcctataaaaataatttttttagatttgaaaatatacctatcgaaaatagatggagggtgtaagaaatactgctgacgagataagataatcttttattttggtgagatgcatggagatgcgataaatatccaaatctagtgtttagtggagattaatgatctgccttttgcttcctaaaaaaaagaaaaaaagaaaaagatctgccttttgctaatgctggacgcttaactgcagattgtggcattctgctaaaggaataatatttatttattgatgggaccaccgtaaatacgtgaagctgaaggggcactatatattactggatttttcacattttggtccttttgaaaaacttatttcgcaaatagacccctgaaaaaacttatcccacaaatggtcctttttggggc

SEQ ID NO: 32172 - DNA, 2200 bp, Oryza sativa
gtcggcagggggacggcgccaaagaggctggcgccgtcctgttgaacaacggcgccagccactctggcgccccaaaaaggaccatttttaggataagtttttctaggggtctacttgcgaaataagtttttcaaaaggaccaaaatgtgaaaaatccagctatatattaacccgttcgtttctccatcaagatatggataaaaacttcgatactcatgacacgctttgtaaattgctaaactatacgttttcaatatgaaagtttatctaaaatatcatattaatttatttttaagtttgtaataactaaaactcagttaatcatatgttaataccatctcgttttgtgtaaaacacttcaacttcatcttcatcttcatttactggagaaaagaacaccacctattagaagaaaatagacatcttccgatcgaaatatttaaactgagaagaaaataatttcatgggaccatgtcttgtaataaatccaactgtcttattttaattagtagtacttatacctatgtgggtccaattaatcagataccggttttatatatagaattattttctaaattaagggatacgtgacacaaacgcatgtataaccatcatttcaaggtccatttagaactcatgaaaataaaagatactttaaaaaatggggaatgctcttgaatggtttcaaggtccatttagaactcatgaaaataaaagatactttaaaaaatggggaatgctcttgaatgggcacccgatccagactaaaaaatagaacggtcctcatgctatatctctcatgctccgccatcaactttgctacgttaaacattcatgcatgcactactgcagagtttctctctcatctcctcaacacgtgtaacattattttaaaactttaagtatttttttttcttataaactacttatccaatttatgatgcgattaaaatattatatttgttgcaattaaatctttatagaaagatctcacataattatattatgataaaaataatgtaaatgtttcacactattaaaatccaatgtttcatttataataagtagatgtttcaactagaattcgactatgttgcacattttaagtttttatgttgtaatgaataatttttgaatattgcacatggtattatttgaatacttcagtaagtaattttgacgtttcactagttcgcagatgttgtttgtaatgttttagtaagcatttcgtgatgtttcaccgtttataaatttatgttttatgtataatataaaaatatttcaattagcaatataatcgtacatatatttttagtcacaaatatagtcatgtctggtcttattttaaatattaattacaataaaaataaagatgcaaggaaaaagtacgaattaccccccgaactatcgcggtcgtccgaattacccccctgaaccacaaaaccggacattcttcaccctcaactatacaaaccggacaaattaccctatacaaaccgaacaaattacccccctcaacccaatctgcggtggttttggtctacgtggcgtacatgtgacagtccagtcagcattctatattaaaaataatgtggggcccacctgtcatacacactctctctctcactctcctcactatcttcctatctctcacggtcagcgacaggcgggggcagttgctgagggctgcagcctcggcgcggaggcagcgggggaggcggctgagggcggcggaggcgccgccggcggtggtgctgccgccgcgtcgccgctcagcctagatggtcaccggcgacacacgtgcggcggcggaagaaggcacgcggcgaaaggggagaggaggtgcgtgcggccagggcggcgactcgagacggttacttgggacacgggaagggcgatggcgacaggaatcgatgaggagaagggccgacggcggagcgtgattgcgctcggcggcggcgggaggggaggcacggcgcgggagctagtggggaggccgacggcaaaggcggcgggttggggtggttcaagggagctccaggagggtggtggcgcgaggaatcggcgagggagaccacggcggcgcacaatcgagcgcggcggcggtgaagcagagcaaaaggggaaacgacggtgcacaatcgagcgcggcgacgtcggacggtgacgcggaggcggtggctgagggcggcgggggcgg

SEQ ID NO: 32173 - DNA, 38904 bp, Oryza sativa
aggtcaccgccctcagccgctgccccagcctaccactgaccgtgagagagagaggaagagagaggaagagtgagagagagagcgtatgacaggtgggtcccacctttttttaatatagaatgctgactagactgccacgtgtacgccacgtggaccaaaaccaccgcggattgggtcgaggtgggtaattcgtccggtttgtatagttgggggtaaagaatgtccggttttgtggttcaaggggtaattcggatgaccgcgatagttcgggaggggtaattcgtactttttccaagatgcaattagattctagatcaaataaatagattacgagaaaaaatattttgaaggttgcaaaaagttcctagaaggcatataggattgtgcaagagagaaagatttagggcccctttgcttcgcaggataggaaaatcacatgaataggataaacgcatgaatcgaagtagtaacaccgaggcagaataccaggttacactaagaaaaatgctttgtagagatatttttctagtattatagaggcacttttcaaatgcctttacaatactatagagacattttaaaaaatgtctaataagtgtcttatggtgaattgtctctacaaacgaagagtcattttataaaatgtctataagatggtagaagcattttataaaatgtctataagatggtagaggcattttctagagacattaaattgtaccacaaacatatgaaaccaggcaaaaaaggagaataaaatagtttccttgcttttatcaagccttgaaacttaagatctcttggacaaaccatttttgtcttcaatgcactagccaactcaactccatgttattacttggttgtttgtgtctttagttacttatatttagtcctttagtacacattatcattctaaaaaatgtctctacatagtttaaaatgtctctacatagtttaaaatgtctcaagaaaatgcctttacatatcaggcgcattttacagtgccaaaagaatgcctttacaagataaaatctaataaactgagctgaaaatgtctctagagtaaaagttttctaggcaatttttaaagtgcctctataaagtgtctctacactataaaacttttgatcttagaaacaatttgcaaaactcctctacaaaagtacctctatatgaggtttttgttgcagtgttacatttggctcgtcagcacaactactacactaagaggataccaagccactatattttttaatgatactttgatggtttaaattatcgcataatctttctatcacgcatgatccctcaatttattttctattgaattagtcacttttaagtaagatttacaatatgtttgatcatatattgtaattttgcaactaatatttatgatgtttgattgtgcattataattctacaactacgtacattatgcataccaatatcacatacaagatgtcatcgatcaaccagtagatcaaatatagtaattacggatagatgggtgataatttggactgtatgaatcatacaaaacaataataatcattttgttgtatatcgccaatataatattgccattgctcgtgggttgccttggccgttcataagcaaattaaaccagagcttgaactggattttctttttcttattgtgaaatcaacactttttagaagtggagatgaagctgatggaggaacaaggctagccaaccaacgtgtggaagctattgatctagttgatatatgcgtttagaagctgaaccacaagcattgtaaacattagttattatcgacattggcctcgtgacctctatcttgccatcgattgagtgcaattctgtattgttggaattaatagatgggctaaggcccattcgaagattaattctttggaaaatcacaaaagcccacctcatgggatggcatgcatgtggagtttagtaccaccttgcttattctaggagagggggacctccttaaaagggagtataccctcctagccacttgaagtatgtgtggtggagagaagagggggaacacgcgctcgctcgcctcgcctggcaaggcaggcggcgcgtgcacggcatacgcgtcgaatggttcggaaaattggctcctcacccttacgcagatgcagtctccttttgcagttttgttttgctgcaggaaaattcggatttgttttgttgttggaaacattccgaaaaatccggtgcatgaaaacggctggagtccggataagttacgcgcgtcttatccggctcggttacgtagagtggagatcgtgcgggcgccctgatcaagcgatccatctctatataaaccgtgccgccgtcttcacgcaacacacgcgaaatccatctagggttttcctcctcctctgtgttgcgccgtcgctcgtagactactccatcccgcttgccagcgtgcaccggtgaaagggagagcaggtctccggaacctatgccttcgatgtcctgcaccgggagaaggcggcaataaggcttttgggaagcgcttcgcgcgactgctccctattcgttcgcgacggctcgccttcctctccgctcgcgtgctgcgcgccttcgtcgacgcttgcaaccgcgagtagttcctgccgagcaaccggtctttccgccacctcggtacatgttcgacatgttgcgcatatttgatctgttcatgttttactgcttagtttacatgtgtagatataatgatgcgttaatgctagtatacatctgtaatgtcatgatttatttatggaatatattaaatcattatatgcctatattctcaacaatccaaaaaccttattataggcgctgtgattttactatggctggttttgccgatgcactgaggccggataaatttaccggtatgcactttaagagatggcagatcagggtcactctgtggctgacagctatgaaatgcttctgggtaagtactggcaagcctatgggcgttcttaatgctgatcagcagaaagaattcgatgaggccactactctctttgtgggatgcattcttagcgtgcttggcgatcgtcttgtcgaggtgtatatgcatatgaccgacgctaaggagttgtgggatgcactgaatactaaattcggtgctactgatgctagcaatgatctgtatatcatggagcagtttcatgactacaagatggctgacaaccattttgtagtcgaataggctcatgagatacaaaccatggctaaggaactcgaactccttaagtgtgtcttacccgacgaatttgtggtcgggtgcattattgcgaaactaccttcatcttggagaggtttctgtactgcactcaaacacaagagacaggaatactccattgaggggttgatagcgtctcttgatgttgaggagaaagctcgggaaaaagatgccgcgtctaagggcgatggtgggcggtccactgccaatgttgtgcacaaggcctagaacaagagcaaggggaaatacaaagctcagcagaccaccaacttcaagaagaagaagaacaataacaatcctaatcaggatgagaggacttgctttgtgtgtggtcaacctggctatctggcaagaaagtgtccacaacacaaggggatgaaggcacctgcagggcagacctctaagtctgccaatgtgaccattggcaacactggagatggaagcgggtatggtaatttacctactgttttttcagttaatcagtctactaattggtgggttgatacaggggccaatatacatgtttgtgctgacatctcattgttttcttcttatcaggccgcacggggttccaccgtcctaatggggaatgggtcacatgattctatcgacaggaatcttgttagtggctcccgtctgactagagacggatttaagttggtttttgagtctaataaagtagtcgtgtctaaacatggatattttattggtaaaggttatgagtgcggaggcctgttctgcttttccctttttgatttctgcaataagtctgtgaaccatatttctggcagtgtggatgatgaggctaatgtatggcactcacgtttatgtcatattacttttggcttgatgtctcggctttccagcatgtgcttaattcctaagttttccattgtcaaaggttctaagtgccatagttgtgtgcaatcaaagcaacctcgcaagcctcacaaggctgctgaggagagaaacttggcacctctagaactcctacactcagatctctgtgaaatgaatgggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaagataaaaagactttggtctgatcgtggtggagagtttttctcaaacgagtttgacttattctgtaaggaacatggcattatacatgagaggacgcctccctattctcccgagtctaatgggattgctgaaaggaagaaccgcacactgaccgacttggtgaatgccatgttggacactgcgggactacctaaggcatggtggggggaggcattgttgacctcgaatcatgtgttaaacagagttcctaacagaaataaggacaaaacaccatatgagatatggattgggagaaaaccatcactttcttacttgcgcacatggggttgcttggcgaaaatcaatgtaccaataacgaagaagcgcaaacttggacctaagactatggactgtgtctttctgggatatgctcaccacagcattgcctatagatttttaatagttaaatctgaggtacctgacatgcatgttggtacaattatggagtctcgtgatgctatcttctttgagagctttttcccaatgaaggatacacatagtagttctagccaaccctctgaaataattcccagttcaatcacaccaccagaacaaactgaatatacacatgaatatgtcactaaggatgatgacagtgaagctcctcgaaggagcaaaagacaaaggatggctaagtcttttggtgatgatttcactgtgtacctcgtggatgacactcctaagtcaatttcagaagcatacgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagctcaggcctgacggtactattgaaagtacaaggctcggcttgttgctaagggctatactcaaaaagaaggcaaaaatttctttgacacttactcacctgttgctagattgaccacaattcgtgtgctactttccctagcagcctcacatggtcttctcgttcatcaaatggacgttaagacaacttttcttaatggagagctggatgaggacatctatatgaatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggtagataaatgtgtgtactatcaccatggtgggggtgagggagttattccgtgcttgtatgttgatgacatactgatatttgggacaaaccttgaggtgataaatgaggttaaatcattcttgtctcaaaattttgatatgaaggatttgggagtagctgatgttatcttaaacatgaagctaattagaagtgagaatgggattacactcttgcagtcccattatgtggagaagatcttgaatcgctttggctacattgataataagccttctccaacaccttatgatcctagtttgttgcttcgcaagaacaagagaattgctaggaatcaactgcaatactcccaaatcattggctcattgatgtacctggctagtgcaactaggcctgatatctcctttgctatgagcaagttgagccggtttacctctaatccaggagatgatcactggcgtgcgcttgagcgagtaatgcgctatctgaaaggtactatggaattggggtttcactattctgggtatcctacggtactggagggatatagtgattctaactggatctctgatatggatgagatcaaagccactagtggatatgtcttcacactgggtggtggtgctgtttcctggaggtcttgcaatcagactattttgacgaggtcaaccatggaagcagaactgacggcactggatactgctactgttgaggcagaatggctgcgtgatctattaatggatctgcctattgttgaaaaaccggtgccggctatccttatgaactgtgacaatcaaacggtaattctcaaagtgaatagttccaaggataatatgaaatcatctagacatgtgaaaagacaagtgaagtctgtcaggaaattgagaaactccggagttataacgttggattacatccaaacagctagaaacctggcagatcccttcacgaagggactatcacgaaatgtgatagataatgcatcgaaggagatgggtttgagacccatgtgagttatactatggtggtaacccagtctatgtgatcggagatcccgtgaattagaacctgggaagaacaaaccattagtaaactagatgagagtaccaatctataccctttctaagtgaagatgcatgtactctcgtgagctgcaaggcaggttggctatgccttaatgagttctgttggctttaattagcgaagatgctgtcctgcagagcattcttgaaagaactcacctttgtaagcttgactgttggtcgcagtctatgaagattttgggtgaatcttctaggaagtttactaaagacctaggagtatgacttatacgctccacccgaggggtagactacagacggtctagtaccagataagactctgagtgaaacttgcttgcacaagactttcaattcaaggcgtagtccattgttcaagttgttagtaagtgtagcttagagttctaggtggatgttcaaccttaatcggtctccatcgaaccactggtatataaatagtatattggaaaaggcaaatctcagtgggattttgagatttggtgggggattgttggaattaatagatgggctaaggcccactcgaagattaattctttggaaaatcccaaaagcccacctcatgggatggcatgcatgtggagtttagtaccaccttgcttattctaggagaggggacctccttaaaagggaggatgccctcctagccacttgaagcatgtgtggtggagagaagaggggggaacacacgcgcgcgcgcgctcgctcgcctcgcctagcaggcggcgcgcgtgcacgacgtacgcgtcgaatggtccgcaaaattggctcctcacccttgcgcagatgcagcctccttttgcagttttgttttgctgcaggaaaatttggatttgttttgttgttggaaacattccgaaaaatccggtgcgtgaaaacagcgtggagtccggataagttacacgcgacttatccggctcggttacgcagagtggagatcgtgcgggcgccctgatcaagcgacctatctctatataaaccgtgccgccgccttcacacaacacacgcgaaatcaatctagggtttgcctcctcctctgtgttgcgccgtcgctcgtagactactccatcctgctcgccagcgtgcaccggcaatcgggagagcaggtctccggaacctttgccttcgacgtcctgcaccgggagaaggcggaaataaggtttttgggaagcgcttcgcgcgactgctccctgttcgtccacgatggctcgccttcctctctgctcgcctgctgcgcgccttcgtcgacgcttgcaaccgcgagtagttcctgccgagcaaccgatctttccgccacctcggtacgtgttcgacatgttgcgcatatttgatctattcatgttttactgcttagtttacatgtgtagatctaatgatgcgttaatgctagtatatatctgtaatgtcatgatttatttatggaatatattaaatcattatatgcctatattctcaacatgtatgtgacatggaaaattcatagggtcatctttgccgaaagggagtatctatagatatgttgacacatttttttagtaaaaaaaatggtccatttgttttagtaaaaaaattggtccattttattcactagaatagctagagatgaatgatcaagctcaaccaaccttaaacttaaaccatttacttgcacaacaattagaagttcttgtttacctattaactacatgcttacccatatgccaactgtcttactttgttaggatgcttttacactacaaacgactacacgccatagtgcttttacataaaaattgcagtgtaattaggatataaacaattatagtgtaactaggatgtaattatattgcatatggataatataatttctatgtttttcgtgaagttagcatagattaattaactagttaggtttctgagagtggaatctgcccactcaagtttaagttctaaacttgatatgtgtgttcgaatttacggcttattattctttcaactaaaggcgatgtatccattaacattgagaggcatgtgatgactttattaatcttatgatataaaaaccaactagattcattacattgagcagttggaactaggggtggtaacagaacaagatccatggttccttccataaatcttatctgggaaaatatatggtagaaacttagaaactgccgttggatcgaaaaatggatttataagattcgtccacgtcatcacgagtaaaaattttactcatagtaaattttttactcatgagtaaatctatgagtgaaaattttgctcgtgatgacatggataaatcttgcacgtctattttttaattcaacggtagttttcaagttttcacaacatatatataaaagtatagttataaagttggacccattatcgcctctagataggaatagaatttcacagcgttggccatgggttgcaagtagctgcccagattagttaatcggtccttatcccacgatgcccctgcaatcctgcatgaatcttgcaaaggatcaagtggcccaaaaaacgtctgcaacctggccagaaatctatagacataattccagcaaatccattgccaaaatgggattttacatcaattctaacggcaattaatactccctaattctaatatgttaaaaactacaagttatagcaacttgtatccaatagcaccaatatacaacctcttcttttttttttagaaacacggtacaaacgcaggcgctcacaacgcgcgtacactcacccctatcccactggtggagaaaccctttgtagtcccggttcgtaacccccctttagtcctggtttccaaaccgggagtaccaatccgggactaaagatcgctatctttagtcccgggtgaaataaccgggagtaaagatcgatctttagtcccggttggtaacaccaaccgggactaaagatcgagctgactttttttttttttgcatgcccctgttgctgcatggtttatatatatatatatatatatataaaccatgcatatatatgtttcaatacatatatatgcatacatatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagaggatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgatggtacctgtctataagtttgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaaataaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagatacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggccttcttgacagatgcagacatacccctgaagaagttcctgacactggggtctataggaatcttcttttctggacttcgaggcttgaattgtctcttgacttctaatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctagcggagcatgaggaggagacggtgcaggatcctgaggaggagatggcggagccggaggagatggtgcatgagacgccgcttgtcgcccagggaggatgatgtaccgcctgtgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacagtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcaagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcggggtcagccatctgttgatacatgaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggcaagctcttccactcaggcttgacggacgactccgacaacacgtcttttctgcaagatacaaaaaaatgtattaggataaatgcgaagtaacatatatatatatatatatatacatatatatatatatatacatatatatatatatatatatatattgcatttcacgttaacgttcgtcctcgttcgttcgctcgttcacgttccctagctcgttcacgttcgttcgctcgttctcattcacgttcgttcgctcgttctcattcacgttcgttccctcgttctcgcttgtcttcgttcgatcgttctcgttctcgctctcgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtgggcgcggcgtggcggcggcggcattgcgcgcgcggcggcgaaggcggcggcggcgtggcgacggcggcggcggcatggcgttggcatgcggcggcggcgttgcgcggcgtagaaggcggcggcgtggcgcatcgtcgtcgtggcgcggcctctcgtggcgggcggcgcgacggagagagatcgagattggagagatcgagatgcatgaagggagatctggcggcggcggctctcaccccagagatgcggcggcagcggaggagacggaggcggcggcgaggacgacgagctcgagacgacggagagatacggcggccgtcggcgcggggatttgccctaggcagtggcggcgaaggagagaggccgagagagatcgatcggccgaaaacgtttaagtgttggtgaagaagacgagggcgcaccgggaatatatatacccctggatctttacttccggttgttctcaacaaccgggactaaagatatctttagtttcggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagtgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaatatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaatatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatagcaccgtaatacgtggcagttgttccatcgtgtcccatggcatcgacacgaacaacgctgttttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcaatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcaccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcacactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcccagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgagagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaatataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatcattagtcccggttggtattaagatctttagtcccggttggtaacaccaaccggggctaaagatcaccgggataccaaccgggactaaagatcccgggggggtctgataggtcctgacagcattcgaaccgggactaaagatgatctttagtcccggttggtaacacaaaccgggactaaagatcaaatatgcccgtttcccttttgaaccaggactaaagatcatctttagccctggtttttattgcatccgggactattgtggaaatcggccgaccgacgaaagatggtttctccaccagtgacaggaccttgataatttaggtccagcaatcaccagcaatgtctttcatttaaaatcacttgtcatctttcaaaaactccatgttcaaataccgccgaccagcccacgaaaaaaaaacatatgtaacgctttcgaatcacgtagcaatgtaatcaaatacaaactgatttgtgttgaactaatcagaccttcagaattgagcatgcctcttgctcgattcatcgattgtgattcagtcagggatatagttatgtgtgtctggtggtggctcagtgggtggcggatgttgattgctcggctcggtggcgtgctatgagcaatgttgagcgcaatagcggcaccgagaggggtgggggaggtggtgttaggccagtgtcgatggcgtggaggcggcggatccctgacaaaataggctttgatggcagctcggcggaggtcatgtcttgcagagacaatgccgttgtggcaacgactcttcggcaagataagctatggctgcttggcggttgctgtggtttgcaatgatgacgatgtagtagcggtggtcctccggtgagataagctttggtggctcggtagagcggtgacaacttttggcgatataagctatgacaactcagcataggtggctctctgcagcgatgatggcatggcaatggtggaatctgtgaaggagtaggttgtccaggaggcatgagtttttgcttggcaactacaaggtagttggcggactagttttgctttctttctttactcaatggcggatcaaaggagcttttgtagttgatgcaacaatagtgagagggtgtggcaattgaagggtgggctagcctcgcatctccttaaaattttaagcagggaaaaaagtttggtgctagtattctagtttttctttccagttgttcgtttgtctatgtttcttggttatgagatttagagtgtaagaactcgtgtaacatttgtctatgtatatccacttgtgaatatagaggccgaatttctatccattatcttgaaaaaaagactttcaggaaaaaaagagttcaatgtttaagatgttgggattgaatcactcaatttccctttggaaccattcactaattccactcacggtaatattgctcggtagtaagaatatactctctccgtttcacaatgtaagtcattctagcatttcttatattcatgttgatgttaatgaatctaaatatattatcaatatgaatgtgagaaatactagaatgacttacattctgaaacggaggaagtactatatatactctcccataaaacacattgttaatatattcatttaagttctaaaatgattataactcctctgcatccatttcaggttgtgatagggacaaattgcaatcgccagcaattacaactgtaaactagcagacaatgtatcaaaaattttggaaacagttttgctatttcacttgtgacagatttttgggctcctatttttcactttttcatccatagtatcttgcatcaagattcgtattctagcttgtatatccaacatgcacttatacccagtcatatagcacttatactcaattggaatgcacttatactcatttaaaatgcacttatactcaattacaaactataaagcaccaaaattagattttataatagttcttttctctagatttatggtttttgacatgcttgtctctttttcatttcatttaaaacgtgctatattcattgattgaaaattctgcaagatttaaagctataaatgtaaagcaagatcaatagataattaggtagtcccttttgcaacttagactgtgttcgtttgggatggttgggaaccaaactcctccgcacagaaaacggagcaatccattagcacgtgattaattaagtattagctattttttttcaaaaatggaacagtataatttttttaaacaactttcgtatagaaacttttttgcaaaaaacgcaccaaaataacagtttaaaaagcgtgcgcgtggaaaacgagaaggggagttgggaaggaaacgaactgagtcagtcaggttgagcctctgcttttgttgatatcctcttaatgtcctggttaattatttgaagctaatgatatgcaaaactttggactgaagccgatgcatacatagttgctgcttggttcagttttcaaaaaaaaaaaaagaagaaaggttgagatacatacttgtccttgatccggtagatattgttaagggttcacttgaccaaaagggctctagctaacacatgccaagaatttcaggacccggtcacccagacatgaaaaattgaaaactctaatcacttgcaacgcaaagataaccacggattttcctggcgaataccaatgatatgatattttgacattttctccaagatagttttaattagaatacactccctttgtcttaaaacactattgttttagacgaaaaatttctatactaattaatgttccatcaccaccacccaactaccatacggaacccacaaaactgtgggttgcttatcttttagcctctacatatcatagatcccaatattatgattttttcatctttacaaaatgacaacaaaattatcataatgataatatattagataattaaaaaaataattgcaacgcacaggcattgtgctaatgtcttataaaaaccgtatttttacagtgggttcactaaatctttttaatactactttatcattaccttctctttagctatcgagtaattgtcaacattgccagtcatttaaaaaatagtcagttatctaaagatagagcgtttttttttaatttcaatctatgtaagctaccgttttatcattttaatctaatttggattacttccccttttggtaaaaaggaaaaaactgagcacggatatagttggccaaaagacccatagctcgacgacccggtctacggcacggagatttggtccgatcgaagcacagtatggcccaactgttgtcgggcccataccggcccaacctgattgttgggccatgccggagtctcttccttgacacgatggaccggtctggcacagctcggtccaatagatgtgagaggcaaaatagacttatttcaaccatgtatgatatgaccccaagaaatgaggaaggcaaattagacttgttccaagaaggagcacgatagacttgtcgtgccttggggctggcctgacatggcccaagtcttattgggctatacctgaactgttggtgcagcctgtgggcaggcacaacataacccgacagtatgtcaatcgggccatgcctggttgtgcccaggcagactgggctgtgcggtacatttggccatctataacccccatattcaacaaagacacacaactttccgagtagcggtattttttccaagtcaacttatgctggccattttgcagcgggtccagtcaacttatatgggcactgttatattgtgtcgtctccttcggttttgctagaccagaaagacttgttaatcaaaggcaggctattaattagcactggattcttcagagcttaatgctcattcgatcaggcagaagtggcctaagcaaatgccatttaactaatttcttcaaagatatactagcagtattatattttgactcctaatttgacttccgtatccaagaaaaagtcccaatggctgtggaaggaaaaaaaaaactgtattaatttcttgaccaagttactctttgttgcttccatagatgattgatctctcccatttcgtggctatatgtgatctctagtagtgtcttccatttctctgacatggttttcctttttattaattagattagatagtttgaatgtttgatatctcaaattgcagctgcatcaaatctttcccgccttagccttgtaggttgattccatttcttgtccatggcgagagcggattcagctggcgctggcgctccagaagccattgatggcgagctggtggagctggagctcggggagagaaacaatggcgtccctcccgtcgccgaggaagaaggcggcgagccaagacccggtggccggccgccggcgtcggggcgccgcctcctcaggcgactcagcccggcatccgtggcgcgcgcgtgcgggcggtggctgaggcacccggcgcacctcgccctgctggcgtgggcgctctgcgtcgcggcgtcgggcgccatgctcgcgctcctcctcctcggcgccctcgacggcgcgttcccgcgcaagtcggcccgcaaccggtggatcgaggtgaacaaccaggtgctcaacgcgctcttcaccctcatgagcatctaccagcacccggcgctcttccaccacgccgccatgctcctccggtggcgcccggacgacgtcaaggcgctcaggaaggcgtaccgccgccgccggaaggccgccgccgccggagacggcgcaggggggtgggagcggcttcacatgtccgtggtggtcgcgctcctccacgtcgcctgcttcgcgcagtacgccatgtgcggcctctactggggctactcccgcaaggcccgcccggacgccgccgagacctcgctcgccgtgatcggcgccgcgacgccggcgctcgcgggcctgtacgcgtacttcggcccgctcgggaggaggaagcccgggacggcgacgagcgcgcgccaccaggaggaacccgacgaccttgagctcgccgccgccgccgccgccgacgtcgtggtcgcggagtgggccggcgggctgctcgacgtcggcgacgacccgacggcgtggtggctgtcgtgcctctgcacgttctgcgtgttcgggtggaacatggagcggatgggcctcgggaacaagcacgtgcacgccgtcacgttcgcgctcctctgcttcgcgccgctctgggtgctcaacgtcgccgccatgaacatccgagacgaggccgtcggcgacgcggtcggcgcggtggcggtggcgctctgcgcgctcggcctcctctacggcggctactggcgggcgcggatgcggcggcggttcgggctcctccccgggcggcacggcggcggcggcgcgtgctgcggctcgccgtcctcgctcgccgactacctgcggtggatgttctgctggagctgcgcgctggcgcaggaggtgaggacggcgaacgtcctgctcctcgacgccgacgaggctggcggcgccggagggggaagctcaagctccggcggcggcgggcgaggtgacgccactctgctgcagccgttgccgcgggagaacggggtgaagctggcattccatcatgcagctgcagtgccagtggacacggacgcggcctacgggccgccggtgaacggctcgccacaccgcggcagcggcggcggcggcgatgagtcgccgttgctgcagaggcagcagggtcgcgagtctcaggctgaggaaatgaggccgcctctgcagccattgatgacggaagcagaatgccgacgggttcagtaataatgccaggagcaatgcgtgcgacagagtccagaaatgatacgaatatactagtcgatttttttgccctttttctctctctctttcagcttgttcttcaaattgcatttcaaacattcaatttcgaaactgtcaatatttcttaagattgcatttcaaagatccaacctcgaaattgatgaacagagaggctcaagaacattttgtgttccatgtctctcttctttgctctttcaaacaaaaagatatttgcttggatccaataaaaagtagctgataccttacggtatcaaatcgtttccgatcgttagatctaacagtgtataccttgcccagctaaattcaatgattagaaatgatttagtatcctaaggtactggtacctcgtgatacttttttctggctgtagcaaaatctcgaggaacagtgcaacactatcattagactcatttggtcgttttttttttggtgactcatttggtcgttaattatacaacctttgccaatcacttaatcacatgccgaagcttttaaccacgcagttaattatcactttaatcacgtttccatgagtgatcagatggcgaggacgagggcagggaggttcttgcgagcccggtcaggcagcctgctctgccacaactgctccgactgcgacctcgagcacggcgccgccgcctcggctcccttgccgcctccgccgccgccgagcctggtgacgacgagcgcggtgttgcagtactcgcggacgccggtgacgcggccgccggggccgaccgtccacgcgtgcacccagtacagcttccccgtggcgtccgtcccctccgccagcaccgtctccccgaaggcgtccacgccgcggaccttgaacgggagccccgccgcgccgccgccgccgccggtgaggaggcgcatgagcaccagatgctggtgcgcgcggggcccgtggaaccaccagtccacgtccgggttcagcagccgccgcacggcgtccccgtcgccgcgctccagcgcgcggtacagctcctccaccaccgccttgctgctgctcaccaccacctcctcctcgccgccgccgccggcatcggcggcgtcgccgttcgcgtgtaccttgtcgctagccagctctgctgctgctgctgcgaagcgagcgatcgatcgaattggggggaagggaggaggaggttggcaatggcgaatgtgaggttggcgagtgccctttatataggggagagttttggatttgtgtgtgctagtggtaatttgttgggaacccatgtgagtaggattccaaaagcatggaatttcctttttgtctcagcttaagcaaagaggtaatgcgattcagtttttaaggcattttttgttgcatgatactacttcaaatgttattcatccatccaaccgttgacggaaaaaatatactgaaacatatccggatactattctctgataccttacacatattagttgcacaaaaaccaggcgatcagtattctctccgtttcgtattataaattatttggagtatttctttaagtcaaactttataaaaaaattagcaatatttattacaaaacaaatatactataacagtactattcaatggtcgatttaatgaaattaatacgctaagaacataggataaacaagatgatttataatatgaaacatagggagtaatgttgataacctcttatccatgactgaaaacgagttctcgtgaaatagtaaatttattctatggtcgaaaatacatccttgaagtagtaaattagattaaatgtgaaaacaattaaaattgtattatgcatgaaggcttgctttgtgataaagtcaagagctttatttccatgatcccaatttggtgcatctctccagatattagttgtcaaagctctaaaatattggccacattggtatcattcgtccgacctatattattgagagatggtggacaggactttctctattttaatttatgaactactaattgcaaatacggtgtttgataaaaaaaaaagtggggcacgataagtggctaaggaaaccaatatcagattgctaacatgacattgaattcatagaacaaaacaattgaatgattgttttttatgaacatgaagtgggaggggtgaaattgtacagactgatgctgtggcaatatgttcatttatgaaaccaacacaatttaagcattgctggacaatttgctcatatgttaccaaagtgcaaaactctcataatagtggggaggaaattactttccctgtcaaaacacccattgttcagaagcaaacataggaaaaaccaccaagaatatgccacacccaaccttatatattttccctattgattccaggcacgctcaaagctaataagtctccattttaacctaggccagaaattcgataggaaacggattccactaggaactacctaagatgcattcgacacatattcctttgtctcgcgtttcttaattattcttttgcaatctgatgaagaatatgactccagaataccggcaaattgcagtttctatctacccaagttgctttctttcattttcttttcttttctgcagaattcaagcagtgtatcacccaaggctgcatcgatcggtgaaggctctattcgatgatcagaattaacacggaaattaaaggttaggatttgagtgtcaattagcctgtaacgcactagttagctttcctgaatcctcgcagcattggccagtttctacatgaacagctcatgagtgcgtttcagaggcgtggcaacttgccgaggaaaaaagggggaaaaaatgaaaagaaagaacactcaagagcatacattacgtgcatgacccaattaaactactctcgagaaaagttaatcagaggttattgtctgattgattcgagtgattgatatacctgcatgcaatccaaggctttaattaaacaaacaaagtcaagagatatatactagctgtttttttttaattattgtagttgcaagatgttgttgtggattaaaagtggctttttgttaagagtgacttgtggaaattaacgtaagctttcaatctttcatgcatgcatgaacaagctgttagtgctttccttttgttcaagctgatctcctcgctgaaaatgcgtgtaagtatctgacatcttcatcctccctgaaacgttttgtgtgtggcctgaaaacctgccatggaatgtggtggtaactgaggcttgatgcaggggatcatgatcatcagatgaccatgcattcatggattaaagtggggttggagaacggatgactgaattaattgcatcactagttaaagcaattgctaataattttcagtttatcttataactaccacctctgttctgctctaaatataaacatttcaatgattcaaattttatacacaatatttacattttttagattactacttatcccatcaattatctcctgtttaaatttatccttattttacaccaactagtgtttgcaatttcggtaaaaaaatgatatttatgaacggtggtcatctgaatttcgtgaattttgatggttcttttttttcatgaaatcattaaaaaatttagcagtttttgactgaattttaataaaatctgaccaaattcaaagagtgcaaaaaaatcgaacgcgatatttcctctttgttttttttttggggtggggggtgggattggaaatttcgaaccgaagttgcataacactaaccccaaccacccctcacattatagtcttttcttctcaaaacttaatgtatactagacaacctagaatgtttatactggggaacggaggaaggagctgataacaagatcgtttttgtgagttggcttgaatatatagttctattcctgttaatagctagccactttggtcccatagtcttacgaaagggtaagattgataggtgatgtttcagaaaggccaaggtcatatgcaccatgttagctaggattgtcctaatttcctttgccaatatatctttgatctacctgggctgtcgtagtcgccgaaagttttaccaacatctaatgcatatattaatttgtaatctctcaatctgtctccagtaccacttctgctgacagagatcaacatcttcccctggcagattatctttgccgacagattactgatatccataaatccatttaccatcatgccatgccacatgttaaagtggaccatcatggcaacttttctttactaggattaattatacatgtattgtacgttgaccctttggtcaaacatgtactcccctggtcttgaaatataagggttcctatgtttattcgaagtcaaactatcgccattctaacccaatatatataaagaatattaatattcgtgatgtcaaatgagcatcatttgagccattataaaatatactttcatatatagtgtacgcatgtggcagatgtgttaatacttgctctagtaaatttggtcaaacttagaataatttggcttaagataaacccatggtttacttatgttagaatggagacggagttaattacacttaattaatatggttagtaatttatccagctcattttttctgttaccttgttactttcatgtagagcagggacatctggttatttaaaatttaatagcactatatggacaagtctataccaaatcaaccacacgatttatataaggaacggtaccgatgggaagcattgagcgaaaaacgaagaaacaatctcaccagccgccgggagactgaattaatcctaaccaaatatcctccaacacaaggaaggtacaattcaaaatttttgttactcctctcatatgcatggccagcaatcaagaaaattaactggcctttaccaatcatttttcaagataaaaatctatggatcatacctaatccaaaattaataatttgttctgtggatgtgctcataatattctgaccatgtgatgcatcggacgataagcacccaatatatgcttataagataagggaatcctcaacagaataagcaagagaggatcagaggaatgctggtaaatggctacacagaattatattacagcatcaagaatagttctcctcctcgtctccatattggtggcaaatattgcccataggacaagttagcaatcctaggcgatcagcatctccaagaaaaataaaggggagaaacaaattgaaagagtcctaggtgagtgaaattgtgaaaatgtgaaatggacaacctgaggaagtaacatctgatagatgatgtcaccatcctacataccatctgcagtcagcagagagcgaacatggttggaaatttgtcagccaagcaatggttactggttaggttcttcagagacattcttcatactgccttttggaatatatcttactccatttgtcctaaaataccataactttagcatttcaaatttgtctcaaaatataacaacttctccacctacattctcttcttaactaagcacaacatatcttctcctatttaatttctctacctatttttcttaactaattacaactatccactattcaatttcccacctccatagggtctgttcttttctccggtactccaactataacttcgtcgttttccgttagaaatctttttaaactgttaaatgatatttttttattttcttaaatcaaataaatctttttaagtttatattagttaatacttaattaattgtgttttaattaatgaactttctagtttcacgtgcggctaaaaatctccttaaaaacaaacaaacataaccttaataccgtgtctaagcctaaaattttttatattttagaatgaaaatagtagttatcttttaggacagagttagtagatatatttatagcacttactagtgttgatctgtaccatgtacaaaatctgcaaaaaccctaccagtaatcacgtgttgagagaaatctgcccgcacaaaatcaataacccacaagttaatcagcagtatcgatctgcagccaccatagatgataccaccatatacatttctagaaacaatgttgtttaattttggtaggatatcacaggagaaccgataattacactctctctacacatttggatgcataaatcatcatcagctgtagcttgaccgacctaacctaaccaaaacatcacatcatcaaaatcagtgtgtatcaaacaattagggccaacatctttgcaggcaattaggagtactctatgcacgcacagcagttcacacttctgtgtcacatcagcattgatataggatatcaattataaaaaatcatgtacgtgtgcattattgattatcgttagaatcttcagatgagcggtatcaaggttcagttaagccagtgtttcttctagctggctactttggtggccacaatttttaatagaatgctgagacggagccaggtggcatatatatctttggtactaataatacatttcagtctctgcgcatctgttgattactcatttatatagtggttcacatcatcagtgtttttttttcacttttgaggaaaataatgctgatcattcacagaagagaacgacgaaaagggtatagcatgcatacaacaaatgttgttgagaggaaatatataaccacaaattatgtaaaaatcttcatgaaaaaggtaaaaatatatttaatctcggcttttttaaaaaatccattagctagctcaatctgtgggaggtgtagatttgtacaacaaccatgacccaacattgagaacgttatctttcgctagcatgaatttagtgcaactaaagattaatttgccaaataaaaagccataggtgccgtattttgttgcgttttcaatgtaatgatagtggtgatggtacttacaacacggcgtggggaagaagtcggcgaggacgtcaccgagattggcgatgcaacaagtgccagtgttggagaacaccggccggcgaccttgatgccttgcaacctggaagaataccggtgaatggaatcaccaattcaccatatgggtgaagatccctacaaggagagaatcgcactacggaatcccctccagcgattttctaaggatcgcgtgtcttaggggttttgggagagtggaagtagagagaccgtcatccttccaacagccggactcctgctttttgtatcactggggaactggaggcgattgaaaatagaagataattaagagcgcaatcgatcaatgtgcttaatttgcaattaagaaaattaacagaaatttaattgcattaattgcacgggccaacagatgtaattagctgtgtccatgattctctctgccgaaagattatttcccaacatttagttatcagacacctatcctttcagttggtactttcaccattttcaacttttggacatgatgtttgactgttcatattattaaaaattcagtgtgaacatgcaaaacacaagtcattttaaaatatctttaaccatgcacaagccacaacaaaataaattatatgtaataactatttttaaagataaatggtcaaatgtcatgacaaaaactaacaatgtcattcatttagaaacagtaccacttaggaccaaaattttcacccacaaaacggtaatccaaccgccacctgcatatactatgtacttcctccgtccccaaattgttgtctttataggatttaaaatttatcctatcaatcacttctcatttaattttatccttattcaaccctcaatcacgatcccactatcaaacatacatcatttttctaccctcaatcacgatcccactatcaaacatacatcatttaataaaggacattacaatttttctatcaaagcttaatcaatgctaaacaacctatagtgacaactattttgggacggaagaagtatatctctagctacaactcaaaatgcgcagggccggccctggccctatgcagccgaggcgaccgccgggggcccatgatggtggggggccaactctgaaaatttaaaatccttcgatgaagtagatctttggtcgcactgcaagatttttgcgaaaatatttaaggcccctttgaatcaaaggattcatgtaggaatttcataggattcaaatcctataggaaattatcctatttggccctttgattcaaaggattgaagctctccaaatcctatgaaattcctatagaatggcacattgcatgtggattttggaggaaatttagcaagagctccaacctctttgaaaatttcttttgagtctatctctctcatccgattcctgtgtttttcctgcgctccaatcaaacgaccattcctgtgtttttcatgtgttttgcaatcctctgttttacacttcaattcctaccagaatcctgtgtttttcctattcctctgttttttctaccctgcgattcaaaggggcccttactcatgagaactcatccgatgtttagatcaatgatttttattcagaatcttcgatgtccgcgcctgagattctgaagtctgttatggatacagattgctatccaaatgtttcagttgcttatcgaattctcttaactgtacctatgacggtagcttcagctgaaagaagtttatcaaaattgaggttgttgaagaactatttgagatcaactatgtcgcaagaaaggttaaatggcttggttatgtgctctatcgagaatgatatcttggacactattgatcttaataccgttcttgatgattttgcatcaagaaatatccaaagaagtatcttttcataagaagcaatgaatatgatggggttctatttttcactaaggtaatgatattagttctaaggtattattttggtcgactttatttctcaataattaccagacatgttaaatttaatatatggatatatttattttcgttttgcaagtaaaattagcgtctatatatatcacaaaattttttatatagtttagagggcccatcacgataagtttgcctagggccctcaaaatcataggaccggccctgaaaatgcgtgtgccctttcgtcacatgtgcgttcatgcaccgtctctagtgatacttgcaaattgtaaccatctttttttttgcataggtccgcgtcagtgattcatatgttgtctagcttaatttttcatttggtaggtttccaccgtcatatatattcgttgttctctccctattggacacaatccgaggaggatcacgaatactaacatgggacatgtgccccctcccaaaatttttttttcaagatttctaagtgaccattacattacaaaattgccccctctttctaatatgtcaatgtgccaagtcagcattgcataccaaaaaaatcaaaataaatttgggatctagtatacatatgagtcactaaatctaagatacctttaatttactggagttaattggcaacttgttctatctacttggagttaatctaggaagaatgcattaattggaagatgtgttcttccaattaatgcacacatccagtggcagccacgatgttgtcaatgtagcaatccatgaaaagcacacgggaatgatttttccatggatgccctaggtatgacactaaagcgctaattggaacctcactggccatgagacataccttgggcgtccgggaaagaaccactccgatgtggttttgcataggtacattttagtttctagtgcaaatttctatctattagaatataaagtttgtagcaaattacaatcatctttgcaatgtacaatcattgccagtggttcatctctgtcctagtatattctctccactcctcttggacatgggttgtatatcacagtacagggctacaaagattgaaatggggccatgtggccccccccccggccacacacacatacaaagtttatttttttgcaatatttgaaccaaatatagcatttgtttaattagagctgattaaactttaaaattggcccctatttctaatgtgtgtcaatgtcctttaaatatatataaaaaaatctagcttaagcttggccactagctagcatcacccttgctagtggttcggatctatacaactcattttttctccttgaatggatcagtgtcgtcacggatttgtatcctttgtattaaccctagttacggtttacggtttgctgttctttatcctagccgtctatttctgagaaaatgtagaatttccttggtccttattataacatctatatatgctcctatttcccatctctaaactcataggtaagtttgtagttcagtttctctaccgccaattgcctccccgccgtgctatctctatatcatttctcaactctcatgttgtcatgcaaatagagatcagtgaagaatgcagcaacatgcgcgtgtgctcataatgctattgttggagaaaatgctcaaaatctaacaacaatctttgggtatctgtatataggaccagcattttttttctaacttcgtgcaatttgctgctatttgttcgtattagtttgaaatttatgctagcaattgatctctgtagatgctggtttactcttcaggttgtgctttttgctaaaaattaatactagcattttgttctgagttaattaagaggtgtaatgttcacttgatcattgggtttttggggagtttttccggttatcatcagtacaagttttgttcaatgcaaagaagttgcatcctcaccggcaacatggcaagtaggacagagttagccatggatgacaatgactctcacctttgatatctagagtaccaggtgatggaggccaaatatgaaagaaggaaacctcaccgttgttttcagtggcgtccttgagcctgagcgggctgtacgaccgaatagggcccccaaattttaagggtccataaaatattaagtatgtcctatatataataatattagaggctttaattttgttaatttgcagtctaaatagtagtaaaacaagacccaaaacactgcagaaggtgaaccgatccaacttccatcgtactcccgtccaggcgtccgcgtcgtcgcgtatcgccgaagtcccgacgccgcagccgcttcgtctcctctccccagtcccctacggcctccgcttctacttcatcgctgatgattggctgattgccacgcccgtttttaattttactataaaaaattactaggctactagagccccattttaatattttgcacggggacccgatttggccgggacgcccctggttgttttgaaacacccctaatacattgtatttgcttgctgctagcggtagtgattaattattgtgtctttcttttaattcttattattacatggtaatgaggatatatttttgcttgttacggagttttgtatcatatcttagtataaagttgatgtccactaacttctaaatctcaatatatatgtaaatgtgtcacattattacccagtagcaattattatctatagtactttaaataacataaaaatgtgtaacatcatcactcctagcaattattatctagagtattttaaataacatgcaaatataacatatcatttacaattttgttgacatgcaagcaacgtcaaattaatatctctatattatttttacattatttaaacatatacacatatcatttataacgtataatatgtattcatccacatatcccgtagtaaattaaacgtgagaaatacaactagttattatagttggtactccgacctcggatctttacatagttaagcctgtatatatattgcagcatttcaacatcaaagcagcacatttagatgtctgtcttttttttcaaaaaaaaaaaaagatatagtgcagtatagtactacacgacgtacacgttcgcatgaattcgggggcccactttccagcgagacgccaggtggggccgacccagcgcgccaggaaggattgatgcatgcgtgggcccacgtgtcagatggcgagcacgaggccaggcagcgacctgtcgtcgtcgtcgtcgccgccgccgcgcccacgttggctctgccagcacacggcggcgcgccggcgaactcctcctccgtcgagctgcggccggcagtggccgccgccgccgacgtcccggacggtgacggaggtgttgaagtactcgcggaggcgggtgatgcggccgccctcgacggcccaggcgtggacccagtacgcgcgtggcccctcccacccttccgccaccacccacccgccgccgcgccccaccgccgccacctgccgcggcacgaacacgaaggacgacgccgacgcagcctcggcctccccggtcaggcgccgccgcatgtgctcgcaccgcctcggcccgtggaaccaccagtccacgtcgcccgccagcacggccgacgccgccgccccgtcccccgccgccaccgccgcgtacagcgactccaccagcctctcgttctccctcgccgtcatcatcgcctcctcctccgcttccaactccatggccatccgatcggttagttcttgggagatgatcgatgcgtcgatgtggtcgagcaggtgtggtgcatggaaggatgagctaagctaggcgagagtgagggctatttatagggggtttgatttcttgaggaggtggggcccacagggggtggaaagcttgtgaatgaagtatccgtgcaatcacctaattcggtgcaactatgtaactctcatcctacaccgttggatcgagaaatggacgctcccagtaaattttaacttatgagtgaatctacgagttaaattttaacttataatgatgtggataatggtataggatgagagttgtattattacattgaattaggtgattgcaccggatacttccccgtggataatagggttaggtttgtgagatttggagtgaactagctagctgggtagtggtagagtacgtaattaagtgatgaagatttgctgctgggggtttgaatatcctaatgattgtgaatgcaaatggcgatggaggtgtgtcggggagacatcaacatctataccgactagtgaggtttcgcctgggagcgtccagaactgaaatgactattctgccctttatattccttgtgcaggataacaccgttgttgacttttatcacgacatttgagcgtttgttttatttaaaaataataatataaatatcatttattttgtcatgacttgttatattattaattaaaaaaatttaagcctagcttatattttaccatatttatattaaacttgtttaaacattgttttaaaaatcaacagcagcatccctttagaaatagaggtagtatattgcaaagtgagcgtagctcaactagtttcttgtggtggaaacagcccacccggattctaatcctagatttgacaacgaggtgtatgtggtgacttcgtcaatctcaagatatgccggcccaattatatggaggtgctcatagggataaggtctgcgtgtgtgcgttcataggatcactggtggagaaaccatctttcgtcggtcggccgatttccacaatagtcccggatgcaataaaaaccggggctaaagatgatctttagtcccggttcaaaagggaaacgggtatatttgatctttagtcccagtttgtgttaccaaccgggactaaacatcatctttagtcccggttcgaatgctgtcaggacctgtcaggcccccccgggatctttagtcccggt

SEQ ID NO: 32174 - DNA, 19440 bp, Oryza sativa
  unsure (1)..(19440): unsure at all n locations
gaggagagagatgtgcaacttttttatttttattttatttttttgatatttttttcacacttaggaactcacagaaaccaaccatgtaaaaaataaactcaaacggacgaaatatgtggcatatggaattttccaaagctccaccgaaaaacttttctcctcgaaaacacaatcttgcaagcggaatttggaggttttaatatcgccgaacccggcaaagctggggagaatcggatgtaactttttctgtatattttgaatttggatatctggggagaatcggatgtaactttttctgtatatcttgcttgctctttttctgtatattttgaatcttgcaagcggaatttggaggttttaatatgtcattttatgtggttatattttgaattagattaattaatttcatacagtggtagagtgcattatgtttaacatgctgatcaaagggttttactaaaagagttacggtctaattttattgaaggtgcaaagtagactaagtggtatgctagatattttcagacttagctaagtggtagtttgagtttaatttttttttgtggttggttgtatcgtgatcctgagtgtgaaaaaacatccgaaaaaataaaataaaaatgacaccgttgcaactccatatagggaaacaggaatggaggcggcggcgccagccatgctggcgccctcctcctgccacatcggttcgcgtgtgccacggtggcaggaggacggcgccagataggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgagaggggtatcgaaccgaccaccgctaaatggccggatcgatcgaaattctggtactatgctcacggtggaacgcttaacccagttgatggctccctagtcttcagcgatcagaggctgccagtcgactaacggatgcagtggaagcctcttctcagggcacgttccgacctgacagtgagaaggacgagctatcactcgccctgcagactcccgatcatctaggacgaacacgagggaaaggggtgatccttggaagattggattcaaggaggacatccacacgtacaggagtcggatgaggagcaagagagataccgaggcgaagattgcagatcttgagtacagggtatcgagctacgagctcagcattcaagaggaggtggcaaggaaggtggataaacgcatggccgcacatcggtcccaggatccccagccgtacattcctcctgcaatggtcagcccatcaggcaatcgtagcagctgcgcctcaacggggcaggtaggatcacagagcatggtcgccatgcaaactcaggacgaaaccacctaccccgttgatgagatcactcagcggacaccatgtgagctacatattcccttcaagaacttatcaatcaaggtatgctcgtagttttatgatttttgacttgtctattccgcaagttgctgcttatgttgattactaatagataacctctcaccacgtgaaggtggtgtcgggaatggccatcccaacggacccttcagggacttaccactgcaggccgattcctgcaggatactcgaaggtcaaagttgagttggtggaagccgcgtacgaggacctcgagttggactaccctggaggagacggtgagacgcatctacgagacacaagccacgccattatactatggtgcaagcggtacatcatcctccctgggcgagaagcggcgtctcgtgcaccatctcctccggctccgccatctcctcctcaggctccagcaccgtctccacctcaggctcctgcaccgattcttcctcaggctcctacaccgactccgcatcaggctcctactcaagcttctgcagtgactcctcttcaggctcctgcgccgactcctcctcaagctccttgtccatctccttccaagtcaaggtcccaccaagctccaccgcctgtccgcacaagggcaacaaagaaggtgaaagttgacgccgccgaaaacaaggagccggcgtacaattgcatgcaagaggagcttgacgcttatgtggcagcagaagtcaagaggcaattgaagccttgaagtccagaaaagaagattcctatagactcgagtgctaggaagttcttcaggggtatgtctgcacatgccaaggaggctataaagctatcggactataagcgaacacttaagaaagcatattctggaaagtccaaaccaatccctcagcttggagagcaaccaaaccaggaggttgagccgttggtgacaggtgaagaatttggaataaaagaatttatttctgacaccgggctaactacggatcaattgctacgaggtgcaccaatcccaaagacggaagtgaaatacaagcatgaactcagtaaatcgcttgtcaagcctgagcagctgcagtccctaccgacacagatgtacaaatttcatcaattgtacatggaaatgagcgccaccggtagagagataattggagcgaggattagggacacggacttcttgctaggagaagatattctctggatcaatttcaagagtatctacaaactataccaactggacgccctcgacgtctctattatgagttgttggattttgtaagtatcgttcagttagatttcttattacatttcctttaattaattaggtccttgtatataagtacaccatatataatatatacttccttttatcgttgtagaatggagattcaaagggcccgacggtggggggttttcgatactagattcatcgaccctcggaaagtaaacgtctcaatgatcgacaagtatccggaagcaatagaggacaatctcgtccatctcttaaaggcgcagcattacaagacattcatactatttccgtacaacacacagttagtttttactatcttcctaccaaatttcattcccgtacgtacatgctaagtgttttatatgtcatgcatccgacacacattgcagattccactgggtccttttactcttcgacttggaggcctgcgtagttaatgtaaatgactcaatggataaaaaagagtctacgtttgaccagctttttgaacttatagacaggtaatgtcataagttccaatgttattacgaatcttgatataattaattgctactacgaatcatagctttaaactccatgtagggcttagtatcagttccgtcatttggtccacggcaattggaaagaaagacttaggaggaagtttaaatttcctatgagtacacatgctctacatttatattgaatctccaattcaaatacaagtgtatattaattagatctctcgctgtttgtcaggtatatatagtgcgcaaagtaagaacagggaactaacttgtgcggctattacgtgtgcgagtattgccactgccttgcagaccaaatcatcaccacaagagagcttaatgtacgtacaaataaattcaaaatttcattgcgtacgtatcgatttgttgtttactaattaatttcatacatttataggttattcgtatgaggtataacctcgcacacaaggaatttatcatggcggttcaagaacaactcatgggattcatcaacgaacaagtcattgatccccagggtgaattctactacgacggaaatacaattcataagtcgttagcttctgagataacgactactacatcgaagtcgtagctagcaaggacataatgaattgtaattaatacatgtctatttttctatatgtttacatttactttagtgtaaatatatattttggtcatatatatgcactcattttaagtgctttaatatatatatacatatgcatttgcatacatatatgtataaatacatatatattatgcatgtatatgtattgaaacatatataaatataatatatatatatatatatatatatatataactactatacaacaccttaaggtgctacgtattaaacgaagcgtgatacagacctcacatcccacaccacaccatcctcccccaccacaccaagatgttcagtaattttttaactcgcgaacgaaaatatagagcgctaccttattggataagagccataggaaggtgcgtagtaaaatatttactcacgagccctgtgcagccaccctcttgcatctcgagatgttcaataatatttttacttcattaaagtatgagtatttataccataggaaattctatccaaccattccttccagcatcaatcactccatttttttgggatctatagcacggcaatctcaatcgtgattctagcagaggaaaggacgacgcccccttcaccgcgtgctcgccagcgagggcttgatggcggtggccaccgacgacgatgaagatgttgaagagatgcagggctaccggatcggaaggattggtagtgcctcatgcaaggaagacagactagtccagatgggatctgcagttggaacacggtcttctctggtgcatttgtgttgttctttggtctttagagcaaatctttatttttttttggctgtatttgatctatttttagttcttgaatttttagctctcaattcgtcagcactcctgatgatatttggtttgatagctaggttagtaggttgtgcacttctgcaaacaatgctgcagtgtcccttcctccggggtggggaaggtcacgatcgaccgcgctcggcgggcggcagcgacggactgcaggcccggcgagcctctcaggtcgccgttgatggggatggaggccttcgacacagctgcagcatccccttcgtccatgtatgatggcgctagatgtagctccaatcggttcctaggcgttgagtttcaaatttgtactgatgcagtgatgcttattcctggaattgctggatttcttccgtgtgattcattacgtacgtgtgccaggttcggccggccggcactgttcccgtcctcggggaagctcatggagtcatggtgtcgcaagtcgcaactgcgtgcagtggcccatcgccgtcgaccttgagactaacatttggccttcactgaacttcgcgccgtcgtcgatacctcctgccaggctgcctcatggcagcgacaagcaagacatcggcaggagtcaaaatgctagcagtagctgccgtttagttttttttatgcattatatagatggacctacagctgccctgtaaatttgttactactagtagcacatttatgttgtcataaaaatttactgtaccttttttttactatataccagcagcgatctcgcttgatgcacacattttcgtctacgtcgttgccatgattgcacgtggtgagctccggctaggccatgtcgaacagcacgaataactcactggcaagcgaggattggtactcaccactacgacgctaaaactacgcaaccatcttccctttttctttaaacgacgacgaaaaaaatgttcacccccattttttccggatctgccatcagttcgtgtggatggaataattcctttctttccgtcactttaactgcgattcaattctccctgcgatcacatttttatctgcttcaaaacaaaagtcattttttaactacacatgccgagtatttttataactacaaaatcatctggggttggaaccgctagatctgcacttagttttttcaaataacagtcaaaatttaactatttatttcacacagcacgaaagatgtttacaacccataagttattttttacctattaaatccgacgatcaaaacaattctcatgcaccacgatcaaaacaactctcatgcaccgtacaagttattttttaactatacacgttcaaaaactctatttttattattaaatgaaagtaaaattatcaacctcatgtcgattaaggcccagagtaatattttaacttataacatgaggcagtaattattttactcagccttcacaaggagtggtgtacaggcaaggcaaattagaggagagatgatccagtgattttttctacctgccgtacaatttttttactcattaagcgttcacatgaccagacgagtaatttttttaactcgggacaaatgggatgggaaaagactttgctggcggtggtagcagtaaaagcggtccaagaggatgcggtatatgagaaaagcgaggaatccggaggcgagcgctgagaggcgcgctacttccttcgtagcgctacacacgcgctgtgtagcaccaccccgcgcgtatatatatatatatatatatatatatatatatatatatgcataaaccatgcagcaacagggccatgcaaataaaaaaaatggcacctcgatctttagtcccggttatttcacccaggactaaagatagcgatcttcagtcccggattgtttaaaccgggattaaagggggttaccaactgggactaataagggtttctctaccagtgtttactattatattgttaatttaattaccctagaaacaatagcatagctattgggaccatttggataggctaatccgggacagatgggaacataaaagccaaaaggatacttcgatggagatgcatgcattgcactgcaatttgcagtgatggcaatttgagccacatgtctgtcttatctgattggattagagggaaccgaatccgaattcacttcagtttcataattaacatgtgcctttagcaaagtatatactataggatagcagcaagcaacaagtagcaaaaaggtcagtgtccgggcatgcatgcttgttgcttgtacgtgccgtgtaggccagataagatgataaatggaataattaatggatgattggttatttcctaggatttctccataagatttttttcatgatgtttactcaatcaggttagtttctgttatatgttttatacatacagatgttgtcctgcatgagtgactgaccagtgatcatcaccaccttaacaaaagaagaacaaaagtttgatatttttctttgagaactaaaggagtacattctcttgtaaaacagtctaatagtacagtgactacagtagagaatatatcgtacaaactaaatctaacttaattacgagaaaatcatttttgttggatgggggagaattgctactctactctaataagttatataaatatgtaattagaagaaaaaatggtgtccattacgacttcgtcattctcaagatatgcaggctcatttctcagaggtacacatcggggtataatgtatgtgcgtttatgagcgagtgtatgtatattatgaacgtctacccttatactatgtttataaaaaaaatgtcgagtaaaaaaacgaaggcagtgtggaataatttacccatcgaagacaggatatagtaaacttagggtgtgtttgaggagaaggggattgaggagattgggaagatacgcaaaatgaggtgagccattagctcatgattaattgaatattaactattttaaatttcaaaaatggattaatatgattttttaaaacaacttttctatagaaaatttttgcaaaaaacacaccgtttaatagtttcaaaagcgtgcgcgtggaaaactgagactcaatctcccctatctcccccgaaagaacgatgccttagacagttgaggcatagaccaccgtatgctggggaatttaactatttgccattattagattcggcagttatccaaatacccctcttaggtttgcacatattattttgcccttcttaagaaatgtcttcttaactatttgccacttttacccacgtggcatgctaacatggcaacggagggtagaaaccggtgtgggacccactagtcagcctctcctctctccttctctccctccggtccagcgtggcgccatcatgatggtggaggaggtagagcagcggcgacgaataaggagaagcagcggcagacggggctcctcgcggtagtggtggatgcagagcggcgacgccagcggaggaggaggcgtagcagcggcagacaagctcctcgtggaggcagtgaaggcggagtggcggcgtcgcggaggaggcgtagcacggcactggcggaggaggaggcgtagcggcggcggacgagctcctcgcaacggccgggcaggtaaagcggtggtgccggcagaggaaaaggcatagcggtggcggacaggctcctcacggtggcggcgctggcggaagaggtatagtggcggcggatgggctcctcgcaacggtggaggaggcagagcggcggcaccagaggaggaggcatagcggcagtggtgggcgtggtgcggctgacggtgaccgaactggtgcgctccatcatgacgctgttgctggtccggtcgctggcgaggatgaaccccggcgtcatcgaggagcccgtccgccgttgctcctcctcatccgtcaccgctgctccatcatggtggcgccacgctagaccggagggagagaagaaggagagatgagaggctgattagtgggttccacactggtttctaccctccgttgccatgttggcatgccacgtgggcaaaagtggtaaatagttaagaagacatctcttaagggggtaaaatatgagcatactaagggcccctttgatttggaagaaaaacataggaattttgaaatagttcaatcatataggaaaatttcctatgaagccttttgaaacaaaggattgaatcctatccaatcctttaaaattcctatgaaatgaataatcctatagagattttgtagaaaatttagcaagagcttcaacctcttggtaatttttcattgaatctatctctctcatccaattcctatgtttttcctacgattcaatcaaactattattcctgtgtttttcctacgttttgcaatcatctgttttacacttgtactcctatcaaaatacgtttttcctattactactttttctcaatcctgcgatttaaagggacctaaaagagatatttgataattggacttaatcctgcgatttaaagggacctaaaagaggtatttgataattctcaaatctaaaagcggcaaatagttaaatttaccctgtatgctcgcacccggccgtatatgtcgcgtcctcctctccaaggcagctaccacacccacacgcgaagcttccagtcgcggtcggtcggggtctcaataatatctggccgtgaaagtgacaaattaattagcaagatccaacaagaattcgagatcgagctagctagcagctgtagcacgcgacgacgcgagaccatcaccggcaacttgcgaatccatcgatcttgatcgatcaaatcggtaacctttaccgcctacgatgcacatctgcacgtacgtgtgcactgcgtgcgcggctggcgctcagggtttacattaccgccgcggttaccggtcctaccgaggtacggtaatagaaaaatcacagtaacctccttaaattcaaataaatttaaaaataatttaaacttttgataaatttttacacggtattgtacggtttttcacggttaccgtgcttaccaccagggcacggtaaccctggcccccgacagtttagaaaaccctgacggctctccagcgatcgtaaaaaactcaatcctacgtaaagtacgtgtacatctatcccatggcctcgatcgcccgagctcctttctttctttttcttcatacttatacttatattatagattttatctcaattttatacgaaaacattttatatggaatttattttaaaatattggataaatttacttaatattataataattagaacttaattaatcatgcgttaattttttttatttttttaaactaattttacttttattttcagtagaaccaaaggccattcttacgcagggattatacgtacctactcttcggtcctgtttggataataatcctccggaatcttgttatttaggagtattaatcgtagattactgacaaaacccattctataacctctaggctattttgcgagacgaatctaacgaggtatattaatctatgatttgctacagtgatgctacagtaatcatccactaatcatggattaatatacatcattaaattcgtctcgcaaaatagtttaggggttataaaatcggttttgtcgataatctacgtttaatactactaaataacaagattttggagggctatttgatagcttgagtatccaaacaagaccttctcagtgagcggctgtgccatttgccagcattcaccggtgacctgaccgccatcgatcgccatgcatgccatccgacatgccaaactaatattgaaaaaaaaaacgaaaatatacgtcgattacttctagtacagtatatatgctgctgcctacgtgcagtatccaccttttccaacttggattcagattcagacgcgtgcactgctgtgctatgccgtgcatgcatcccacgactattcttcttgacgtgctcctctagctttcccaataattaatgacgatagtcactgttacctctatctcaaaatatatcaataggatataacctaatactttatcttctttatattacatatgaaataagtcaaacttatttaaatttaattaaatttacagaaaaatattatagtacttctaactgaaaacaagcatattatcaatatatattaaatgttagatttaatgaaaataatttgatattgttaatgttgctatttttctatattacaaaagtttgactatagaaaaatcaaagcgacttataatacgaaacggaggaaggattacgaatctggatatgcggcacatttttagattcgtacgtattactaagctatgccaaatacgatactatttggttatattttaggatagaaatagaactctcataatttatactgttagtatataagtaataatagaagaaattaattaacacaacactacaacagtaatcagcagcaagatagaacacagctagctctagtttaagtgtaactaggcaacaagctattcatttgctacttgcagtagcggactgaacgaatcaattgaatatatcttgtgagcttacttcaaacagttcagcacatgcttataattaataaatccatgcatatataggttgactgcccaagaccaaaacgtgcatcatatctatatatatgcgacttctctacgagagaatattttcaaacatgcatatatagttgaagtccatgcttgcatggaaatgcaccaattaaattgaatcaaacctcgaatatatccatcgatccatgagaccgtgaccacatcttgactagtatatatatatcctcgtatcatcgagctcatgtctcaccgattcgtgacagttttagattcgacatgaaaatgaaatcgaccaatggaatactagtactttaagactttgaagtgagctaggcagtagtttgtttgggctggatggttgaataatggaattcaaagttctacagtgcacatgaaagattaccactcacaactgttttatctatttatttattttttttgtcatcctatccaatgatatatccaatgatagttgaagtggcagcttatcggactagaaagctggggatcaactaaacaacagagaatcacgtgaaagggacttataaattcaatgaaagcaaagtgttaaagtttgttgtgtttatttatcgatctttggtaaagctaatgagatcacgttttacaattttataattaatgacacggtcatatatacattaaccgtaccgatctaggataattcagacatggctcagcttatctgaattctggttattaataagcaaaataaataagcatgcatgtaccagacaacgatttttcttctgttacaggtttgcgagttttacaccataataggatcaatttatcattgacactgtaccaaggtttacatcattatcactatcagttatctgtgattctcagttacgtatacttgcaagacttgacttcatgcatgctgaatcgaagttatcaagttgacctaacctaattgtttgagatcattaattatatagattataactgtaatatagtgagcacatggatggtctgctaggatcaataattggttagctagtagatggttccatggatgtcattgcaaacgtcaatgcatataggtcaagctaacataggaccaacagttatgcttcacttgtcaaaagagatattttcttttcctttcttcttttcttctttttccatgcgtgtgaaagagattttcaaagagaaggggatctatatgtctgtctaaacagaatttacctctttatgagaccggccagctgggttgctttagtaccctacagtttgttaaatgttaatcactatcttttctccctgtttaaattgcatacatgcatggtatatcatataacttttcttgaaagctagcaacttaattgcttgatagattgctagatatgcatgagtcagtcaactactcaaccacatgggtcctgtttctagatgatctagtaacggttgtcatgcatatgcaacaggataatggcactgtcaataacaaatactaacagtacaaagaatgtgatagatgatcggtatgtgcatgcagctgctaatgcaggagaaagtcaaaacggatgatgattagttcatgccatccaaaactagaggaattttgaaggatttaattcctgaggaaaaaaaactcatgttgtcctttggaacaaagaaataactccctcaaagtcttcaaaattcctatgtttacttttccgacagaaaagactcatatatttttcccatgtgccatccaaacgttagttttgaaactttttttgtctttaattcctatcgaatccaacggccatgacactttgttcccatattattattctgttcatgtatttacaatccaaccagagtcgtcttcaagtcctgttgtttttctctctgaacaataactttgtcatagctatgcaaatggcggattcacctcccggacagcactagcggctacccggctttgcgtgttcggccactggattcactgtggtaattaaagtccaccaattcaccgtctttcccggacaaaattagcaggttaaaattaattagatcttggtgtaaacggcgaggattgggcgttagccatcggtaatctgttgtggcttgcttgtttgccttcaaaatggacgtggaccactccaagtctccaaccatcggaatcaatggaatctcctagattaatgacaaaatcgtatatattttttcagcataaactggatcatgacttgatgattagcaaactgagcatatacacataggtttagtggcagtgtggcacggctttaattagacttatccaggttttctgaaagtcacagttgaataacttatgaaaaataacttcgtcatgacgttcttcccaagcatgtttctagattcctttgctctactggtcaaacccaaattaaacttatctgaaaatagttttggtcaagccaaatagtagtagtcagtgagcacatcagcatggggacgacgacagatgagttatgctgatgcacgtgtacaatctggacatttcaatattatctatcttggtgacagtagcataaattagtcaatgcgtttgatcaatcaaacaattaatcaattaaggtcatgggattgacagtgatcctgtgctggaaattagtttaagagcgaggattatatatatttaagctatctacaggctgattatatttgccgtgagcaatcataataagtaattaatttaatggtcaatgaaatgatccacctgaaggctgaactcctctttgcttggaacgtcatgtgtccttgtcggttctaggctgcttctggctgggcgttaattaatttgcttctggaggaaacccaagagttaatcaacaagtcaaagatctctttccgggctttgttctattaatcccaatataaaagcgattggatagaattaagagaggataggtgtggaataacttcatttcaaatctacctcaatcccggtttaactgaacaagacctcaaataaagacatacatacatgatggatgataatgatgtagcagccattcagcccaaatggcaaacatccactacatctggtaagtactctttcatatatagcatttccagcaaaaaaaaaagaacacactataaaaatatatttaattatatatttaataaaactaatttagtgttataaatattgttatatttttctataaacatagtcagataaaaccaaaataatttacaatatgaaacggacggagtagtcggtagtgtaggctgcccttctaggcctttttcagctggcttgtgtgttgctggatgggctttcacgtgggccgtcatgctcagcacgtgggccagcccacacatctgactcacctagtcctttcaagagcaatagttttgcatccacatggttatcaaggaaatgaatgggacactttatgcatacattattttgttgtatgatacgtgaatttatgctccgtccatccttaaatatatttgatgccgttaatttttttaaatatgtttgacctttcgtcttattcaaaaaatttaagtaattattaattcatttcctatcatttgattcattgttaaatatgcttttatgtatacatatagttttacatatttcacaaaagttttttaataatatgaatggtcaaacatgtttaaaaaagtcaacggcatcaaatatttagagacggggggaatacattagtcaaggtgcagttctgaactaaaacatgcatcagtttctcgtggggacaacataaaagtagtttaattaattgctgctaaagaccggtttaattcttgagaaacatgtggagttcattgagcacgtccacatctttgtagataggcacacaaggatgcgtaaaattaaagagaacaccggtaagaggtgatcttactagcaaggagcatgctaaaaagagataaatgggaagaaaatgaggttagtttcatatttattttattgaataaagttgtgctagctaccatgtgttcaaatttcatcccaaagttattttagatacgaacaccatgttcttaaatttgaatctattttgtacacttgaaattgttaatatattacctttgagtaaaatacatggtagccgggcggtccttaaatttggaccagattcatgaatttgtaaaatacaacacatctacatctctagtcttggtttaatgtataccactcaaagtccaaagtgcatatgacatagctcacgcgccgatatggttatccacggttacgagaattatgtccttaggcctacactatagtattccccaaaactgactccaaccacccccaactcaacaaatatatatgtatttctcagcatctagaaaattcatagtatataagtcatgcgctaaaagtatatttgatagttctaagagtcacacgagggacctaaatgtaatgttcttgctacggttgacgaccacgtcaaggattaaaattccagaacgaaatttcggaacacccccccccccctcccataatattttttcagctgatatttttattttttttgtgaattttggcaatattttgttcaaatttttgaaaatttcgaaccaaaattttggtatatcagccccctcacatataaacgtccaaaccaaaagattaaaccctgggcaatatactttgaccacggtagatgtgtatttataagttcatagacctgtaccggccatgtattttacccacgagcttttaaatacttgcatcatctttactattataaaaattaaagttgttttttcagtattttgatacgtcatccatatatgagttggttttaaaatcgttcgcttttgaaaatacatatccgtatttgagtcggggggttttaattttgtccgcttttggaatgacagaaggagtcgtataagaaatccattaaagaaaactcgcatgttaatatgggataatcgaactccctaattatagctcatgattttctagactcacagtgaatttcacctttactaaaccatataacaataataagattaaaatagctttcatccgttgtaacgcacgggtattttttctagtctagtaataatttaacgggaatgctaggggatgagataccgtttcccaacatgatgcccctcctccacaaacgcgattctcacccatgcgacgcgcccgaagccatcagcgcgcgcccgtcccctgcctccgtcgtccccatcccctaccgccgcagcgcccgtcccccgccgccgccatccccatcccccaccgccgccaccgccgcgcccgcacccaccgccaccgccgccgtcgccgtcccttgccgccgcgcccgtcccctgccatcgccgccgcgcccgcacccaccaccgccgccgccgtcgccgtccctcgctgccgccgccgcgcccgtcccctactgtcgccgtcgccgttgccgtcctagtctacaggggacggctgcaggtggccggccgcgcgtcgggatgctcctctcccaacgggatgcacagttatatctactaggaatcatctgatacctggtaagtatcatccgatatctcttaagtatcgcgcgatacatagcagaaatcgtctgatacctgacatgatacttcgcgagtatcacgcgatacgtggtagaaatcgtctgatacctgacaggtatcacatgatacctcgcgagtatcacgcgatacgtggtagaaatcgcatgatacttgataagtatcacatgatactttgcaagtatcacctgaaacgtttgtagaatcgtctgatacctgataagcatcacacctgatacctactcgggatcatctcgttcgaaaacgggattccgttatatagcagcccccataatttaagaggcaaggttttgcgcttaccaaggtcaacgtgctaagagcaggtacaatagcaggctattagccagctataaacatattttaataagataaagatgagagagaaaagtagcgggctacatatctgtagccaactgtagcacggactccaagacgcattgtgtgtatgacaggtgggaccatatattaatagtatagtaagcaattattatatgaattgactattagattggttataaatgatttggagctagcagtgggctatactattaaacttgctctaaactatgctgattagactgaacaaacctaaatttaaccagatgttatggatttcgaccgaagttctttttttttttagataattcgacctaagttcttaaaaaaaaaaccatgtaagcgtcgctgaagaaagtactaatagatgatccttcactttatgaagcttataacttgtttaacatgttgaacctaataaagcgtcatcgaaagtgaaggatgattgttaaacttgcctggaaaacgtggttggatctagacgaaaatctgtccgtaaagcagcccgaaatccttgttagtatccaaatcaaagagagcgcatgtgttgtcatggagaaaaggacacatgccaggatgaaccttcttctagagtatgacattaaattgctgaaaattcagtgattcgggtggactgctcttattcagtcagcttggggacagaggtcagaggggttagtgctttgattgtagcaggtttaattacttactccttcccggttaataatacatactagtgccacatcacttgaccagattgtcacatgtcgtggagttagtgttagttctcaaaacaaaaaataaaaataaaaaaagaaacaagagtgcactgctgttgttagtgtgcagttgcactttgttaattacctggacaatggcttcagctggttctcattgaaacctagtcagagatgtagatacatcaaacatggctgtactttttctccactgattgatcatgtaggtttttttcactgagcatgataaattgagatataaattagtaattggaatccaagaagaaatatgattgtaattcctaccttctggtctcactcactgatcaagtaattgggagctaggtcggcctgccagctactactgtttgttttcagggatgtaaaactgcatgcataccatatgttgtagatctttctccccatgttttgatgtaagcatcatttgttgcactttatatcagaggatggaggaatccacatctgcatatcgtttacaagtcagtaaattgcttgcagcatggggaacctgaagtgatgtgattccctgcctaaactagatgggacgacgagggacttaaagtggacctattcctttattgggtcttacagcgatgggccgggcaggctatccaagacttgttgggcctagtggaatcaacgaccagactttcagctcttccgaacaggagaaatttggaggattttcgtacggaataagttcacattaggtcccttaatttgttctgaaatttatctctgaaccgaatactaggtatagaccgtcccccaactcacagcagtgtcaattttagtccctcggaagtataatgaccggtttcagctgacatggcggttgagtcaagcgtgcgacccacatgtcagaacaacatagtctaaataaaaaataaaaattggtggaccccacctgtaagcgacacataatctccttcctctctcttctctcaaccttttctcgacagcataggccggagcagagcgtcagcgctatgacgcgtgaagccatggggcgtaagcggcggcatgaaggagcacggcggccattggcggagcagttgcatctcctacggccgcgtgcctcattccccttctttcctctctgtccccagaggcaggcggcgattggcgagatgagctgggtggcagcgacgactggctagagagggcgatgggtggcaagagaggagctagcggcggcggcaagagaggagctgggcgcgggagagagcagtcatttggaaagacgttgtcgtcttctccggcgtcgctttcttcaacatcttcttcggctggctactaaaaaacactatcggcgcctgtgcg

SEQ ID NO: 32175 - DNA, 12265 bp, Oryza sativa
cactgccaccaggcaccagcctttccatgggaccttggccatcgcctccctccattgtgacaggagagagacccctcctgccaccttctcccgcctatgtgccactcgcacccgctcctccgtgtcacatatggtctttcacagtcccacttcctcctccgccagagcagctgccgccaccgcagtgccaaccccaggccctttctcctcacacaactcctctccccctcctcctcatcctcgtgggagctaagcacacccttaggggtggtggagcggtggagaaggtgctagtggcaaacaaggggattgcgtgcagggtgatgcggacgcgcgtggaggcttgggagccccaccgtggcagtccactgtgttgttgatcgctgggcactgcacgtgagtgccaccgacaaggctgtgtggcttggcccgctgcccacaagggaaagctacctcaacatcgtcatcattgttggcgctgcgctctgcatcggcgccacctaatttccgctgcggtggcattggttggctaggacggaagagagatggggaaggaagagaggggagagagggaagagagaaggaagatgttggtttaccgacctgtggggtccacgagatctttattatttgtttttgctattatgccacatagccgaaaccgtcttgggaccttatttgcactgattttagaagttaagagacgcatcatatttggttttacggttcaatgacgagtttaaaactcgacgataaattgagggaaccaaagtaaacttattccttttcgtacaaattgaacctgtaaaaattcctctcttaagagccctcacattgtgatcgtgccagattaccccgatcatcagcccagcccatcaatgatttttctccgttccaaagatcacgttgggatccagtttatttatgtgtatacgccaacactttgaactgaaattatgatcgtgtctgcctgttcagtcatctcgcttagcttaagccaaagtcaatgtggttatttcaagaaaatctagctaaacatgcttacatgtagactacgatggaaacagaattcatatcagttaagaagagagatatctgaattcatgggtgcagaaataattatgacaactcgaagggccaaggaacacaatgatttttatcaatgacataactaccaaagacaacagaaattattgtcattgtggagctactagcattgattcgagctgaattttgcaaaaaataataaatgcaaataatccaacacccagtgaggaaaagaaagaatgttgtaactcggcagacaaccatttagcccataaaccaatacaagactgttcaccatggggaacctgaagcatatgcaagcaagaacccataaaatggactcaaactagctaagtttgaaataatgaacctgtaagcaccaagcaccactaaattgacatttttccctctgtttttggggcaatattgaatacattgtgtgttccaagtatccaaacggttttacaaaatttacttgatagctcacatggcagactccagccgaaagaagccccaatctcacacaaattggtaaaattgacgagggtttgacaaccagatttatcattacctgaaacactcaatcattaaacacgtgtgaaattctgatatacatggtatgtcgacactgtattagggcaaaactgaatacaattgatgctgaaggacatgtagaacaaaccaagtttttcatgatattattctattcaaactgaatattatgcacagccatgttgtacaaaatccaaacaagccaatgcaattgcaattccaacacggaggaagttttaaaattatgtggccctctcataataaaattcctacgtccaactagggataaacataaatatgggacaatctcacaacttagacaaataaagagaaacagcaccaatcaaactttcttaccctgccattcttctatctaaactcacaattgattctttcattgttattgcttctcatcatcattcatttcatcagaatctgagtcactggcattatatcctgaaaaggagaaaaaaaatgatacattagcaaaaatgttcacagcctagaagaagcagtttttatattatatattaaaaaacatactaaacattgtaatacccggacgctttgtgccaactttccagactgaaggcctgtatctagatgccttctcagcccacgctcttcccttgtaaaatgaaaaagaaacaaaataagtgcaaagtataatcaaaacatagtattcaactattatgatgcagttactggacatgtctgtattccacaaaaatacaccacatgcagaaagaggatagggaaaaaaatcgaaatagtatgacgaataaactgtactgtatctatataaaactcatttcacagtatctatataaaaccgtaacctaactcagatgtgaaatgttttccctttaataattcaaccaaatgaatttatcgtctgtgcaagcatgttcattagcactagcaaatatgaaacaacagccatgaatttctttgatctttcttctttcataacctggttattctcctctagggtccagctcctcacaacttgctctaaagagatgtcccttggctgagttatataggcaatattttgatcctgtggtttaagaaagctctaaggttgagagtaacagttacttacaaaaacaactaagcactgaagtacacttccattaagtgccttggaaggatgatgacaaaagctatgggtagtcaagcataaatgcttaggaaagatagtgaaatcaatagggacaaaagacccccaaaaatgcctccaggtcttatatttttcaacaagatggcaaactaaataggccttatcaaatcaacagaggaagtaacataaaatgagttaacaaattcaaacaatcagtgatagctactaccaaatagaacatcaaatcatcaatcaactgccataaaagcagcaacactagtataaaacatttacacaaacaagaaataacacccaaatgtggagaacccatttccatgacataaatcaattgaaacttaacatacccaaggaacagaagtctaactgttcaagaaaaaacttgcaagaaggatggcacagagaataaacacaacataaaaagggctaatctgcatgtgaaccatcttctgtatcaagtttcctcattaagctagcaaagctcaaatatccattgaatccatctcaacacatcaacatttagttagttgccttatcaatggttgaaaagaataaacataaaatcaacaaagcagaaaaaaggaaccccaaacataatccatcatttgtccaaaattgcccaattattcaactgaagcacaaacaatggtgcattatttagatatggaaatcaatgaattaaaaataggaaaggatagcattttcaaaccctttttgtatcacgagaattttcctagttcttacctttttcctacaaaatcttttgatgtcctaaatttcagaaatggccttaaaggttacggataccccaaaggttttgctctccaactaatgaaacatgactaccacatcactcccagataggaaggcaagtcacttgaagctaagcacaaatctagcaatttgtacagtggtgtttcctccatggttggagctggagactgttggacatctcagaataaatatatataaatgggtaccaaagcaaacatagcctcttaggttgtgatgagtcaatagtgttggtatgagatatgtgcatctatctggccaaatgaggtggtggtagaagataaagtttgtgttcttttaattgtcgaatcaaaattatctttcccatactggtgctgaggttttttatataattattatgggggtatgccacgtgtgacctagacaatggtaacctccagtatatgattgcatcagccccatttgtggtcagtaatgggttgggcattcatctccataaccacacctccctatacatttttaaagttgttgggattttctatatagtatatagtattgttcttaggcgtatttcactttgtacatgcaatatttagcattaatacctcctcactccaagaatattacatacagattaaaaactaacaaaggcaaagaaagctatgctatcatcaaaaaggtataaactttagccagccaaatcctccatgataaagcagcaatcaactccaaatataaatgaagccagcaaatagaggacagaaaaaataatgttgcaccttctgtttctaaccaaagaatacactccaaataccaaccaaaacaaaacagtatttctctctgtcgtgaggaaaaaaaagaaaactaacaatggctgagaacagaacagatcctcccataaaagtgtatgcaaggaaccagaaacaaatgagcacccctgcccatattctaattattttcttcctttcaaaattgaccacaattgctaaagaaaggaaaaaaaacacttggttgaattctacaaattgaaccgggccactaccatacatgttgccacttcccaccctgaagttcaaacaccagctaaaaaaaaatattccacggctctgacaaaaataagtcgcaacttctagttaaaactatgctaataataattgtaataatcgatacgttaaaactctacccaaaaggaggaattgctatcaccatattgcatacaatactttacaagaaccagattagaaccacaaaagcttgtgcatcagcacaagaaaacagcacggaagcagttcacgacccgaacccgaccaaagtaactagatagtatcatcgacacacaaaaaaaaaagaaaaaaaaactatgcttgcaactcgcaagaactaacatagacagggttttggtaaaaaaaaggaggcgtcccctacccccatgtcttcctactccagaaacaagttgtaatcagagtcgcacccttatattcaaatctaagaagcaaggcactagagaaatctaataaataatgcagtgataaacggtgcgcacgaaaggaatcacatcgtgtttaagctaacgccttccccggatctcgattcagccgagcaaaataactttgatctagagatggttgagacctataaacggggaggagcaggagcagctcgatcctcctccggtctctagcacgcaggggcacataaccagcggatcaaatcacgcaccaccaccaccaaaggaagaaaaagacaaggtggggggaaccatgggggggggggggggtggggcggggatggatgggcatgggcgcaccttgtgctcgttcttggggatgccgtagccggagtggtacatctgcgcgacgagcacctgcatggcggagtcgccgcggcgggcctccttgagcgcgtcctggaaccagcgctgcacgcagtcgcccaccacctccgacagcggcttcctctcctcctccaccgccccgccgttcaccccctccatgtgccgccgctaccgccctatgccgcttcgccgctcggcgaggcgaggcgcggtcgggtttcttctccggcagtggcgccgccgccgccgccgcaagaggaaggttagttggggaggcggcgcgaggagagagaattttacaaaataaacggcgggaggggaggggttttgtgtaaaattgtcggggattttgcctttttttttttctttttctgcaagttgcgggttttttttctcttttctttacctcgacacgggacggcgcacgcggttttttcaaaggggagggggtttggttgcctgccgtgcggggaaatcgcttcgcccccgattcaaatgccgccgtttatttgtgtaggattcgaattcggatagaacatgtttcagctagaaattgggaaagaaaaacatgtttcaccaagaaattcggacggaaaacgtttatggttctctatgtgggtcggtacctgagtcggatacaagatgttttctatccgagacaaatacggcataatattcataaacataagttttttttgcttttagaaatacataaggagtcgtataagaaattctttcaaaaaaaactcgcatgctaactggtaccgagagtcgaatttctaattgctttagaattcttatcagatcataagaaaacaatatataggatatgatcatatatatttggatatttggatgggaatgtttatatatcagttaatttttggatcatcggatatgctttaagattcgtgcagaggcattaatcctagctctcctcctcttgttcccctcgcatcgcgcattccgccgccaccactcccatcatgcattcctccgcctgatcccccgccgccaccgccccaccgcatcgtcgcccgccttgccggagggtgtcaacggcgccggcgaaaccccccttccccccggccagcctccttctcctccccactccttcctcctcgagccatcggcggcgagatgcccccaccaccaacgccggcccaccgccctcctccagcttcgctgctccggcgcctcgccgcccaccgccgggctgtcgcctcccccggccatccctctagagccggcgaactcctccccttccctctcacaccccaccccgggaccttaatctgtaggtcctctgccggagtctaggatgtcgtcgacgccggagaagaagagaggtcatcggagttggaggaaaagacttggagtacgaatcttgaagctcatccgatggcccaaaatctgtaagatttgaggatgcaatttctatggacggaaggttagcaattccgatccaacgaatagaaaaaaaccataaggtgattggacaaactctcgtaaatatatttacgtaatgagaaattaatcttgtgagtcaaaccataaggtgattggacaaactctcgtaaatatatttacctaatgagaaattaatcttgtgagtcaggcggccgacctgatgcgtaatttaatgctaaaagctaatggtggcatgtcactttcggtacatggatagaagtggctgccacgttggaaattaaaggaagagatttgcacgtacgagcggatagggattggaatttcctttcagcatcgacgacgacgtatgatcattaacgactaggttatctggtcatcgatcctttcctttcgttgtagagtgtagacgagaaaaatacaggcgctacagtatactaagtaaaatactcgtgcttctctacatgtaaaaagaatcgttaaacactaaaagacatagtaaaacatgtcgtatatcaacattggtacaagacatataaatgatttatataggctaagtatcgataaaaaatctctaaagataagtaggacgcatgaaaaccattattgcataaaaaaacattattacatattaatatactcatattctcataatgctcgttctctcttaacacttacgtagcaaagtgtgtgatctcatttctaaattcatgtgcgtatttgtgtagagaccgatcgtggcatgtgtaaaagatagatagcatacacgttctaatttgtcatgtctcatggacgacaataaaaaaaatcttacctacttaaaaatatcgttttttacaattgcaccatgtgctcaatttgttttttccatgccatctgttcatcatccgattttctatgtgatattttttatagcaaaatattggtattggtcatccaatattttcggtgattttttatagcaaaacatccgtatttgtaataggtgaaaataattttatgttagtttccgaagttgaaagatgaagttgtcgataaacactaccatatatcaaatatttattttgttatattcttagcacgatgcatgttcaactcactctgcatatagtgccatagtatattttttcttttaatttcatttgtttttgtcatagaaacaactataaggtttggatttagaaatactttttgaaatggtctattaataaaattaaataaaacataaaaaggtaagaaaaaaaatccatagtaaacggttgaaatcgcgtgggcacggaatcggacagcgcgagcacgtgtgcggacggacgacgatattattttatcaggtgtagagaagtacaggttactcatcctgtattgcaggattagtacagtgtacatgcatatgcttatagcgtatgtgcgtgtatctttcgtataattaaaaaaatcttcttcgtcaccagatataggcacacattcatcatagatacggccgtagttactctctccaccaatcactacaacaaactaaaactattattttattattttaagacgttttacttaagtcgctctgtaagtcgtctctgcttttacaagtaaaattaaaataggaacgatatttgagacgctttattagttgaggacatagtttaagacgttttattagttgaggacatagtttttaagacactttacaggttagcacaacattaaatcgtttagagatgaatattgagacgttttggaacgtgacagatgagttttgagattgtttctaatcgtcatcgtaaaaaccattataataatattataattatttggacaaaaaaatttgaatatttaatatttaatctcgtatctgctagataataaaaaataaataataaccctttcatccaggctcaaacacaccacctgcaggttgtaaagtctagacactaaccaactcattaccatggataattttgaatgtcaatacacagttttttttttatattgtaactctgcaaacatgcgtcatgtggtaatcagaagtgggttggccctgcacagcacttcatttgttgggccgaatggatgactgacagctggccttcatgcctgtgatcgatcgtgtgtatccgcgacagggacctgtgattttcgtcccatacgcgatctcttctgattttctgatcttgccgcgatcacagatcgagccgcgccaccggccaacgcttgacccggcacctggctaccccacgcggccacgccctgacgcccacgctgccacgcacgaccagcaggcaggagcccccacaccggcaagcccacgccgccgccttggccgctgctgcagcctggagcgtgtgccgccgccgcgaggagccgtcgtcgagtcgatcagccgattagccgtccgcaccaacaattttaggttatctatttgtgtacttttttagttactgattttatatgttttaagatgttttattaatatatcatgataaattttttggtgatttggtctattatattatatatacttacattatatatattagaattattagatttactgtgtttaaaaaaaatagatcggaccacccatatcctaaatcctaaatccaccactgatgagcaatggatgctaggagctgaaacaagccgtcgtctccttccttctgtctcctatccagccccaggtccaaaatgttaatctctcatttagtgatttagacatttttattccctatttacgttggttaatcgttaaatgccaagagtactgttcactacaaattggttggcttgatttaatttgttttatgctagcgagagaatacggagatcacaaatgtcagaccttcatatgatttataattcttacgactaacttgaatcaatttaaatgagagaagatataagaaccataaagattaaggtggatcgaaatgatagatataagtaccgcaaagatgaagctaccttttaccagttgtatattgaacttctgctatgaaacttgagtagtattaacataataagtttatgtatccatctttatgcccttctcaaatctcccaatcaacttctcgttgttcttatttaagtcagaattggtcagtggatcaattgctagtgccagcgttaagactttacatagtgtttattcaattaattatgtgaataatagtcagagaaaaaatgatttttgtgacttgggaaatactgttcatactttatgcacattttggacatgtttttgtaaagttgatgaaaataatgttaattaccaggttcatgttttttctcttattacttcagcataccatataactagtgatggatcgagattggatgagtgaacccagaacatctgcttcctataaagatggtgtagcacatttcctatccattgcatttcgtgatgttccagatgatgccaaggtcctttgtccttgtgtgaattgtagaaacagaataacacagaattatgatagagttaaaacacatttgagatgtgctggaattcttcaaagctataccaagtggattcaccatggtgagaaatatgatgcaccgtcattagtattcgctcctgtatctggcaaccctaggaatattcctatttccggtgctcataagagcaatgttgtagaagttggggatggaagatcggataacatggaaggactactaaacactgcatttggcagggaagatagctttgagtctatatcgagtgcttctatcgatgatgatggtatttattttgagtctagctatgcagaacctaatatggttgaggatgagaataatacatttggagattgccataatgggggggaacaagatatgttcacaaggttgttgaaggatgcaaaaacaaaactatatcatgggtgtgataaattttcgaggttatcattcttagtcaatttgtataacctaaaatgcatacatggatggacacaagaatcttttacagcactacttggtttgcaatctgatgcacttcctcaagaggcagatttaccgaagaattgttatgaagcaaaaaaaatcatccgtggtttaggtcttggctatcagaaaatccatgcttgtcataaagattgtgtgctctttcgaggtgacaaagctaaccaagagtcttgcgatgtatgtggttcctcccgctggataactgataaaaatgggtatccagttgaatcaaaaggaaagaagaaaccagctaaagtgttgcgttatttcccattaataccaagaatccaaagactattttcaactgaacaaacttcaggagagatgcgatggcacgaggagggccatacaaaagatggattgctacggcaccctgctgatggtgaggcttggaatgatttaaatactcgttatcctggtttttctgctgatgcccgcaatgtgcggcttggtcttgcaagtgatggattcaaccctttcaggaatatgagttcaaagcatagtacttggccagtgatgcttattccttttaatctcccgccttggatttgcatgaaacaaacatcgttaattttgtccatgatcattcctggaccacattcacctgggaatgatatagatgtatatttggagcccttgttgatgagctcttgcaactatggcaaggtgtggaaacttatgatgcttctgcaaggaagaaattttctcttcgagctgcattattatggacattgaatgactttcctgcattagcttacctatatggttggagcactggagggaaatatgcatgtccatcttgtgctacacttacaaaatcatttcgtcttaaaaaaggtggcaaattttgttacatgggtcatcgtcgatggttgccaccggatcacaaatatcgagaattgggtagtcagtttgatggcactgaagagaaggaaattgcaccaaaaacattgaatggaacttctgttttagaaatgctgcagggcagagtatttgtatttggtaagaaggtaagcatagccaaaatgtcaaaaaggaaaagacaagcaaaaaaaaaacactaatgacaaagggagcaatcggaaactcaacggtaagagaaagacatgtaaggagaaatcaagtgataacccaagtaagtctaaaaagaaacctgaggattggttgaaaaagaggtcaatattctttaagctagaatactgggagtgcaacaaattaaggcacaatctagatgtgatgcatatagagaaaaatgtatgtgataatttaattagaactttgttggatattagttcaaaaacaaaggatgatcttaatgcacgacttgacttggtaaatattggcattcgcccagaacttcaccctacaatagatgataaaggaaagcaaatattgcacctgcaccctttaccatgtcaagagaaaaaaaaagagattctgtgttcagtaattcagaacattaagactcctgatcgttatgcatcaaatatttctaggtgtgtcaacatgaaagattgcactcttaatggtctaaaaagtcgggctgcaggaat

SEQ ID NO: 32176 - DNA, 484 bp, Oryza sativa
acgtagacgcccaacaacggcggcataaaggccagccgtgcaggcgaaaacaccagtcggcggcggcataggcaagccagtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcgggggcgaaggcaagccggtcggtgaagacgtagacgcccaacagcggcggcataaaggccagccgtgcaggcggaaacaccagtcggcggcggcgaaggcaagccggtcggtgaagacgtagacgcccaacaacggcggcataaggccagccgtg

SEQ ID NO: 32177 - DNA, 546 bp, Oryza sativa
gtcctcgcctatatggttggttggtcacaccaccgttcatgggcgtccacgtcttcaccgccggcctgcctccgtcgccgccgagtggtgccttcgcctacacggctggcctattatgccgccgctgttgggcgtctacgtcttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctctgtcgctgccgactggtgtcctcgcctatatggttggttggtcacaccaccgttcatgggcgtccacgtcttcaccgccggcctgcctccgtcgccgccgagtggtgcctgcgcctacacggctggcctattatgccgccgctgttgggcgtctacgtcttcaccgccggcctgcctccgtcgccgccgagtggtgcctccgcctac

SEQ ID NO: 32178 - DNA, 768 bp, Oryza sativa
tgttgagaggtcccaacatctagcaagcatttcacgctcccttggtgaagaagatcttgttggggtcaatcaaaatagagaaacacttgaagagtggctggcagatgatttgttggaacgttcagtaattacgctgcatggaatgggagggcttggaaaaacagccttggcagcaaatgcatacatgagggagaaagaaaagtttcagtgtcatgcatgggtctcgatttctcaatcttactgcatcaaggatgttctaaaatgtttgatcactgaactttccagaaatgtgaaaaagactaattggggtaacattactgacatggatactggaggttttcgtgaagagctgaagagattcctaaagctccagaagtgtttgatcgtattggatgatgtttgggcgccagaagtaatcaatgatttgtttggagcacatgttcctaatctcaaagggagcagaatacttgtgacaacacgtatcgatgatgtagctcaacttgctttcccagacaggagaataacattagaacctctatgtgagaaggaatcatgggaactcttctgtagaacagcttttccaagggagacaaatcatgagtgcaatgcagaactgttgcacttgatagatcaaatagttagcaagtgtaagggggttcctctggcaattgtctctattggcaggcttgtctttgtgcgtgacaagaccaaagaggaactgaggagaatacatgaccagctcgactgggagttataaataatccaagc

SEQ ID NO: 32179 - DNA, 1400 bp, Oryza sativa
  unsure (1)..(1400): unsure at all n locations
nnnnnnnnnnnnnnnnnnnnnnnnnnnnnnnnnttgtagcgacataacgatccgtgccacatctatatattatcatgcgaaatactagtattatattgaagagttttaatctagggccgtagtaatataatatggtggagcaaatgaattaagaccgccttgttgggaggtctgctagtcgtttgtctttgttattatgacaagcaagcaaagtcttctcaagttttcccattgctcttatatatacttctacaaccgtaagcagcagccacaatgaattaatgttcacctagaaactctgagctctactccgacttcacagtttgctcatactacatatatctatgttaagttcaaataactaaatcatatctatgttaagaagatgctattgtcaggttcctgatagggcatacctcctacccgacgacttatggaatatgcagatacggtataccttcacgtacgtggattatttctatgtatgttagtggaatctgttaaaaatcatggaaaatatctacacgagtcgagtgattttcaaagtcctactcggaggggatagagtttttgttatatcgtataagatccaatgtcttcgagtcttacttggggatcaagatgatccatggtataaaagggacccccagggaagggtgcaaggcatcgaatctcatcgctaacacacaccatagtttacaaagccggaaaacgcggaaccaagtcgccgggggtcgccgattctgtctacttccattgtaatctttggttttccatcatcaatctcatataaattagagtagggctattacctgataaggggcccgaaccagtataatccttgtcttttgtctgcttgatgtcgtattacgtagatcctcgttccaacatatcccaataccctaatcatccggtatacaagtatcactcgtcgacagctatatactccacaaacatgttattagccccagagtatgacaagagggttctaagtagtttaaattggggagaaacttttgctttctgatatatcaccatgttctctatgttaaatcttttgtacaaagtaaaatataggttaaatctactataaaaaataatatcttaaacttaaaatctattgtccaaattagtatattttaaatctttcatctccatagtgtcaaaagagttgacaagtaaacctgcacaaatgtggattctcaatgataaagttgacccgtacaaatgtggattctcactgatatgtgatctcacttcgttttccaggtggttttcataagccaccacctctgaagagattttatttattatttaaaaatttatagaaaattcataaaaaaccaattaagattaacaaaatttcagagtgatccttactacaattcgatgggggatcc

SEQ ID NO: 32180 - DNA, 28066 bp, Oryza sativa
  unsure (1)..(28066): unsure at all n locations
aacagcatataccttgatccttgataccttcaaacgcagtaatcaatgttatcattatgctgaatctcctgcaagcagcgccaaagtagatctgacagcagaagagatgggctcatcatgcttgccaacaccagaaccactgcagaatagctcgaagctctcgagctcagttgctgtctctgccacttccttcagcgccttgtccatttcatacctcttgaacaccccaacgtaatcttcgttattttttatcagccatttcatctgactgagtgttactcttcttatccccgggaaatcggtggtaggagatttgcacacgctcagtaccatcttgagcatacgtatccattgtaaggttggcactctgtagagccttatcaaaatcaatggcttgcaaggagtggcaaatctgtgagctgaggccaataaagctgtctagtagtttgccttcttcagctttcagttctttcaggtcctagttgtacacagcaccaattttaagtgagtttactcaagaaaagtgagtgtacgttttaaatgagggaagctacatggaatcaatgatgtcttagaaagagaggtttgttacatgagaaggttgtccatcagggaattcaggattatcgagcttctgaactgcaactttgatttcttccaataactgaaatggcattaattgataacatatattacttttcttctaagtttctaactaaatatgcaatacagattgtcatggaaaacataagatttagctttttaacagaaatagaattggaacatgtaacggaagacaaagaatagatagtttactaccgaaacttatagcacgcgaacactttattttaccttcagaaaaattgtattcattgacacatatttcagctattcttcagtggtatggtgatgcagaaaatttagtatcgaattccaattttaggcaaaaactcaactatatgacagaatttacctttggcagagaaccgtcaattactttcttcagttggtttccataacctgggcctgaatacgtccgcaaatgtttaagcagatgtgctatcataatcctttgctccatggaagcatcaaagagcatgccgacaagctcttccagattaattttatcaaggatggttgccctgttgtattcactcccagtacttagcagaactaatgcctgtgcggctgagtcagcaactgtggatccattgttgccatcttgaacaatatccataggccttggaagaaccgacgaaacaagcttcctgacgatctggcaagaacttccaatcacttctctagcagtctcatgcatcgctaagcaagaaaggatttttacagcatgaacagataaactactgttcttgttatcatgctgatacaggatttttctgatgttgctcatgatctcagaattcttggaaatggtgcttcgtagagcttcgccagtctcaccagtagtgctaactagcttgtgcaggacatttagtgaggcctcaactatctcttcttggcttctattctcagtttcatctggaacaggtaccttacaatcatctctgaagtttagcagttctacaattttcgacaaaacgacattggcatcagccacagatctgcggttatctggattctctacaagcctttcaagaattttcacaccataacaagtgagctccacactatttatgtcatgggggccttcattgatcctctctcggcctgtcgttagtagtgaggctataagctgtggcattgcaggcaaattctcgaataggaggtatggagcaagttcaagcactatggatgctgcatgacctctagtttcttcctcttctaggctcttcaaattcagccccagcatattcaccactctctctagtgtctcagtggaagctcgaatacttgtaagcaccctccctttgtacttctcaatcttgtagatgtcaagaacacctgctctagataagtgctgcttctcccatcttatgatgtaatcaagaatcctaactcctttcaactggtcatcaattgaatcggatcgtgccagctcctttccaaaggtgatcaaattcatctcgagagcttccctaacattatacctaatgaatgcccaaagctttttggctgtatactcagaaactgcatccatgccccagtcatgaagcttgtaactagaatggaccaaccttaccaatggagccactaaaaactggaacgcaacaatcaagatgtagtaggacatgctatgggcaagggccagcccatagaagacattcagggaacctctaatgttcttgtggtcatccttaactttgtcttttggatcgacgtagtcttgcttgagtaaacgccggaacgatatgaagatgcaagcgacgagtgcagctgcctccatccatgtcagggttgtctggaatatggtcatcttgacatggcgctttgggcaaaacatgcgaactaggacattgcgttgattctgtcgtacgcttgacgagcctttgctggcctctccgttctttattgtgttcttccgccaacttccgagtccaacatgcgtaagttcgtcacggtgcagcatcgagagtggtacccgaataaagagttgatcctcgggtttctgggaaccgccaaaaaccctaccattttcaaaatgatcagcacatatttcttaagatagtataaggttctgttcactttgatgtcattttcaaccatacatttttttttggtaaagttactaaaaaaatgtctatatttagtttgctgccaaatttgatcaatacataagaaatcctgccaaaattttggcaatattgctatcttgccaaaattttgacattgccaaaacttaataaggtttattttggctacaatctgaacaggtcctaaatttcccaaaactaccattattttgtcaaacataacgctttaatttgcaacaactttagataggtatttcacaaaaactccagctatagaaaaagattttaattatcacaaaactactactttacgatcctctatgtatatgacatgtagacctaacttacaccagcctaagtattgcatctatgaatgacagatggctccaagaattgtcagactaataaagtggcagatttttgataaaatcatagactatatattattgtagcaatctgaaatgtgtctagtatttactcttcttaaaaccatgtatcaaatgaaaaatagattttcttttacgctacttgcttaaggttgtttcacattactacattaaggaaaaagtacgaatacccccctgaaatattgcgatagtatgaattgccccccccccccccggaatctcaaactattgaaaccagacgaattacccccccccctcaatccggagcagttttagtcctacgtggcatacacatggccccgtcgtggaaatccaatcagcaaaattaggtggtcccacatgtcatgcttatgtatttcttccactttcccctctcttcatctcctccagggcagatagaaagcgacgtggcggtggtgctctccagggcgggctggaaagcggcgtccagggcgggtggggaaagcggcgacgtcaagggcgggtgggggaagcggcggcgatgacggcaccctccaggtcgagcggggtcacgtgcggctgcgctctctagggcgagcgggggaagtgacggcggtgtcgtcgccctccagggcaggcacgggaagcggcggcagtggcggatttgtgggagcatgccagcgccaagcggcggcaggcgcggcgggagcggtagagggcgtggcaaggagcagcagcgacagatcgcgcacgtccacgaccatgagagtccccacctcgacagagccttggcgcacgtccccccgaggtgtgatgcgaataccgatgaggcgaccttcaccaccgtcattccagtcatgcccgtcatcgcgctccgctcgaccgaagcttcctccccgccgcctcgtcgtcatctggagcttactcccagccgcacccccttcccgctgctcccgccgccgcctggagagtccccccattcgcgcctgtcgcagctcgccgccaacctattccccctccccatccgtgcctgccgccaaccggagccacccatctgtgcccactgccgcttgcccagccatgcccaacgccaacatcacagaggagaagtgacaaagaagaaggggtcaatatgacatgtgggccctatatatattattttttattattttttgctgattggatttccacgtcggtgccacgtgtatgccacgtaggaccaaaaccgcttcgggttgagtcagggggtaaatcgtccggtttcaatagtttgaggtttaatatgtctggttttgtggtctgagggggcaattcatactgtcgcaatagtttaggggtaattcgtacttttttttccttacattaaccaacaacagctatttcctagaagcctgtcatagtttacctaattaaattaaatgcattaattatatcacatgcattaattatatcactactgaagaaatgatctttactgggtggtgcaaaaaccacattaatcccggtttgaataggaaccgggactaaagatcatctttaaccccggttgaaaagcccaccaccactttatgatctttagacccgggactaaagattatttttagtccaggttcaaaaagtgtgtgtccccctactatttttagactcatatgataagagcaaccgggacttaaaaatcgatgcgtcgtatataatacctcgccattatcctcaagcaaactccccctcccttatctcctcattttaacttcctcttcctcccttttcttatcctctctctttcctctctcttatcctctcctttaaaggaagcgagcaagccggcggattcgaggtgcacggcggcagcggcctacacggcggcgggcggtgcggtgggctgcacggcgggctgcacggatgtctattttgttgatttgtatgtgaatttgttgatttgcaggtgatgtctgtggatcaataaatttgtagaagcctgggcggtgttggtgaagctggtgcgctgacctcgtgggggcgattcaagatacatcgccgcgccatgtactgcctctatccctttctgtccccttaggctccctcttcccgatctcatcagcattcggctgtagtgtctccctaatctctcttctcggttcaaagagcaaggcatggcggtgcctctttggtggtgaaggaagaagatggcaccgttgctctaacctacacacggcgttgacttgccctggcaggagctcactggtaggcgtctgcaataaggcggctgtcggtacatcttggcacctagcgcctaccactccgctgctgcgggcgtcccgtgccatgaccacaaatgtcgatgccacaaccaccagggacattaggcccaagctccccgcacgacctgctttctcctccctctcccgggccaggccatcctcccctcttctctctccctgacctagctcgctgctccgcccgcttgcacctcccctttgcgaagtctacactgccaccctcctatctcccgagccgctagtaggtggggcccacctgttgggctctccttcaacctccggttggttgaccggccggaccacaccgccgctcacatcctgccaaatccggcgcccccccggtcacgagctcgcatctaaacagcgtcgaactgtctccacgttcccgcctcatttcccccacatccccgtggccccctgtgtgagatatttaactatttaccacttttagatgtggcaattaactatttcctaatggacccacatgtcattgacacatttggacccacatgtcattgagataggggtgcaaatagttaattgccaaatctaaaagtggcaaatagttaaatgcccactaaggccacatttcgcacaagtcgccggagcctcactccgctggttgttcccgctcttcccgacctcgaggctcgagccagcctcccaagcctagaaaaatcaacccccctactccactcatccgtttacccctctcttgcgagcttgccgatgcccgaaaccactccctcgctgagacctacaagctccaccatcgccgtcgtatttcggccacaaatcactgctgctagcgccactgctgcgccacgcccccaccaccagcagcttcaccgcatcgagctccaccttagcctccactacgtgtttttcccctccaccactggaacaccgccgttgttccccactccgggcgcacgctgccaccgcctagccaccatcgcaccgtgctgttcacgttgccgcatcgcagcgccgcgccacgtcctggccgccactccactccaatccgccaccgagctgccacctccatcactaacccgagctccaccagaccaccaccctttcgccacctctggccggcaattgccgtagattggggcaatcccatgccccgttgcttcctcctccagctttgcaaggacgacgagccccacggccgccactcggttgacgttccccgccaccgaaacccaatttccctcgcacgccggtgagtcccaccatttcccgtcctccagctagcaacatcctccttctctctctaatcgatttattgtccatccttagttgtcgccgccgcttgtccgccccttcgctcgcaaggtcatcgtcgttgccgtcctctcctgcaccgcccgccgatgtttgccgatgagatcaccctccccctctctccttgtttcccttttttcgccctcgccggcgcctttcgcgtgcagtgccacttcctgtgccagccgccgctccccgtgtctctcaccatcgccggcggtggtcaccgccttctcgggctggccggcgcgcctgcgtccttgttcgctgccgccgcctagctgatcttggccgcctgttcagccttgggccatttgggccatcggtcgcccatgcaccccgtggacccggtccatagcccagccgaccgttgcaatatgacccccccccccccacaccccttggcctgctgacgtgtggggcctacatgttggcgccggcccattgatgacaccagcatccttgtttttctttgttaaaataattagtaattgcgcaataatttggtttaattccataaattgatttaaatggttaaaaacttctaaaattcataactaattcatatgaactccaaattgagccattcaacttgcataatttatataaaattgagttctatacaaaattgagttctacatgtttatacttttcatgtactatttatttggtttttattagggtttttgttcattttgtgtgccatcgtgtagattctgctagttttcagaatatcgtgaccgcgaggaaaaatgttcctaagatcaatcgaagaagcaaggcaagtcacaccttccccttgagcatattgagcctactttataaatgtttttaccgtttgcaaataaattgcacgctttgctaattacatgggactatgggattacctatctgctcgcttgtgccatgtttacttgtgatccatcctttgttagacttgggaaataatttgtctagcttgtttcacttatattgatcttgctagaattatgatatgcttagccatgcttaattaccactaccttacctaatgggataatcacattatctacttctagtatcctaatgggataatcacattatctacttctagtatcttgatgagctgcgagctcgaactacatggccatgttttattggtcgtaactatccatttaaaatatgacttaatggtgggttgtgggtgcatcttttttatgatcacaccatggcaattaagacttacagtgcttatgacaagaaagaatgggcaaatgctgaacttgtagtgcagctttttcctttgtgacgtacgaggcaagggtgagcatgatggagtttggatgggccttgcgatgacctttgcgaattccggattcacctaggcataagaggttagaagtgtagtgcttttgagccgaagacgaagttagagtaccaaggctcataccccgattaagttttgcctgtggagtggagctgaggatcgcctttttccgctgattctgctttcttttcggtgtgaggaccaagtgtttcttctgaaaatatttacgcaatatttatgtttagatttgtatattaattcatcatattgtgtaccctggtttgattctttgatagggatttatatacaaaataatctgaaaatttggactaaatttctgggcgtgacacagacccagcccaaaccgcagctgagctcgagtaggcggcgtggggtaagcctgttccaccagttggcaggatgggttgttgtagcagctgcagctccgtcgccgtggggtggggacccagcagcactagctcctcgccgctgtgatcgccatggaccttggacgttgtcaccatgttcctcctctgctcacactgactgcatctttgtcgacgacggacgtgcatccatccctctcctaacggtggtgtcgtcgccaccatcgtcctcagccgctaccacacccgcgctctttctcacgacctcggtgtcttcaatcctagaggatgcatgtggcgtggtggactgttggttggcaagggaggggtggagaaaggatttcggacatgtgggtcccacctaatgattattattgtaaaattcatttgagtgaaaaggatcaaggcgacgacaagtcgaaccgtggccacatatgcaccatatcagaacaaaaacatcgtgcaaacttcgaagggatgtaaattgatctaattttgtaagtcggaggatgcatgttctctacgtacctagttttgtggtcgagtggtgttacggaaattcgtccaatagttgaaattccaaccagtccatcccacgatctttgtggatgttggatgggcttgccgactatcgtaataattttttgtatcgtatggtctaaagtttgcctccgttttaggatgacacatttatagatagatctatctctatctctactattataaaagttaaagatatttttatcggtattttggtacgttatccgtgtacgagtcggtttttaagtttgttcgcttttggaaatacatatccgtatttgagtcgggttttaaattcgttcgctttcgaaaatacagaagaaattgtataagaaatattttttaataaaaactgacatgttaacttgagatgatcatactcctaattgtagctcatgattttcaccttaactaaaccatataacaataataaaattaaaatagccttcacctgttgcaacgcacgggtattttttctaattattatatctactattataaaagtttatgtttttgtcgaaaattttcgtacgtcgcatatgtatccgattagaagtaacctgcgcactaattaattgtttatgttttctttttttcatcgccgtgtcaaatcatctgtgtattgagcgtgcatcagttttcctaccccgttagatcgctggatcgagcactccaattcagcctagggcttgtttagttccaaattttttcttcaaactttcaatttttctatcacatcaaaatttttttacacacacaaactttcaactttttcgtcacatcattttaatttcaaccaaactttcaaactttcaattttagcatgaactaaacattcaaatattagtttcaggaggcgtggagcgatctggccataagaaaaactaaaagaaataaaaaaaaagaaaacggaagttttgggctggtttgatttaggctgtggttagattaggggtgtaaagttttggcgtgtcatatcatatatacatacgcacatttcaagtattactagaaaaatgcccgtgcgttgtaacggtaaatgctattttagttttattgttgttatacagtttaagtagggtaaaattcactgtggtaatccgctttgatattctttttagaaaatcataaggtacaattagaagtccgtattttacctcaagttagcatgcatgtttttttaaagatattccttctacgactccttttgtatttccaaaagaaaataagcttaaaatccaagccaaacgcggatctatatttctaaaagcgaacgaacttaaaaaccgactcaaacacgggtgacgtaccaaaatacagcaaaaacatctttaatttttataatagtagagaaatgcagtctaataacgaaacaaataacagaatccacctgtaaaccgcgagacgaacttattaagcctaattaatccgtcattagcagatgtttactgtaacaccatattatcaaatcaagcgtaattaggcttaaaagattcatctcgcaatttacatgcaatctatgtaattagttattttttttcgtttatatttaatactccatgcatgtgtccaaacgttcgatgtgtgttaacgacgaaatttggtatgcccgaagttatcatcggcctaaagtcagtatcggcttcagagtcctggaatcggccgatgagaattaccaagtcgccaatagccgaattcctgctatattcggttaaggaaattaatatattaaaggaagcttatccagaagtgaccgagttcaaggaggatgcagcacgacaagttatctattaattagaaatagtttgttagtttccttttatctttaggaaaatgtgtttagtgtcctataaggactttatgttttccttttatctactatttgcatatcttgtctgttgcagggtcaaactgactggcacgcccgtatctcgtcaacctttggacctgcactagagctaagcaaatctccaaggccagtgtgtgttttttgcatcaacacatttttggcatgcccgatgggacccgaatttcgcacccaacatgtctgaagaggaagtcaataccaagaaggaacaatctcctgagccgatagttgaaatacttcaagatacagttgatgaagcagttcatcgcgcattgtttaatcaatctggagttttggcggatacgttacaaaatttgatcaaggtatcagttgacgatttaattatccagaaaagccagctcggggggcagattgatgaacaacaacagtatcggcttgggggcaagcatatcagtatcaacatgatgggctatatcaatatcggccagacgaacttcatcaatatgggcatggtgaagaatgccaatataacaatgattgggccgatagaattgcaaagatgatagaagagcagtttggaattaaacctaaggaacatatttctgtatatcgactgtcatatcataagtgatttgatagggttctattgccacaccaatacaaggttctagacttctcccaattttcagggcaagatgatatatctacaatggaacacatcagttgattcttagcgcaatgtggggaagcatcggctgaggaagctctgaaagttagattttttccgttgtctttgactgaatcggctttcacatggttttcatcgctatcatcaaattctatcagagggtgggccgatcttgagaagcaatttaatgactacttctttgctggaatcaatgagttgaagctttcatacttaatatcggttgagcagcaagaaggagaatcggctatggaatatattcagagatttcgtaatgtccgcagccgatgttatggtttgagcctaaatgatgagcaactagcagatctcgcattccaaggattgtcaacacctatcagagagagattcttttgccatgagtttgacaacctggctcatctaatgcaaacagtataggctcatgaaagctgattacaataagcaaaggaagatcagttttgtagttatcaagacaagaaataagataattttgaagcatgagttttcatactccaaaactggggggcatgtgctaacgatcaaatttggtaagcccgaagttatcatcggcctaaagtcaatatcggtttcagagtcctggaatcggccgatgagaattaccaagtcgtcaatagccgaattcctgctatattcggttaaggaaattaatctattaaaggaagtttatcgagaagtaaccgagttcaaggaggatgcaacatggcaagttatctattaattaggaatagtttgttagtttccttttatctttaggaaagtgtgtttagtgtcctctaaggactttatgttttccttttatctttaggaaagtttctttcttgtcctataaggactagtatctccccatgagtataaatatgtacacccagggtcattgtaatcaatcacacgatcaatacaactactctcggcgcatcgccatcctctttcttgaggtttttacttatcatccgacggaatttggcagctgacgcggggctgcatcggctttcgatctccggcgaagaggtaagtcctacgttctaccagccctggtgaatctatcggctacattggtgttgttcaaggctgcatcgcttcaatctcttggatcgctctggtttggttgatatatttgcctacctgatatctcaattatatctctaattacattgtgtttagagacacatcggtttagttgggactgtctcggttaggtccgatcttctatcttagccgatatatctctacaatcacaatgttgttctaaatagatttgttatatctatcacattagacagatctattggctcatcgagtattagattactatatacaatctcgtgctgcatcggttaggttcaacctactagattgttgttgataatataggtcttgttaagccgatcggttcatgctaatattttatcggagtgctagccgataagttatctagatgttgcatcggcttataaggattgcatatacatataagttcgatttagccgatgacaacaaaggtttaattgatctatctaatcttgtggattttatgacatcagacctccagccgatgtatgctttaaccttcggatcagtacttgttctattatatcataatgttggccgattggtttatactggattatattattattatttatcatcatcagccgatcgcctttatatcattatctacattggacatatagccgattgttcaaaaccctatcgctatcagctggtatcggcatcggctggaattgctccatcggcttgtcagccgatcggcttattgatctactatttgcatatcttgtcagttgcagagtcaaactgactggcactcccgcatctcgtcaacctttggacctgcactggagttaagcagatctcgcaggccagtgtgtgtttttcgcatcaacaatatgacaaggtgaaaaattttagtgtgggatctaaacagggccttaggtatgttactgatcaatatgggctatccatttgtcacatcaattttttgtctgtaagtccaatcgaatgatgtcctccgttctcacacgcgcgagtaacacattgggtaaggtggataaaaaaattcaaagataaatatgaaatcctttgtcactgccggatctgctctcgggaagccgccgtcggatccgcccgttggaagccgcctcgtcgccggatttgcgccgacactgccgacgttggatccgcccgcaacaagtcgtcgacttcgtcgtcgccgctggatccgcatgttgaagccgtgggaggacgccgtcactcgtggtgggggagggagctgccaccgccacccatattaaggagggcgacgctgctgttgctcatggaggggaagggcgccgcccccgccgccgccacacatgctaagggagggcaccgtgccatcgctcatgatgggggagtgcgccatcgctcgcggtgggagagaggaggaatgaatttaaggttagggttttaacaggcaatgtttatctaaatcacgagtgatcctaagttcctaaccgttctatcgaatccaacgactctcagcgcacctatgtcgacttgtgccatgacctgtcacatgggcccagtgcacttaacaggccggtcacaacatccttctaattatgagactaattgtgttttatttattttcaaccgatttaaactatttttccgttaacaaacttagttcaagcactatttttagccattaaaaattacttaaatttgaaatatgttttcattcttcatattaaattatttctagctaaatggagtcaacaaaaatgtaattatttctttgtcatgatatagaattaggtatagatttaattcattatttatgtccatgaatatgccatatcctaattcccatgaaactataaaataactataattattatcataacattagtttttcccgttgcaacgcacggacacctttaattttctagtctctactatataaaaattgaagatgtttcagccgaaactttggtgcttcatccgtgtttaagttggttttaagctagttatatgtcacccatatccaattccacgcacgtgagtctagaataactattaaacaccaccatcccatcccaatccctctctctcccagtctaacccaaccaacccaacaccatcccaccgtccatctcgcgctcctacacttgggcgccacgcacacccctcccctaatcagcttgtttttttctcttcctttttttcgttttctttttcttcttttcttttgtgccgataatcttgattatctccctctcctttcaatctcctctcttttctcctctttttatcttgtttttctcctggaatatcttcaccacctactttgtagaaaaatcttaatgggcttccgtttttcatccatcatcggtcacaacgtgtgattatatggacttttgtatctttagtgaattttgatatacgagaatttaaacgaattttaaacaaggggagactagtaaaagaagaaagtaattcaaaagggaaagttgaattcgctttcaaattttcaaattgagtttgccgaagttttgagaaaggaaagtacggatctaagtgatttaaggtattttcccgttgcaacgcatggatattttttctagtaatttaataaatatgggtgtaattggatcatatgtgagataataactaatttaagggaaaatatttgaaactcgttagagcgatacacacacatgcatgcatgcataggagagagagaggggctggcgtgtgcaggctattcacagtgaaagaggggcactgcctgtagccatgggacgcccaatttttctcttgtgatcgagtgcccaagaacaagccagcacttttcctatgtatcaattgatggtggaaacggaaactaattagcagtttagttaacttctactttatatatatagggatgtcgtattgatacgcaccttgttatttgcatgaccacgatgatggtgacgaaccaaaagtccttgggctttatcagggtggagaatccacctagcagcacaacggtggcccaggcaagtgccagcttcccgaagccgtccatcaacctaaagtagattgcaagccagaggactgttatgtttaacttacttgtatcttctggcagctggtccttgcctcctccgttctcaatcccagctgcttcctcctgctgctgtgaagccctcgtcccggctgcctccgccatcgctgcaggagcagcactgggcgactggctcgatcgatctactcctacctagcaaagagtacacactatatatatggagtaatcatatatatttctcggttcttgatatatatatatatatatattaatagtgactcttgggaggtagatcgatctgcgagtcgttctatagttatgcaagttggcaaagtcttcctttgccctggaacttaattaattagccaatgagcagggcgtacatggacatgatataaatcatatggaagacctactcttcgaccggtatcttggaatctgcagacaggtcttctttacaaagtcacaaagttaatttaagaaaaagacggcgaccaggaagtaggtctttaccaactttgagaagaaacaaaacaccctgttgcaaattgcaatacaataaattaaatatgctagtgtgcaagccagtggaggattaattagccgttcagtgatgatgagggtgctctctcgtttttcttggcacgaggataactcccgcttccatccaaatacgatgctaacaaaacagctacgactaagggcttgttcggtagttggggttgtttttccccagggaaaataccactaggcagggattgggtggatgccctcccaccacccaatccccacgtcaatccccttcaccgtgggatataatccccttaacccatgggatctaagtatattattggtgtggtaaataatagtgagtggtgagatatcatatcaatttaatagtctcactccagaaatttcaaaatattatgcacataattcgaaatacggcacaaacaaaatataatttttcaggaaaatacagaaaaaagatatataaggagatcacatccaacggaaatcccccatattgagcctttggtggtcttattggcgcataccacggtggggtcttcnnnnnnnnnnnnnnnnnnnnnnnnnnnnnnnnnnnnnnnnnnnnnnnnnnntgaattcatcaatttttgaattatggacttggcggtagtggtcaatactaactgcaccgtctaaatgctccctgaccaagttagcgggatgtttactattgattggttataggccttccttccaagcatcaaagaaagaaaagagcaaagcaattccatcttctattcgctgggatcaagcttttcctctgcaggggccttgtgcaataaaccccctacgggcggtcacccatcgtcgtaaagtagtaaaggtccccgcgccagtggtagtgaagttctcactccacgtcggccggccgccatgaggttttccgaaaatgcctagaaaattacgaaaattgtagaaaattaaagaaatactgaagacctgctgcaaaatccatgtcgtaattgttacaatattgcaaaaaaaaaaaggcaaccaacattaagagccaatacacattgagatttaggacacacaaatatctctcccagttaccagtatcaaattgaacaagacataacttgagcttcattgccttaatagttctatctagtaacaacactttccgacatacatcataatacatttccttgcatcattgttgcagcaaacaaaaggcccgtggacatcacatatcagaaaactgcacaccaaaacaatatgtcaaagttagtataattatttgtgtcaaaagcctgacaggcacctgtaaatacacttctaaaaattcagctaactgttcattaataatcagctaactgcatacatgttcataatcacagaaggaacatttcgtcaaatcttcagcccatgaccagccccatctaatctaacttttgattgtaagtaattcctctacaattttatttaataacttagagactatccacatgaatcagacataattaattcttattagtaccatagtagcatatgcaccttaatcaaaaattaactaactacatgccacaagacaattcaacagatccttcaaagaaacatgcaccaaatctatttctggatttaggatagtaggagtaccaagtactaactgggagccaacaatatcatggaaaaacatgacaatcttaccccactttattttctttttcaaaccaacaatatcatgaagaaacaggacaatctcataataccaggatactagtgaccaacatggtcatgcatgcttcatctgtgattagccaacatggtcatccttgaagttcctctgaacagctccagaggaaaaacgggatgacaatccttgtgccatgttctcaggatctaaattgacattttgccgcccagcagtcaggtccttctcgcggtcacaaggcttccatgggtggttgatggttcccttccctttcttctttctctcgttgcttctgcttcttttctttttttcctttttgctctctttatgcttttgcacgagagatactgatcgtttggaggaattgtatttatccaccaatgaagcgtctgaggttttactcttttcatcatctgcatctgcaatttcctttgctttgttgtataggcttctaattaagtagctgtgacaagcacgataatattattccatgtagatcattacattcatagtgcataaagggcatcgtacgtactaaatatcacaaacaaatttgtcattagaaagacagaaactcctgttttcacatcttcctaagttcaaccgggcctatttaagaacaatcacctaaaagatgatgttctttaccaaacgctgcattcaagatttcaaggttgaaggaaacatccttctcttcctcttccaactccctctccctccacggagtgcgcggcgaaggcggcggcgagctcgggcgtgggcggtggcacccgggagtgggcggcggctctcgggcgtggccgcgagaggagctcgggtgcacggggaggccggatccaccgccgccgggcctcggggaggccggaaccgccgccgcccggccgtggggaggccagatccgccactaccgggccgcggggaggccagatccgccgccgccggaccacggggagggcagcaccgacctcggtgccgtcgaccatgctgctcgtctccctcctctccgacctcgacgccgtcgaccgtgctcccgcggctccctcctccgaccgtgctgctagatttgattttttttttcttttttttttgcatgttattccagatgatgcacatgttttgatctgtgtaaatgatgtttgatctgtttgatctgtgctgatgatgattttgtatttcatgtttgaatttggaaatgagcggcgaatctagatatggatttgaattttaaaattaatgaatcaatgggcagctgcatgggtatttctttttgggcccaaaatagactttcactggaggccgatttaacatagccgccagcaaaaatccattttcgctgacggccgtcttaagccaacgccagcgaaactggatttttactggcggctggcttaagatgaccgctaacgaagatcttgatcttcactggcctttgctttgtggcggctgctccattttttcttgcggtcaataaccgctagcgaagatcttgatcttcactggcctttgctttttgacggctgcaaaatccgccagcaaaaattcaaaatggccaccacgaaaaatggttttcatagtagtgagatgaccatttgaggtagtttagctactatcaaaattggtgtagcctatgatttgacatgactcaccgaaaaaaagaaagataaatcgttatttaaatgaggaaccaattcaactgataaagcttcttcattccttacctccagccccacctgctatccaaacctccaatatagcctgacccgaatcgaaggcacactaaacactgctaatccccctactttagaaaagcctggtcacccatctctcctcccatgaacaatgaatcatcgcgcagagtaaggtagaacatgattaccatggccagccaaaggggacccgaaccaccacgtagaaagacaaatctacctttttaaattttacgaaattttatactgtaatctactctctccgtttataagtcgtttgactttttgtttctagaccaaatttttagaaaaatatagtattatttaaaaaaacaaatatatattatcaaactatattcaacattagatttaataaaactaatttcatattttagatgtttttaattttttctataaacttgattgaactttacaaaatttaactagaaagaaagtcaaaacggagggagtaattaattggaagatcaaatcggcctataaagttagatcatttataatggcagcatactactcgtatattgtagcgtaaaagttctgtaatattataaggctaataaatagcttagaaaaaaaatatttaattggtactaaaatgtaaagttatagaagaaagtgtatttttagaagtgtataaaacatgaataatccatccataatctatgtcgccattatgagaaattctgatgcaggactaatttctaccggaataagttcacctgccatcccttatttttttgacatcccttatcctcaatatcagaaatctttacccctaaactatataaaaccgtgcaatttaggtcccatagtagtatagatatctagtttcactgacgtggcatcctagttaaaaaaaaagtatatgggagcccacatgtaagtgagaaaaaataatatgggacccacgtctcttttttcttttctttcttctcctcttctctcctgctctcttctcgtgaggtcgccggcggcagaagagggagagacggccggcaagcccagccgagctccgccacctcgagaggctctgccgccgccgcacccgacggcgacgacgacgctcacgtgcgaggctgctggatgctggcctcttcttccccctctctagtgttcacacctatgataactaaagaaggaaggctcacgacagtaggtgaacttattcctgtcgagggcggtgcggccgaaatcgaacgctgcggtggcgatgtggaggcatggtcggagcgtggcgagccggggctccctgcagttgggcagcaacgagcgcctacctgtgaccccaagacggtgtcctctggagtacccagccatcgagaaatagcctgggatgatcgtgccagacggtggcggcaaccgaggaggacgggaccgacggccgcagggctatccatggtgatggcgctgctcgccgggtcacctagtcacccggtcatcaccggcatcttcgacggtggcgggtcgtcgtccatggccaagaccgccaagatttcatcgcgtggaggcggggatcgcagaaggaggggtggatccatggcgatgagggagaaggcgccgcaagcttttcgatggaggagctacccagccaccttatcggggaggtcctgacctccggccgcctcgccgccgggaacctcgcgaggcttgaggccacatgtctcgtgctctgcccgctcgccgagcacgccgtgtcaagactatgcgtcgcacgtgcggcactcgcggccatgggccctggcccgccacgcgcggggagctcctggagaggtgcagcggcagctggaagaaggtgctcaggttcctgcagtccgtcgagcagtcgtccggcactgtccatacctcctccggccgcttctctcgccctctccctcctaggctcgccggcctcctctcctcccggtgcccctcaccccccccccctcggggcggttgcttgggaagaaaggagagaaagatgttggtggcgcgggccccacatattttttttattttaactttgctgaatagaatgccatgccagcgaaaccgggcatacaaactgctatggatctaaattgtacagttatgtatagtttaggggatgaaggtttctaatatttagaataagggatgtcaaacaaacttggtggtgaacttgttccatttctacctgaaaacatgggcttcgggcttctgctggttgacagggattggatatttgggccttcgtgggcaatataaagggcataaggcttccaagtgccaaccatggcgtgacggcaccggagacacggggccacgactgcgcccgcgcagctagtggctgaaccggcggagacaggggatttaggaatggccaactctatatatggccaaagggcccgcccagcacggcccggcccaggcatggctgggcacggcccagcagtcatcgggccggcatgacccgataggcacttcgtgccaggccgtgccggccgatgggctgcacctcccgtccaggcacggcccaccagctgtcgggccgtgccgtgccggtccgaaggcatgggtggcccatcgggccttttttaaaataagtctatttttcgtccctcctctttgggctatttcatatgtataggtaaaataagtctattttccatccttcctctttgggctgacatatgtatagctaaaataagtctatttgccgtccctcctctttggctgacatatgtatagataaaaaaaagtctattttagatccctactctttcgtccatggcatataatatgtctatttttactcccatatttttttttatcgggcctaactgccaacccatcatgccgggccgggccaacgtgccggtggaggggcccaggcatggcccggtggtcgggccgggccggcatggcccggtggtcgggccgggccggcatgggcccgacctccgtcgggccatgccgtgcttgggccgggccaaaatgccgtgccatgggccgggccgtcgggcctcaggccttttggccatctatagccaactcgtggatgtgtgaattgcagtcataattagttctgaatgtttaatatgtagacatgtactcacaattacaaccgtatcactgacttgctgtggctgaccggcactcgtgtgttacattacaaccattatgttcttttccatgagttcccgactcatctccctcattttccgcatgcacactttcaaactgctaaactgtatgcgttttacaaaaaagattatatagaaaaattgttttaaaaagtcttattaatccctttttgaagttttttatagctaatacttaattaatcatgtgttaatctatcgctccattttctgtgcgagggggttcccaactcctccaaaagaacacagcctacaaattaagatgctaacaagcctacaaattgctactcattttttacgtatctattatgagattaaaatttggtagccaatagtccaatactggctagcaaaatcatctctactacccttatcttatgccatagcttcaacatgagccattcttctatttttcgtcctgatttgccactgaactacagcaaatttttttcttcgatcactcaccttttttatggataataatatgtttgtttattgaaacgaaaccagccgaagggctccaattatatttcaataagcggggataaaaacccaacgggttaaatgaaaagaaaaaacaactcaactacacaagtctcaccaaacacgaggccggctgaacaagcgcaacacaccgaacactgcacacaccatccaaccaaacaaccaacaatggcaaagcctaaacatagggtatcgttgccgagcttgccgcaaagtaacaagaatgcttcgaccacgtagaatttatgttatcgttgccgagcttgtcacctcttgcaacacagcagctccgactccacagcaaaagtgtcatcaatgctaagcccattatagagcgatcaagtagcttccacttcccacacggacatcagccaaagccattaaaatccatcacataaatacggctggcacacaatgtgtcttcgttgcctagttttattgcacccccaacaacacaactctgactctaccttgcaccgcaagcaagaaactggaaccaaggcagcgaaggcctcatgaaaacacctaaaccattgatgtggaggcagaaggccttgagccgagtaggagcaagaaaacaaccattaatgcaccaggaaggctctccaaagtggcagcaccatagaggacatgatgtgaaacgccgtcgccgcttgtccgaaaatccaaatcaaggttttcacccggagtgtggtgtggtaggagtagggataaaaccccacaatggcgcctacaaggaggggatctgcaccatagggcgtcgctgtcatcaaaccaggcaaaatcacgtctagcttttcgccaccgtttccccatccagccccaacacccaagccagctcaagcggacacataggacagtccgtcatctcgacgtcgtgagctcaacaaaggcaccacatctacccttgccacggagctcccaatgacccaatatggaagcagatcgaccatagaaggggaggagcaacatggaggggagaatgttggccaacagaggggtgaacgacttactgcacacctggaccgtcactgtgccaccaccaaccacaaaaaaatgcagtgaaaggagaaggtgatgaccccgccaccacgcaccacgtgtcgccattcatcgacatgcatgccccgagcctccagattcaaacaccaccaacctggccaaatctggccaaggcggccatggatctgacccctccctgaagctcgggccgccgaccctggccatccaccaccttggagccatagcatgagagggacaccatcgccatgagcacctacttcgtagcgccaccgtgtcggtgccatctccatcaccgcgagtgcccgccgtgtcaccgtcgctgcaagcgagcgtgtgctcggaaactggctccgcagcttacgtcctagtggtcgcgctagccgccgtcggcatgctcagggtggcagtgaggagcaagggagtagggaggagaggcggaggtggcggctagggtttcgctgcccgaaccggtccctcctggagtgactaggggggccacagaccaaagcaactcccacttgatgtttttgaagttatcccacctaggacttgggatattaatacgtagaagctgttttgtttgctcgatgcaaattccctaatcgatggttaaaatttcaccgtagcagtggtttttattcacacagtagtgctgcttggttttatatttgtatctttttctttgcaatttttccggtacattagaaacttgagtgcttttgaatcattcgaaaaggactcatgtactacttatatatgtgttatttcagctctcttaaccaaattgttttgctcacttaccaatgaccactatagcacccatcaaaacatgttggataatggaaggcttacaatctaaactccggcctcttcatacctatgatgcataccgacaacaaaccaagttcaatacacatttaactcagaattaggacgaccctcaaccaaaaccaacccattaaatgaaaagagtcttaaactctaatcttgtaattgagaagatgcatctccctgcacgcggtcagactatctaccacacctagccagtaagagaaggcttatggacaaaaatgttgtgacatgcataacctggcatatagctagctagtgttgtagtttatgatattgaattgaatttatattacataacagtagctaattgccacggaatcaagtagcctacgttcttacaccagcttccatatcattctcctctcgtaaagtgtgccaccatcgcataccaccaattctagattggcgcaatgacagtaagaagtcaacagtgatctcctcgaagcttagatatttgaggggcatgagaaactcaatgcctagagggacctcttccatgctgcttaggtttattagtcttaatctttcaaggctcaccatggcaccttgctgaatatccatcctctttagattaggcaagtctcttaaacgtagaaccttcagcttgggaaaccatctagtaaggaagaccagcttctctccgttgtaggctctggtgaaatgtagctctgttagatttaacaaccgagaaagggatggcaagggatcctcttttagttgggaccaaaataggcgcaacgagtacagatttcgtcccccggcatcttcttggaatagaggagactctgcacccaacatggtgtgtgccaatcgtccacttaaacgtagtttatgaaggcttggaggaagggggttcaagccatccaactggagaacatcatcctcatcacttgccgtgatacttaggtaggacaaacatttcatctgaagcagcgactcatagaggcgttcacagaggcttgccttcactttccataatctgagacctctcatctgcctgagctctcctaagcatctaacagactcatcctgagcttccagtgcttgtagggattgtaggcttgtcaagttctcaaggcccctggggatgcttacaccagtgcaccacctgaaaaggcgccgatgtcgatcagtctgtttctcagcaaacaagtgcctaagctttgtcagcttgacaatgcctctaggaagctccagtatgctagatctgaagaggtctagtgttaacaggttggttagcttctcgatagactttgggagaaacttcacatttgaaccacgaagacctaaatggcggagattgaatagatctccaatagcatctggaaccgtgctgatgggtagcccacttaactccagtattgacatatatctgcaattgtccactactagacatagtatgctggatgatgatatcatactattatccaatgtaatgactgatcgaagactatgcgcacaagaaatttcttgatcaatgtccttattaagtttgtgtactaccaatcggcgttcatctctatcctcatgttcccaacgtctattatcttcatcatatgcaacgccaaaacattctcttcggcacaagtcaaccgccaactcatgcatgatatcatgcatccggaatgattttatcctgccaaatgaattcctgtcaattagttgtagcatgttcctgttaaccaattcctgtagatacccttcagccacttcctccattgtgcttctacccctcttactgatgaatccctccgctatccaccaccgtattaatgcctttcttttgagaagatgatcctccggaaacaagctgcaatataggaaacaacttttcaactgtgttggaaggtaaatgtagctcaagtaaaggatattcctgacatgttccaggcttggattatttattaactcccagtcgagctggtcatgtattctcctcagttcctctttggtcttgtcacgcacaaagacaagcctgccaatagagacaattggccagagggaacccccttacacttggcttaactattttggatctatcaagtggcaactagttctgccttgcactcatgatttgtctcccttgggaaaagctgttctacagaagagttcccatgattccttctcacatagaggttctaatgttattctcctgtctgggaaagcaagttgagctacatcatcgatacgtgttgtcacaagtattctgctccctttgagattaggaacatgtgctccaaacaaatcattgattacttctggcgcccaaacatcatccaatacgatcaaacacttctggagctttaggaatctcttcagctcttcacgaaaacctccagtatccatgtcagtaatgttaccccaattagtctttttcacatttctggaaagttcagtgatcaaacattttagaacatccttgatgcagtaagattgagaaatcgagacccatgcatgacactgaaacttttctttctccctcatgtatgcatttgctgccaaggctgtttttccaagccctcccattccatgcagcgtaattactgaacgttccaacaaatcatctgccagccactcttcaagtgtttctctattttgattgaccccaacaagatcttcttcaccaagggagcgtgaaatgcttgctagatgttgggacctctcaacaatgtaatttgagctgtcattactaggattattaccatcacctaccatcgaaacccatcggtctttcgcctagaataggtgcatcaggttggcttctgcatccttaatggacaatgctatcttgtttaaagagagcagaatatttggtcgtgtgaatcctttcttcagataggtactccatccagtatcatgtttatgggaaacaagttgcaggtaatcatccacagtatcttcaattccatgtgccagcattcttatctcttccacccagatttcatacgtctcattattgcgattgcgtacatccattcgagaaaggaattgatgtatcagcctgagctccctcttgatgcggcccatgcttccttgaagctctgttatctgcgaaacaaaccttttgaattttgaagtagcttggttgattgcttcatttcccaaggcaacacaaatcttcttcacagctaaaagaa

SEQ ID NO: 32181 - DNA, 5844 bp, Oryza sativa
attcctgcagccttattttattcagtgtcagcaatcatttgatttagcattgggttactttacaaattaataaacagtagcgttcctgtcgttgctttctgagaatcaaacaacttgcccagccgagaattgaagctattttttactaatatatgtactggtttttctcagttaataacaccaaaatggtcctgctaacacaacttgcagataacatatatggaaaatgttgaaacaattctttgagctttgctcaaatccatgagctcccaaacaactactctgtcaaaaaaatatctgataaaataacatcatatctgatccagacttggttttgcagggtggtattgctgtgagtgataacatgttagccaagttggagtgaatgacagggacctaattaacatttgtgaataagatgagttggcagcgcagtggtcgctcaaggaaggcaacagacctgattgccccttgtctctctaattatttgtttggatacagatgtgtccactggccattttggctagtgtggcaatcacgtggaaacctacttattcgcgttgtttcatattataagtcgtttgttttttttcttagtcaaacatcttttaagtttaactaaatttatagatgaatatactaacattttcaatacaaacaaacatattatcaaacatatttaatgataaatttaatggaactaatttgatgttatagatattgctaatttttttatatacccttgatcaaacctaaaaaacttttaaaaaaagtcaaatgactttaataaacggaatacaaaagaaggccacggtgttaattgaatcagattgcaaagtaaggggggtctattttcttactaaggaactgagccaagcttagtcgtcccttatctctttacctctttgtctataaattctattgaagataaaatagaatagatgggctttagaaacaggctacaaaattaaacatagattgacccaccgcgttgaaggactgtacaatgtatggtcatgattgtataactcatctaatcaagggtacactttctcccaaaaaaaaaaattcaagggtacaaactttttagttaacgtgaggtgtacaattagcataggtataaatagataaatgctacaaccaaattattaaatatggatcttttgcaaattgcaaataccaaaataaatgaataaatgggtttactatccatgtcttagcagaagtgttccatttgcttgtgccacatgacagcatcaatatcattgcttacgacatttcagatggagctctttttccatccttgaggaggtactttttctatccttaaggatgtaccattaagtaccaggtaccattaaactgtctggaaaagttcatatacagttcaaaacaaccggtatgcacagtcgttcagtagagataggtagctagagctctctctcgataatgcaataattcatttctgggaaatggacatgcgaacccaacccatctaacatacgttacacttataacatggatcatcttaacatcataactaacaagcatcctatgcaaccttacagcaaatacataccagcgtactggtgaccaacatggtgatgtttcatctgtgattagccgatcatctcaaaatggctcagaggaagttcctctgaacggctccggacgaaaatcgggacgacaatccttgtgccatgttctcaggatctaaattgacattttgccgcccagcagtcaggtccttctcacggtcccaaggcttccatgggtggtttccttcccattcttctttatcccgctgcttctgcttctttttctcctttttgctttctcgatgcttttgcacgagagatactgatcgcttggaggaattgtatgtatccaccaatgaagcgtctgaggttttaatcttttcttcatctgcatctgcaattgcctttgctttgttgtaggcttctaagtagctgtgacaagcacgataatattattccatgtagatcattgcattcatagtgcataaagggcatcgtactgaatagcaaaaacaaaattatcattagaaagacgggctctcctgttttcacttcttcctaagttcaaccatacctatttaagaaaaaatcacctcaaaaaagatgctttttaccaaatgctgcattcaagatttcaaggttcaaggaaacatcatttgaaaagctaatggccgcaccaaatagaatataagggccaaagactagccttggccactagcacgagtgaaattgtccacttcataccataataaatgaattccatcaccttatgtagcagatgaccattcgaggtagtttagctactatcaaaagtggtgtagcctataatttggcatgtctcagtgaaaaaaagaaaagataaatcattatttaaatgaggaattaattcaactgataaagcttcttcattccttacccccaaccccacctgctatgcaaacctccaatatcacctgatccgaattgaaggcactaaacactgctaatccccctacctcagaaaagcccggtcacccatctctcctcccatgaacaatgtgcagctggagaaatcatcgtgcagagtagggtagaccatgattaccatggccagccaaaggggacccacaggcaaccacagctaaccacatgataaggggaggcttcgagaaactgccactgccagcaccagtagactgagccagcacggaacaggactatttgggcagaggaaaacaaatgacagagaatagtgagagaggaaaggaaagaagataagaaagagtcttgtaatgtggacccatagacagttttctagtttagggggtaaagtggatgtatctgaacagttcaagggttaaatacactttgttcaatcttttaaagtaccctccctgtccttaaacagatgagccccttgatatcaggagctcaatccgctttcgccttttccttaaatagcctaggtagcaatttttggccaaaaaagtttctaacccctaggaagtgttgacagttgacactatgttctctccatctcagtaacatgcacaggatgccaattaatgccctctacaaggcaacaccaatatttgctaaactagcaggtatgcaaaatattgattgataaaggtgtgatatcatgatgtgaaagctagtgtcaaaactcttacttctgttgtgctttttgagctctttcaagaggagtatctgtccagacacttgtatcaccacgtccttctttaccattcatactaaatgacgtagtcgaatgcattggtactccaggctgaaaaggagagttaaacatacatgtaagagaacacaataaaataaccactttctttttttttcctttcagaaggagataaaacagtaaaatgagtatattttactcaattacttttctttcaggaggcaatgtggtcatccattcatctcttttaggtgcctgtgcctgttttggaactgccagaagttcatcatcaccctcaagagatacacctgtaaacaaaataacaacaaatatgccatcatgatagttcttctaactatgcttccatcttcagttcttatcaagaacttgctcggaccagaattgttatgaaggagatgaagtttgttagtaaattattagatttagtttctataatatttgagactggatgtcaagtcattcctccctatatatgaaggcaccccttgtactatattatcaatcaagtaatgaatcccaaaattcatttggagagactttagctctaagcctgaggctaagcctgcgtttgttccctccgtttggagagactttttgctcacgcggaacgagaaagctcattagcacatgattaattaagtattaattattataaacttgaaaaatagaaaaaaatatatatttttaaacaacttctatatagaaactttttgcaaaaaacacaccatttaacaggttgaaaagcgtgctaacagaaaacaaggaagttgaagaaaagaaatgggctttcttttgcataacagggagaagccttgctggcgttattagaggacaagtgccctataacccagtcttcagacccttacccttgaagaaaagaactgggccctctttggacccttaccctataacccagtctacaacaatattcaactctttaaattgcaaaaatcaaatactcaaatgctgaacaaacagaagatgatgaccagacggctaggacctcacaaaaaattacgggttatgaaagtgtataggccctcaataactgcatgtatcaaatcaaaccacggaagaccaacagtccaacatcagtgaagttcacaagattatcaaagaggaatgaacagttagaaggatatctagaattttctcagccctataatctaaaccttacaacaaagctataatcaattataccctataattaaaaattagacataagtgttgtcaatggcccattatagggattcatatttggagcagtacatttggttcttcacgcccaataatgtatgccccataaagaaaatggaatagttaatcttcttgctaaaagcctaaaaatacatgtattttttctgtgtttatggcttttggtgtttttgttgataactagacgctgcacaaacttaccttgtagccgcctccattctgcggcctcgcgcattgctttaagctcgacctacagatgaaaaaaaaggaaaggtaacaactatttttcatgcagctgacagcagtatctgaaatcttagttcaacaagaaaaggtgctctatgtacatcaatatatgatgcaaatgagtttacctcaaattgttccatctcctctttcttttttatcttctcatctatcacacctctctggaacaaagggaataatccagagaaaacatcagtgtaaagaaatttcctgacatggtgaactagtgtaataacttcttaaaaaagaaaaacagtaaaagtaccaactggtatattaacaagaacttggtttctatagaacaaaaggcaataggtatgtaataagttctagacgtaatgaacttcacacatactggagagcattgcttgtttgttatgaaggtaatactatctacaatctaaatttttggataaatcagcaatttatgttaaaccaatcttaaatttccctagcagctgtatctagtaatgttggatcattggcatgccaaagacaaggattattccatatacaccactgaatatctatgcagtccctcattatctcaatgaccaagtgagtccaggtccacatgtcatttacaccaagtcacatatagagatgcagtaactcaaaagaaatccaagaaaatagtatcacggtaacaagttcatactacaaattcataatgagcatataaggctgtaacaaaaatagccaatagttgcaagttaggcataaacatcgaagcaatcagcattttcttcatagaaaattttctgtagtttagaatcaggacacagtacatgcatggattgcaattctcatctctagtctctagtaataagcaagttaatattttgtatggttcagaatcaggacacggtacaatattttctgcatgcattaaatttcaagcaaagaaacagtaaacaagttaattctcatctctagtctctactcatatcagaggtcattaccagttaccacccagtcatctcttggcactatttaccccaaaactatctaaggacaattccacaacttgcatgcagaaattcatttaacagatatcatataccctagtagttgaaacatctactttactattgctcctccatataagagtggagtactttgtacaac

SEQ ID NO: 32182 - DNA, 2876 bp, Oryza sativa
tggatccccccgtgttcatgcaggataagagatcagcaagaacaattaaagaaactttctgaacaacagaatgcagcatgatgaaatatattacacatgaattacaaaataaaagtatgcaatagcctttataaaatatttctatgctgcaagttattgtgtgtaataaatgctactataaattttgctgttccctcgatacatgagctacagccagcaaacaaatattacgtgaatacctcaagatacaataattagaaaaatgctaataaaacaatatatcaccacaaacataagaagaagccttaggttcaatgtcaatttacttcatgtgtaagaaacactactgcaaatttcaggtgaggtcaatggaatggtgctatttcacatgaaactgcatctactatcaggttctttagtgagaatcttaaagttttattcacagaaaggtcattttgagtgcatggtataactgcatgtgtaaatttgttctgggcaggttagaggttagggccctcatgcagtcaggcatagccaaggagaccctacccaagtggcatgacagcgcgcatggagacaagcacaccgcacaccactaggggaagggataagatggagagataaaagacacatggattcatttcttaatgaaaagagatacaaccccatcgttacatagaagggatgacctttgtgaaacttatctctgaaattaagaaatatataacaatttacagtcaaaaacatgtcagcgcataggattgaggcccgactgaggacgatgaaaactttgtagcccagggctgtatgccagcagaaattagacctaagtagtaagactgctagaaattgaatctccatataagttttccgttctttctgaatgttgggcccatttcatgaccactgttctgaaacaaattttacaaggccgcatacagggactttgtgcccaatctaatgtattaaatcatcttcaaaagaactaatgctacaagtagaaaatattgatatgataggtgttgcattcaccagaaatgactaaaacaaaaatattcttgaagccttgacatcattttttgaaagcataatgtgcaacatttgcatcttgctacagacataaaaaacgtcattgcactatgcaattgtgtggatatctgtactttaaatttgtgcttgtgacctgtaccatattttcagtgactactttgtaggcctatgaaatatgtgcatttcttcgcagtgtatactgtatatgtatgcatgtcattcgcaaattacacaactgcaaacaagaaaagcaaatgcatacaaattactaccttttcttgatgttatcagatgacatcttccaattgatgcccacaacatcatatggcgagttctcatccgccgccaatattcgagtaacctacaaccaattcaaaaaaatacaataaatagttgaatgtagcccagaaaatgaaaagcagttagttgcattgcgactttcaagcaaaaacaagtacttttggcttggagtctgaccaacctaatggaacatcaattacaattatccaaaagacaaatgagtattatacaacgaaaatgggcatacagaatatagcctaacaagaaagttagaattcacattaacaaacactgtatgtacgttcatgtgcatgtttattacagtttcataaacaccggaaaaaatctcgtaagcagttcaatcaaagatgtttcaagtagcaaacaccatatagtgccatgtgagtagagcataatttgttgcatgattatcaccagaatgaagtataaataattcaccatttaagtagattatatgatcattactgattgaatattaataaacaaatgctctggcatagagatggtaaggactgaggaccagtttttggaaaccccgcaggttactggccagtaaaccaaaaccggacttgtgccagttttgatttaagactccataactctgcatttgattctgatttcaactgaagcttattgctgctcatatgatatgtctcacacttcaaaccttgaaaaaaggaggcataaactcaaaatggctccataaaatatggctagctattccctggatgtgttgccatataccaggcaagtaggcaacaatgagcaaccacaaccagcttgagtgcggttctcatggcaatttttgtttctaatggttaagggcaggtattaccaataagctggtgtaacccggcaggaaatcggtcaagattggtctagcaatttctattaatggtgactacatcactgattgaagggccaacacaaaccactgccacactataataatagtatatcatgtgctactaacttaaaagcctataagaacgaacccacttattggtccagacaactgcaaaacatatttggtcagctacatgaagcaggaagcaaacaagaccacacaagataatctaaagtagtatattaaattttgaatctgtagaagtgttccaaaactaagggtgaaggttcaaaacatcgtgttatcactgaaaatgtacctcttcaaatcgctcagcttcatttgcagatgctgcttcagcgaccatggcaggcggtggggggcctatgagaaaaccatcatcagcttcaacttcagcatccctggagaaagaaaatgcaatcagttaatattaggagaataaacaatgaataactatattaacaattttctcgcatatcaactgagttacttttggcatcacatagctgccaatgtccatgcactgtcagttcttgacaaaatggcaaaataaggaagagataaacacaaaactgtaccgggatctaagagcctctgtcatttcagcagctgcagctagtaactcgcgtgatggcat

SEQ ID NO: 32183 - DNA, 23094 bp, Oryza sativa
aagtagaaaaatgtctgaatccttggtactaaccatgtggcatcagtaatgactattgataacagtgatattgccaatgccttaaacattaccacctaaaatatgggcatgatatgtcattctggtgttaagtgttaacacaaggagcaaataaataaatgcacaatggacagttcaatacctattgggtatagaaagactaacacacaaccttctctcattacctatgaattaaatcatatataaatcaggtaaaaattatctgcgtgaaatatatcacaattgtatattctttttaaaagagggcaatgatggtggcagtgaatctgctaccacctcaccaagtatagtattttttttttatttaccacctactccataatgttctctaccaactagcccatgtactttaatgttataaaataacccctctacatatatgattctatcatatttcaccttacaatatagcatctacaggtacaaaattgtcccaaaaaaatcactattaatttgttttaatccgtagcaaagcatgggcatttggctagtatttgtaaaaatatcaatattctatacacatctactgtcattgtgaaaagaataaggagactaataaattatctgccaggaaaaagggcagcagctagatatttaaatgtctatgcatcaaaagatgctagagctactgctatttctcaaggaaactaatgctcttgaacactaccatcaagtggaatgcatgctgcgacaagaccacttagtaaattactaacttagtaaataccaatacttggttcttaacaagcggcctactataattagctttaaactatcaagtatcaataacattataaagatgagacattatagcagagcaatggtggaacaaaaaataattctatctgaaataataacattttctagcagaacaatggagcaaaatatagcaaatatttccaaacacataatattttcaattgtgacgaaaagaaaagctacagcaaagagccatttgttttctcgcatagattctagaacgcaggtaatttacctccgtttagggggttgttcatcagcatcatttttcgctggctcttcaggagtgctatcatttttattttgcacatcaaaattggatgatggttgttcctgtctagttggtgacgctggatttttattttcattatcagccagttcaccgctagctactaatgctgatccaacaacatcaagggtgggtacactctttggtggcaacaagtaagccccatttgagctttctctcagtttaagtgatctgaaaagtttctttaggcgcttcaccaatggcttgtcagaaattccagaaatatcaatgccttcaccattatctatcatttgaagaagctgcaaattaatagaaattcttattaatgtactattccatggggcaattagaaacggtccataggataggaaataacagtatagctggaactctgggagtgccacaaatatcattcataaactgataagacaaatgacttagcatgttcaaaatcaacaagaggtgtggatatactagttttggcatgatactaagaagcattaagggagttaagtagatctgctaatcagtaatcacaacgtattagaacaagtaactgaggacaaaccaagccaatatgacaacagacgatgagaatcaaacatgtaattagtaggttggagggtaggacaatggcattccccctattcatgtatttgatggctatagatacttaaacaaggcaatatatcaaaaaagaaaattgcattggacttaacaaggcataactgaatggagaatatggccatagttggtcctagtagttattagacatgtagttcagccagttcatcttcactgttatgactgcttaagatggacaaatagcactgaaacttcacacagttcagctaggaactcttcatggaaaaagaggtatgcctcgagcaaagcaatgaattttcatgcgatgcaattgtacgggtctgtcgacaacttaacccatactccaaaggaaattctcgtcggaaatttaaaaatgcgatagggaacgaaccctacctgacggagctccccggcgacggcggggaaatcaccgaggatgtcgcggacgatctcccgcgcctcctccgccctatccggctcctccgagcccgatcccgacgactccgacgcatcgccgccgcgcctcccgcgctcctcgtcccgccgcctccgccggcgccgccgttcatcgtcgtcgtcgcgcgagcggcgggaccggccgctgctcttgtggtggtggtggcgatgccggcgtgacgaggaggaggccttcctccgcttgctgccgctgctgcggctgcggctgcggcggtcggggctgcggctgggggaggaggcggaggatggggaaggggaggaggcggagtcggggtcggggtcggaggaggcgtcgcgggatctcctgctgctgcggccgcggccgcggcggcgcttgccttccttctccgcctcgtcgcccctccccatcttctccgacggtcggacggacctctaccttggggaagaaaggcttcttgtgaatttgtctgttacggggactggaagcctggaagggcataacctgaatggagaatattactgcctaaaccaacccttccgaaatttgataataccaaatttttttttggcaagttgatagtataaccaaagtttggttgaatagagggggttgaataggcgatttaaaactaaatgacacctaattaaaattaacctaagttgctaggcttggtgagggtcaactttaactaagcaactaagttatgttttgcaaacctagggtgatagtggctcaattatatctctacgaaagtaaatcacaatcctatgtcaatgtttagcaatcctagggtgatatgatctcaagtatgtctctagaaatgtaaattgcataaatgtaaatgcaacaatcaaataagacaaggagacaggagatttttcaccgaggttcggaaactcgccggtttcctactccccgttgaggcgagcccaactccaccgctcaaccacgaagccaccgcacgctcccttcgtcaaggggtgggcaaggcaggagccggcccacggagaggactacccaaacctcgatcactagggtagttcttccttcactccgaaggtggtgaactccaaaccactcacaaaccggcgtcgggcctcctccacaatcttctcggagaggtcacagggcaactcctccacaagccgtctaggaggcggcaacctccaagagtaacaagcgatgacccggcgtggagatgatcaatcaagtgccacactaactctacaaatggaagcaatgcacttgactcttggctaatcaaccctctaacacactagatggatgaacacaaagctcaagtgggtgtgagagaggtgcaaggggtgtatgcaattgaattgggtgccaagagagcccccttgctgctggagggggagtatttatactcccaccaaccaaaactagccgttgggggcgaaatcccccaactttgtgctctgctggtctgaccggaggtatgtggccggtcaaaccgtgctactctgcaacggctagaaaactagccgttgtagtgctgtcagagggccccatcggcctggccggtcagaccggcattgagtgggcggtcagaccggcctcagctcggtctgaccgaatacggctccgtcggctctgtatcggccaccccgagcaacaccatcccggcctccagggggccggtctaaccgcgcatgtgccgccggtcagactggccttatgcgccggttagaccgccgtctttcggccggtcagaccggccagggcacgccggtcagaccgccactatgtggccggtctgactgtccctggtcatgccgaaaccagtgaaatcccaagtgattgtgtgtgtgtgatgaaaagcgagcacaagtctaaatgcataatgacctaatgtggcaattaaaatcatctctttgctagatcattacccctcttaatagtacggcgaaactaaaaaataaactagcaaatttgatcgccctacacctcgatcaattttaaaactaaaaaactagttttaccgttttcttttcttcgcttcgcaccatcaaattttgatccatcgatagtcatctatgcgcacacatgacgtggacctaacttaaaatattatctcaataacaacggttagtccacaattagcgcttgtcattaattaccaaaattaacaacgggggcctagatgcttcaaccccgcgccatctacctcagccatgagttccactcatgacctagggcgatctaccaatcgtcgagtattgccacaaggtgaaaacggatgctgatgctctccacgacgtcggccatgccaagcagatgttttcctttacgactattccccaggctgcctcgtcttttgatttgcttctacaaggactctccaccatggtagctctgtcctccttgggtgtcgagtatctgtgacctccttcggttgcttcatctgctgaggtcgagccaccgatattggatgacaccaccgacaccaatttcttccagcccatgaccaggctttggacttcatcggcttcggcacctcatcttgctggctcatcacctagcgtcactgctagcgacaatttgtccatgggtaggcaagacaatctgtatatgagcggatctccattcggctactgctgtgcctatctctgtggatccatagggtttagaaagagtgccaccagcaggccataatgggcgaaggccggatactggtggtgcagcccaatgcctcccgactcaggtggggtgctaggctggaccctagcgtagaaatctcaggttgggctccggtataggcactgaagtaaatgtccaagtctatttcttgccgtaggctttctaccgattctagaaaatcttttaaacgatgaccatttactttaaaactgttaccttcgttgtccatagcgtaaccgctctatgcgatgaagtgtcgatgacggtgtatggttgcagccacttgcttcgtagtttcccatgccccaaaaattcttgtaaaaagttaatattacagagcaaatcaggaggtttaagatcctgcaggagtttatcctcgatttttttaatgtatagttaataatatttccctcttttttctataaagctatataattctaaatatttctagttgaatgattgatctatatcacaaactgttttcgcttgaagctatagcatcttattatttatcttctcccaagaagccatgaaagccatattttctcaatattctctcctcttgaaaaaatagattaagttataagaaagagtacgttacaaaaatgctaattcctccgtttcacattgtaagtcattctagcatttctcacattcatattgatgttaatgaatctagacattatgaatgtgagaaatggtagaataacttacattgtgaaacggaaagagtatgaagttgttcaatttaacgatattaagttcagcagttcaaaactccaaatcaatctcatcaatcctaaacagagcctttctgtagctcagtttatgaaattccccggtgactaatactaagtaattacccagcaagcttacaaatgactgctaagaaacttgcatttcgatcacttcttcacaggaagagcaaaaacaaaacgcgaacacacgaaagcacgcgttaagtgcaaaaatctacatccttaacaccggtagcttctccctgtcagttcttgatatatatgaacaacactatagccactattcatgtattacatatacttgtcttgttctcctacagggatacataaaaaacaatccccatcaacacaactactgctagaaagaactgggctctatccatcctcacatcttctacatgttgcagaaggtatatgccagaggcagcacgtgttctattcacaaactaacaacaaatgttcagcatattccacatgatcacatcacgcagcatgcacatgcccattttgctcatctgtaaccacattatctatgccattgtgctccttgctgtcagagtcattctcaatttctgactgagctttcttcagctttctaaggcggacactagtctgcttgatgcggcctttacctgggtcagacactaagagcaggcgggacataacataggacaaaagctcctccctatgggagaatgtgaaatccaagtgggcgtactcgaattcattgtaggaaacctctacaccagccttgcgcatcagcttatagtgcttctttaccatggatggtgagataactctgtctctttgcccagcgactaaatctactgggatgtcaatcagaccataatgagctcccaggtccaagggttctggtgttccatatgcttccatatttgctactggacttccatagtcatacatttggaacctttttgccctctttatttgtgcaaggtgaagtgcaacatggaatgatacaccaggcatgtcatccatgttgtagtgtggcaacccgagcactcccacccaatttgaactgtcaccgccaactacatagcccataagagtttggacaaggccgcccaaagctggatagttgttgaaatccctggccaatttgttcagtagcatccggaagaaacgtgttggtatgtaaaggccaggtataaatggagctagtactggtccaacaaacaaaatgagcttttctaccatgctgaacaccacattagaatcctcatgaaagccagcaggagatagcaagaccaatcttgataacctgtggggcttctgcgcaatccttgatgtcaccacatacattaacatcaccgcaccacccaagctgtggcagacagcacaaagcttgtatggttgattgtctctttcatcgtcctgtgaagcctgcacttccaaattttttatcttatcgttttgatcttctgtttcctcacttatgtgaggtctacttttgccaagttctgaagttttaatcttgtgaatttcttcaacaattgctggcatatctttggttccatgttcattaacagaatatttccagtacctagcatggatagacaaaaacaaataagacatgaaaaaaatacagagaccaaaatgacataacctacaatagatttcctgcatgcagtaagaaacctgatatgctttgctagtattactgcattacttacttgtaggaagaaatatttttatcaacatgctccctggagactaaaccacgcagatttccaagaaaaacatcataacctgcattcacccataaaggatttttagcattcactccatacatctgcagtatattatatccagttttaaatactgaccttgatcatatgctgcaaatgcaggtgagccaacaacaccattcgatacccaactgcaagagaaacgacatggaatcaggggaaaccaaactgtatgcttcagataaactacatagaaactggatagatacaaaactatttgaagtttatttgactaaccactactgcatattttcattttactgaaaaacattaacagtacgatcttcaacaacacagtaacatagtgtgctcatacttttgtatgtgtgaattgatcattcgattataaacaaacattagcgctttgatgtcaaagttctttaaggaactaatataactgcagaaacagattctcagagtggatattgtgacattcagcttacgacattatcagtcaggagcaactacattataaatcccaagtctgatatgatgatcaatagcaagattgtggatcatcgaattttattagggatggcagcgggctgggtcgggcacgggcagagtgattccatgcctgacccaagacccatgtgcccacgcccgacccacgcccgcaaagtctatcgggtaaaatctcatgcacgtgcccatgcccgtcgggcacaggcatgcccgacgggtgcccaactggtgcatcaagggtgaggaagaggtagttgtggaggtggtcgcagccggtgaggaagacctggaggtggagccatggaggcacggtggcgaccggtgaggaagaggtggaggtggagacggtagcggctggtcagatctggcaacggagaggagagcccatggcgaccggatccatagaccaggtgacggagagacgacgacaatggcaggcgagcagcgatagagagatgagggcggtaggagtcacgtagtcacgctaggactcagcaaccaaaagccagcaacaagcaaaccattgactacacagcgtgagcacaccaagcgagggaaggaggggggaaacgggaggcactgcgctggtctcacggtctcacctggtaggggctcaccgccggcgtggtcgtcgacttgataatgatgccgctgccgctaccagcatgcataatctcgcagccgccaccgccgacgacaccttgcctcgccatcgcccgcctccggcctcctccacctcctcgccgcgcttcccttctctctctccccctaatccatgacttgctttggcttcatctactttgcctctcgcttttgctgccacagcagctggccgcgtttccgctcacctcgcttcgcttctccctctctgcttgacgcgttgacgcgttggcggtgatgagagagacacacacacacacacagagagagagagagagagagagagaggagttgggtttcgggggccggtgggtgatccactagccgcctggtgaaagctggctagtggcgtgcaacatgtggttggtttccctgaaacttggctatacatatgtccattgctaatgggccaaatgggccaaaaggaaggggaatgagaatgaaggtatgtgccaaaatcaataatacatataccgggttggacatgggttacccgcgggtaaaaaatgagaccctgctgctacccaccacattgtcgggtctcgggtgggcatgcccacaagcaaaatattacacccatgcccatgcccattgggccaggtatccgcggatacccggacccatggggaaaattgccatccctaaattttatggtctgctgagtcattagtaatttagtataaaagcgaacagcaaaggcagcacctgaaatttttctagaatagcatcaacttcaatatcaaaacctactataccagctcatatttctcaatatcaactattcattactggagtaaaaagccatcaccttatcgcatcaactacagtcagggtccaattcgcatacaaatcatattatccaactagtcaaggacaagctaactcagggcaacctctttcctatcaattggcttgtttttacagtctattaagtgggaaggtaatgccaatataaatacataaatagagaaaaaaggaacaacagcaacagatcaaacggcatacaactaacaaattaaaatacatttataaagaaccaacaccaaacatgtaagaaattagaaacgccatcatgactaagcatttgattgtgactcaccccattgatgagtccagtattccatgttgcagcaataccaccttctgtgaatcacgcctaaaaattggatgcttcatatctcaatctccgtaacacaactgttgagaaatatattaacatgcaataattataattcataccttggaattctctccagcagtaggacatatccatctgaagtaacaacttttatagcctcaaaagggtacctgaaaaagatgtgatgagattaacaatttgacaatgaacactgatgcaaaaggatttaatgcaaaataaaccgaactgactgaacagaaaatagagatcgtacaagactctagattcataaacaattataggaattcgcacattaaccaaaacatggtccagattcatttgacacgagaaaaattacgcacttgactgataaaacctaaaaaataatgggtaacacatcttgaaattcaagcatagctcaagcgtcaaggataactagatctattagaataacaccaacgcaagcccttagcaacaatttgacacaaagcaaatataacgaaaagcagaaaatcactggaaaggacatacccacaaatttgtggcaaatgcaactgagtaaacagtactaaaacaccttaaaatgctaaaaatgctcattcaggattatgcatccattaagtttgaacaatatacatacatgtttacgattctattactaaaccatactaacatataggtcgatcacctacccaagctcagtgataacatcttcacatgtccgagaatccgtgttcaaaggatggcgatatatagtcttcctttcagttggggctggattgtcactgccaacattagctgttggtacatcaacaacagggctactgctgccatgaatccagcaaaataatttcttccacacctcagaaggagaaagaacataatgcgcgcctttatgaacaatgtcaaacactgattcgatgaaaatctcaattgcaagatggaggtcctaaatttgaaagaaaaaaaaagagatcagggtgtgactaagtggacatagaaaccactaaatgaatttcttcagggaaataggttaaacaataatcacaactttgtcatgccataagatagacaaactaagggtccacttttataaaagtagtacctcaacaactccacgcctcctgtcagttgttcgttggagaacttgatccttaatgtgaagccctctcctagaacggaagttcctagaaatatggggactttctgggggtttattagatgtctgcatgatccgaaatttgatagcgttgaacagaatcaccagcaaagagacaagaaatctggcaggccaaagaatccatgaaattgcatatctaataggtcttctcaagcggcgatcacgcctactgaaactgcttgtatgtgataatcgtgaactttgggacaatggagatgaaggacatataaaatcttcgttttcatcatccccagggatcgagtcagtaactgattcaccatcagaatcgacagagagttcatgaataaactcattgaacgatgaaaccccactgatatcagaacaaataagtgtagtcatcagaaagagagagaaaaattttcatcacagaaatagatgtggaatctgttacattaaccatacataagtcataatattaataatacaaaacaaaacttcataaagctaaaatggtaggcgtaagatctcatgcaggtgaaaataatccggtccatattgttcagtcattacatattatggtacaaattttattcaaaattctaaagacccattggtacttatcacatttttccagcaaacaaagagaagctttcattgggcagagcccctcctaagcatacattggcacaaaccaaatgcaaaatggcaagcagcacatacagaaattcaagattattgaattcacttcatgttaatgatcactcactatcttgtcctcctcggttacaatagaacattccttaaccatgccaaaaagctactccctccattccataatataaggcacaaccactttttgaagatgctccataatataaggcatgcatgcatgtaggcaattaactatgaccccttctacattaaattattacttttttaaatcctccactctcatattctctaattctattggatacatgcattgtatttattaggatgatccaaactacaagatgataataattattttcttggtctttgggttaggggtggttatgccttatattttggaattgagggagtattatataggcctacaaatgcacgactgagaaattgctttgtagaaaaagctatgaaggttttgcagggacaaaaataaactgcgtggatttgttgcttgtagatggggaaaaaaatagtgagttaccaacttgtgtccaaaaccacagagaaaaaaatggcaggagacaggagtgcaattaatatcacaagttgtaaatatctagcataattaagtcaatgaaaataagataacctttccatccaacgaggaagacgtgggccacggaatgatggtctaagttcccagccactgatgccttctaacatgttggccttccctggtaatagagtcaacaggagtgctgatattccatttatcaaccttgcaatattgttcagtgattcatatgtgaatgtcttcacagatctggccaaacaaatgcaagaattcaatagtgcatctcattcatacagaaaggctaaaataagagcaacttaactggcatcttataaacttcacagtagagatagcatgcatggtttttgtttttttattgaagcatgaaaactatccataaacaagtacaagcaagtaaaccccagaccacaaatgcacttagcaaagacataaatactacattgaaaaaagaacaacttagaaagcctgggacactcatagacaaaatgtcagaaatttgcattctaaggtacaagtcagcaatcagcccatatttgtccaaggctttcagctcttggaatcatctacaaagaaagattaaaaaaaaacaaggccagaactggtctttatggttcaaattccacatccatacttatgtgtgagaccaagaagaggttaacaaacagcatagcagccaacgatggggcaaagcggtgttgagtaggaagttcacacttaacaacggtgtcaagcgaaatggccccatgtcattgagatccttattaactgaaatctcagtgatcttaggccctgttctttttcagctacttcatcaagttatatggtggattatttgctccatgtctctaaaaatacctttaattttcaaaagaaactttcttctaatgcattcttacaccacttgttgtacggtacttattaagtttatttctaaaaatatttaatttatccctacaatcaagtacataatccgtttaataatctgtttcaaactgggacctttgtgcagccggcataattcagtaattcacaattctacacacaaggtatcatggtactactactaaaaaattagtgcttagccaatagcgacgccatatttttctgcccaccccttaccctcccctccctcctctcagcatctcctcgtttaacattttgacattgaacctaatccaacaaattctcgtttcatggctattctggagagatgaatgagctataaaaatccccgacatctaacctcagcgctcaatccaaaatccctagcatgaaatcctaccctaccgaggcaccgaccactccccctaacgcgccacccccacccatgacccatgacccacctcggctcgccgatcctccgcaccctagccaaccattcatcaaaacacccgcaaacaaaacgaagtaagcaagccccccaccgcggggaggtagggatcgaggggagagagaggggcggatgggtgggtgtgctcactccttgatgacggcgatgacgttgtcgacgaactcctgcagcattatcgcccgccgattcgcgaacgggagccgcggattcggggcgccacggcgtcttctggaagcttcggcgaagcgcgagggcgagggcgaggcgcggaaggctgaagaaatccggagggaaggcgacgatggcgcacagcgaacggggacggagacggcgaagccaaaggaaggaggggggcttgggcggtttgggcccacctatttccgtagccgcatcgtgtggaaagaaaaaattaaagtggggaataacctggtccgcggaatacaccggccgcgtggatgtgagcatgacatgtgggccatgctgggagatcatggcccacgtgccgggtgtctcatcgggtcttgttgcgtgacgtggaaggttagtttatcccgcggagcactgttcgaccccctgtatgctacgacaaagggggctttgattgggatagctttgtgaccgacaggtgggtccaggaactctgtgggctcaaatgtcaggcaggcgatctcatctgggttagccgcagcggggtgtgttttctttttatacttttctttctttttttaggagcatataaaaggtttcgtgcggagcgaagcgtgggataatgccgtggtggtgacgtgtcgccgtctgttgtttctctaccatgcgtgcgaacacgtgccgatgtcttggagcggtctctgtttgaggttaggcccggctcttgctatgacatcattcatcatcatcaatcatttttctcaatttctaattttttttaaactcctaaacctttgtgttacataatggattttcattaatacggcctctatattcacgaaggatatacacaactaaaaagatacaagagcccttagattcaaacctcatcaaagagaacattcaaccaaaaagaaaaacctatgacctcggcacattcttgcttcccgacatcttctcctgaaacagtcaaaatcgacgagtggaagttgtttggtcatcactgattggtaataaaaacttccaagaatgtgccactcgttcttaaataaaacattgattatgagaattagggagatgccaactgattggtgcaaactttgtgtgtggagatggtgcctgtaaaaagatggggctcacaagctaaattgagaacctttcacaagctaatttgagaaccttttcctttaggatatcgtctaaattgagaaccttttcctttaggatatctttaggatatcgtctaaattgagaaccttttcctttaggatatcgtgctacagaatatatgtatcacttctttgttttgctacagaaggtggagcagtttttatcttcttagtttttgtttatatgtatttataacaattattctattctagatcaattatttgtgtagatcaattatttacacctcttgcatagaaaccaccaaatacagcatatgggattctttattgcctcatgatttttgtttatctatgccaacatttacagacgcccaagccctcaatgctgggctccgtgcagacgtgagccggcacaattgtctgcttctccatgtgctccccagatagattgggtatccacatcaagaataggtaattcagaaaacataagacacaattatacttcaatttaattatactatgttatttaattatgctatattatgtttattcttcatctttcaatcagtttctaaccagtgaagtccttatttacgggaaattgtcaagtaatctctattgtacgtgttcttgatcgaaggatatagtggtgcatgtgtattcagtggtagtactctcaaacaaaaatattgagcatttgatgtacatcagaattgtactaagaagaacaaaattgtgtgccataatgaatccaagaatttaaatttgatttatttggaaaaaaattgcttacaacagtctacgtataaaatctaattgtactaccatcattatggttttttaaataataaaaatgttctcccttgcagtttggcaagtttaatttaagcaatttgtccaatttaattcatatactgatttttacgtgcattgcacgtggacgattactggcaggaagaaaagccagaccgggcaccgaaccagccaagcgcttggttcatcggtccagttggacttctcaaggtcaatgagatataaattttactaaacttgctaattgtcatactaaagatttatcttctctggcatgcaggtatttacattactagctatatttgtttgttttactttgtttgttgttctgggggctcattgtcatctcaagttcatgcagttttgtaacattgctttctggtccctgcgacaacgtgcgaggacaaacttgatttttatgtttactagtgagcgtgcacgtgcaaagcacatcttgcacgtcgatatatatatactctctcaggaattcatcttggctctagctgctgggcgcgtggctccagcgacaagttggaggcgatagcaacggtgattcacgacccatggcgcagctcaccctctgcctttgatcatgatccatcctgttcacaaataatcgcacaagttatatagctactaatgcaatgaacaaagatatctaaaggaacaatagattcttgcagtgtgtgctatagtccttccataatttgtccaactcatatggcccaaagcaaagtatttgttcaaaatatatgtagttctgtgaaatttactctgaataaaattatgtcgactaccttcaaatgttttgcatgcctcttgttcaagcaaaattgggtgatgtaataagaaagtaggtctcaagcaccatagatgcttcatgcttgcctgcaaaatagcaattgacataagattggagtatttcctgtgcgaaatctgttgtctaccaaagaattggcagtagcccttatgtgaagaaataaacacactgatcttaaatataagaaaacaaaaatattgattttcagttgcttatccagtgtgtagcagcatggacagttactgaggatgacaaaaagcattggttggcaggaaactacaaatgcattgcaagcaaccaacagaagtgctcaattcatagcaaatacagcccatacattgaaatgttaaaaaaaacagcgtggtctgttaaaccggcctgcatttgtaataaaatcaagtttggactatcaaagtacatgttgaacagtaagagattcatatttcacaccacacatttatataggctcctagaacaaattcatatatcgaataaatcaatcaaaatagattatgcatgcaaaattaattccaattgtcactgaatttagctgggtggcataatttttacagtactatattcactaattccaagcattcaaatttgtacaggaccatctataattttgttttgaacatgtaacagcttcgtggattgcaaaaaacagaaaatgtgcagcacaaaaccaagttagtttcataaaaaaaaagttcaatgattaggagtagatgagaaaaccaatcttaaaacgtgaatataattgcagggaatgaaattgtgtatattgaaaatgcaaggaaaacaccgattaacttgatcattacctttatgtcttgttctaactccatcactaacagcatccccttcactgatcaaaacagttgatgagcacatccaagacccatagaaggcctgctccaacagagaagaatataagcacaatagagctatgtgttcatcagtaaaaaaaaaaaagtaatgcaatgcatcacgtgaattgctacctacaatagtgtctcaaatcaaagctttgtcactgcacagtagaaattaacgtaggcggcatgcatttttatcaggaaggctgaaatgaagggaaatagacagctccaagcctccaaccaatctgaaaatgcatcatttaccataagtagtgatctatggccatgtggtttgtcaacatgatttcttttgggcagcatcataggaggcataactctctttgttctaaataaacatgatgcctataaatgtatatctccagaaattttaggaacaaacatgttaccattcagtatcacggttcctgaacaggcttgggtagcaccaaagccagcataatttgtgatatctcttatgggcacccttcataatttgtgaacctacacagacatgtactcttattttgggagtacataattcacatgtcatggtgaattttttttttctcatggttaagtttggacccaatgggatctatgcaacctgatagagatgtagtcgcctccttcttacgttgtttatacttacagttcttttgaagcctagcttgtttctgttctgtagagagtgaagcatacctctccctttcatgctttctcctaacctcggcagcagttaagtttgattatgcagtgcgcctcttcctaaaacatgtggcatggaaaagtaaaatcaaaccattatgtgataaaaatgtgttgtggccagaaaaatattaattatagcaagatagtgaagataaaacttcagaaagaacatacttgactgtgttgaaaattctgctgtggcgttcgcattgtttttcactgtattaagatgccgcctcatggttgcttacggttgtagcactgtgaaagtcagacactgaaatagcatagagcatataccatgtaaatcaccgtctgaaataacataaagcatgtaagtcagaaactgaaataacctccagacataccaatttactgaaagtgactgtcttgattcattctatgtcgatcagttaaggaagctaattggagttcggtgtttgcgttaatcttgaatgtgaccaactgagcatggactgacatagatggatgaatttgtgcgaacaaagaagtcagcactgtgctcaccgtagggcgaggcggcgagggcgggacggacctgaaagcgcagtgccggcgcgagcagacctcgcctctccttcctctcagtcgcgtagagagcagggaagcagggtcaccgacgagcggagggctggctagctgtcaaacttgtcaaacttcatatccattcttacagggaagcagggtcaccggcgaggaggctcaggcggtaagcggagacggagggctggcagcggggtagggagtgcgcctaagccggcggcggcgcccggctgtcctgtagtcggaggcggcggagggttggcggcgggcgcgcgccctgagccggcggctgtccggcggtcggagacggcagagggctggcggcggcgggctggtgcgcgcgaggaagagaagagcggcggcgggctggcgcaggaaaggaaaaattgtttttttttgttactttgaccgatcggtaaccgctgtttagaggtggtagaacggacagatccaaaccttgatatgagctgttggatatacagactaagggttagaaaagatatttaatgaactggtatttttatattagtagattaatttaactaaatatcccaattgcacgcaaataatctaattgcgaaattaggactatgtggcaaactcgatgctggatcctggatggggggtggacacgatgtattgtaccgaactatcgatcaagacactacaatcacataatatttgtcctctgaaatatttaacaataatgctagacaattttgatcggattaaccaagtaaagttggcctctataacggttgggcgatagcaaaagatcatagcaaagccagtagcaatttgtactagcaataaattaggttgacataaggaggaacatattactagttatatcatttgcaattgtctgaatctcagtatgttggttggaccaatcatatattttattgagataggtaactgacccgaaaccccctcggagaaccgtatattagaatttcatctcgtccaactcaagcggaaacacaaatttttaatggataaaaaaagtttcaaaacttaacttcattggattgggtcgatttgccttgaagatatggtttgcctgtgttgatgtacccaattttaaattttagaatcactttagaggggattttccgtcttttttgtcatttaaccttatagaacactaagaatttttttaagaagggatagaacactaagaattactcgtatgtttttttttactttaatcatgtgttttcaacgtataaaccgcaacccaaacaaatctgaaacaatcacgcacttagttaaccctctttacaggaagagagtttattcaacatgctcatatcacaggatttctattagcatcaagcaccggtacacaaactcattactagtatatttatctgatctcctttcatcagtatcactacggcaagtcaatttggtggtaggcgtggtgggcgcgggaatgcccgtatcgcagcatagatcagctcctctcggccaactggagcaggagtgggcagtgcagacgctggataagggaaaatgcagttctttgcatgagattcggaaatagtaatataaactgaattttgctgagaaccagaagctgagaaacaggttagtatagagcaaaccttgaacgtcagcagattggagtacagcggtacccatcagtggcgggcccaggatttagaggttgggtattcgaaataggtaggggtaaaacaaaattctttttacttctagaagtccaataattaattggtataatattacacattactaattgtataatattatagcatatggccataactttataaattgatagaattgatcataagtccaaattctttaacatatataagtactaattgttcgacatatgaaagtggcaacatatataacatgtaaaggatagaaaatggtaaaatgataaaaaaaaacttacaatttagaggagaacttttcaatgcttgatattttaaaaatgagtgatgatgtcctcatcctttaacttgtacaaaaaattctcttccaataaatgtagattgttgctcatcttgcttcttgtttttatatagttcatcgaagaaaacaccctctctaaattctctaaattcctaacaacagctcatatatagcctcatactatcatcatatatataaatttaacacactgaaaattaaatattatggttctaagttatctaaattcctaatatttacagctttatactatcaatctgtcaataaatatacacttaacagttaacactctgaaaaataaagaagacaggaactgaggaagttgaatccttcggtgctagtgaactattgaactactatagaacaaatcaatgaaacaagccgtcgccaccggaaaacataactactattgaactacctagaacaaatcaatgcaatgaatcaatgaatcaagcccctcacgcaatccatgccaggccggcaagccgtggtcgttcggctgccgcatcgcgtacctgtgtggtggcctggtggactggcggcctgcacgcctggccgagccccaacgccgcacggccgcagccgtcgacgcgccgcctgcacgcctcggcgcctcctgccgccgacgcagccgcgcacgccgcagccggaagcctctgccgcagccgccgacgagcacgctgcagactagactgcagtcgccgccgcccgacgcgctgcctaggctcctacccgccttggcgccgccttccgccgacgcagcaggaagtcgccgccgccgcactgccgcacgtcctcgccgccacaccgcgcacgtcctcggtcctctggttagggtttggccgatttgggaattagggctttggtttgctgtgcctaggcgaggaggggaaatgaactagttgtggcccaaactgattgtgggctgagatgaaaggggagggaagtgggaaatttaggcccaatagagaagaaacgatgaaacagggcccaaaatgagtagttttagcctttttctttaatttcttgaatacatatacgaggtatagagtacatatacttattttttttgtctaaaaatcttgggtatacgtctgaatacccttgaatcaatagtgggcccgcccctggtacccatcgttgggttgatcgtaggtccatctcttgctactgcaggagatgcaaggctgctaacaaaaaccactaaaataatgaagaatgctttgaacgccatcgtcactcgtctattgtttttctcagcttatgacagaaagcttcctatggtcctccaatttatagttggcaaggaatgtttcagcagcctaattctggtaataaacaaaccagcaaaaatcctattcgataaggttttgcagttttgctttaacccaaacagaaactatgattgtggctcgatggtatcaacatctcctaggctgcctaactcaatagtcccttgaaacacatgtttttcttttattagaatataattatatgatattttattgtaaagatttaattacaacgaatataatggtacaatcatattacaaattggataaatagtgtaaaagaaaaaaaatatttaaagcaagaaagaggaaaatataataacaagcaacctagagtattatatgactgtgtgttgcaactggtgaatgctaattcaatcttattgttgttactagcaaaaatgctcgtgtgttgcaacgggtgaaaaaaattctaacgataatatactttttcatgcataatcatgtcaatgacaatatttatattttaatgagcgacatgtttttttataaacgatgtattttttttcttgcgcgattttctcaaaccatttttcaaaaatggcgtatttttttctaacaatttttttcctagcatgttctttttgcttttttttactggcgacgaaaaccatatttttctctttttttgcttttcttttttcgtgtgtttttttatgttttttctgacaattattttctcacgcgcgttttttgcttgtttttttcgaatgttcttttttgccttttccaatacaggaaaatatatgacgaaataaaagacgtgtagtagatgacaaaaaatcgatggatcctacccggctcaagcgtccatcaatttagcgttttttctgacagatttttcggactgatttgtttttttaatagacgatgtttttttttggcacggttttttcaaaccattttttagaaatggcgtgttttttctgatagttttttcatcgcatgtttttttaaatttttttaccgacgatggaaataatttttctcgcgcgtttatttattttttatggaagatagaaaacctgtttagcgtgttttttttgcgtttttttctgacttttctcacacgtttctttgaaccgtttttattttgttgtgcattttctctttttaaatagttagattagattagacatagcgaagagatatatactgattagaaatcggaatttgtttctccctttccatttttttttctcgcgcatattttttattttacatgaaccatttttttcttcttagagaatgggacgaacttttttagatgttttttcaaaaatttttcgcctttataggaatcgaacttttttttaaaggtatcagatctcgcttttttttcaccatttttttgccttttataggaattggatctacggttttttttgccacttaggagaaagggctgcag

SEQ ID NO: 32184 - DNA, 3148 bp, Oryza sativa
atttttttagaaataaaaagaaaaaaagatctcgggagatggggaggagattttttttccgcctccgattcgcttttgtttttttgttgccacgtttttctttttaggatctctcttttttttaagttagacggacgacggaaacatcataattttttttttgcgggggaagacaggggttttattaaacttcagaataaggattacaatcctgagccagttgctcagcaacacacaccggcgcctgcaggcgcaagaccactgcctccctattccgaatggctagctgagcaagctcatgagccaccttattagcacccctgcgaatcagagccgtacgagcttcaggagcagcacgcatacccgctctcacttccctgattagtggccaaatctgggacctattagccgctgccaacctcagatagctatcaacaccggcacaatccgtttctagaatgcatggctccttgacccactcatttgcaagccatattccttccctgcacgcagctgcttcggcaaattcggccgatgcgcagttcctgatcagcttctaggaagtgagtaaaacattcccctcactgttccgaataacaatgccgacgctaccagtgctagtctgcggaacatagtccacgtttattttcacccatcccatagctggtgcctgccacacacctgccacttgggttctttcccggcacccattcacatcactttgtcttccctccgacactgtttttcctttctcattttcctgcattgcactgctagacgggcacaaggaatcccaaagattcagaaggaaagctgtagatcccttcaccgtcgcttgcccagaaccgaaaacacagtcattgcgcaggtaccatgctcgccataggacaaggagaaactgcgcccgctccttttcgctcagcttatcgagtcccccaagaagccaccccggacctagcttcgacagggaacgctcatccggtaacctccagctcgcccgaagagtttctcggagggcccttggctaggtacatgaaatcaccgcatgaaactcatcttcctccccatggccgcagatagtacaggtcgcatctgcttgcagctttcgtttacacctgttctgctgggtagccagataatttcgggctagacgccaggcgaaaatacggacctttggtggcacaggcgtactccaaattcttcgccaaatggagcgatcactgtccgcttctctactactgccttctccatccggatggaacttgttcaaccacgctaaacgataagcagacctcactgagaaaatcccagatttttcgtagtgccaagctaggaaatcctcatcctggtatggcgacaaattgatttcaagatctcttccacatcaagtgggtgacagacgtgcatgatcagatcaacgtcccagctcttttccccttgtttcagcagctgcgagacccagcgaagacggcagcgtccgctccttcccataagcatgagagaggaggctcggggaatccatttatcccgccaaatcctgaccttggtcccatcaccaattcgccatataagtcctgtcttcagcaattgcagcccatgttcaatccctttccatgtcggagacacttcagctgggaagaccgcatctactagctcacaattagggaaatacttagcctttaaaacccacacacataaactatcagggaattgaattagcctccatgcctggcgggcaagcaaggcctgattgaagagcttcatatcgcggaaccccagacctcccattcctttaggccgagtaatattttaccaagcacaccagtggatcttccttttattctcctcatcaccccaccagaaatctcgaatcatcatcgtataagcctcgcaggtagaagctggcagcttgaacactcccatcaaatatgtcggtatagcttgcaccaccgacttaattagaacatctttagcccctgatgacatatgtttctcagcccagctatccattctttttgccagtctctcttcagtaggtttaaatcgtcccgcatgcattctaccttccggtgttggaagtccgagatacttactttcaaacgccggtgtttccacttgcagaatctccttcaccacttccacagtcgcatcagggcaacttctcccaaccaagagagagcattttccgggacttaagagctggccagtacaggcttggaagcaggttagggcattctggactacagtagcttgttgcaggcaggcacggaagaagagcaggctatcgtctgcaaacaacaaatgtgagataccagggctccgacggcatactttaagctccgttaagcgccctgcctccacctcccggttaagcacagatgacaaaccctcagccacaaacaggaaaaggtatggggacagaggatccccttgtctcaacccgcgagtaggggagaaggcctctagaagagacccattgaaattcacagagaacttaacagtcgttacacattccattatccaatcaacccattgtctgcagaagccaaccttcaagagagctctttccaggaagtcccaatctactcgatcatatgccttgctgaggtcaagtttgtaagcacagaagctattatccgggctgttgttcctttggatagcgtggatgctttcaaaggcaattaacacattatccgtaatcattctttcaggaataaatgcactctgggtggatgaaatgatatccgatagcaaaggacgaagtctattaaccaaacacttagagattaccttgtagatcacattacacaggcttattggacggaactcctttagattttctggctgtttcacctttggaataaggacaatggatgtgttatttacctcatctggcatagcacaatctgcaaaaaactttctaactgctgccattatctcccctttaagcgtgtcccaatttctttgaaagaaacgagctgggaagccatcaggtcctggggccttgataggaccgatctgaaacaacgcatctgagatttcctcatcggaaaagggcttgcataactccaagttcatgggttcgtcaaccagctcttgagcagatccaccacttctgctggggtaacggaatgatctttcgtgtaca

SEQ ID NO: 32185 - DNA, 5870 bp, Oryza sativa
ccacttcacctagatctgctgccaacaaatcctgctgctaggcgagttttataacttcactgagagactcctccctctcccacatgatctcataacggaagacattcgtcggggtagacgatcgctttgttagacacaacaggatagggcaatgatcagacctgggagacacaaggtgcaacaattttgcttctgagaagtgattcgaccagcttggggaggcgacagcccggtccaacctcactttcacattcctatcccctctctgtccattatcatatgtccaagggcgacccaagaagcctatgtcatgcagatcacaatgagatagtacctctctaaaatccatcatctgtttttctggtctccttctcgccgagaactgctcgaaagaccaaagagtttcattgaaatcgcccatcatcaaccacagggcatttgagactggttttatgcgacggatcagctcccacataagatgcctatccgtggtcttcggctcaccgtaaacaaaggtacatctccataaaaaaccatctcccggatttctgattagcacatcaatatacatgttactcatcgacaagagatcaacggttatagtctcatcccaaaacagcgctataccaccacccgatccttcccctttcattgataggaagtgtttcaatcctagcctccatctcagttgctgcagcttcccctcatcctgacgagtttcagatagaaacactaacttggggctgtagtaacgcactagacgtataagttcatgaactgttcgagggcgccccaaccctcaacagttcgaaaccatcacattcattgctcctggtggggctcatcctgagcgcccaccaggtctggcaccaatgcttccttcagcattgcatgtgcctcactagaatcctcacttgtatccttagcatccggctgtaccatgtgattaaaaggctcaatatcactagcagacagtttgatattcatttttctcggtttcccaatgtcccttctcctgataaagaccctggcgctactcgatttttcaacctcacgagaaggcagtccctgcatcttttttattaaccagtctggggacttccttctgacctatgtctgcgctcctccagcttttgccgaatctacctcatcagctttatcatccgatagaccatagtcagaactcatagaaactctctctctactgcaaggcccacgagcaaccaaattcagactgggaccaatatcttccacctgcatctgctgcacacttttgcccaaaatctcatctgctccacacatatcatcctttactaactcagtaacagcttcgtcatccttccgaacccccaagtttgcgggcgtaccacctcgagcacgacttacctgcgaattcctagatgaactggactcagaaaggactttatccttctgaggtccaacaaaatttagccctctgactactcttggtgctgatgaagaacccatctactgcacacgattcctcaacggtgaagcacgcagctccttccgatatctcacaggattatcagacattccttcctctggacactccctttcagcatggccaatgcgcctgcatgagaagcagaagaacgatacgttttcatactttattgggcacgatataatacctcttcctttgattctcatcttaatgcaggtttttagagcattagcaagtgaaaactgcactttgactcgcaaaaagttaaacatcgccccttgcacttcaatcaccgcacccagtttctcgcccaaaaacctgtggtcatcattacctccgagagatcgaagaacctgacccagaggggaatagagtcaatgacaacctctaacggtctcacaataccatcatagggaactactatcaatgcatcccccttgtgcttccaagggcccccattaataaccctcttcaaatcagcttcacagccgaactcaatcaagaatttgttttctcctaagtctcgggttcttcttgtctcatgtaaaccccatgccgtactcatctcctcaaacaaacccttcacattgtaccgttgccctgaatagaacctcgccagtgccagccacttaacctcctattcctgttctaactctcccagatcaacataaaaaagatcctcctccgcctcatccacagaatccagattttcgccaaaaagcacaatcgccttgttaagcccggaagcctgacttgcagaaccagcccccaaacctttcaaagtttggtcaatagttgcacccagctcgccggccagcaatccgatctcatcgttctcgccaacccccgttcttccatctatcagccccctaacttgcacatctttgccagcgtccatcgctcgttcgcagatcatgcagatccacccgtcaacggcttcgggtgggtagatccctcaccgggttccccttgatcaccctcaccgtcaacaagaggaagagcacgtgaagaggagacgaatcgacaggcagaagaaaccagtaccccaaccttggctagggtttcagcagaccagcaacccgaggacaaaggcacgacctcggaaggaagagtccggactaaaaatagatcacagccaatccgcccccgattacaacgtggcggtataaatccagcgaatcacaacagaaactcctcaattaccttaatctccacgtaaaatcgcagagaccagaacggagatgatcagatgagattcaatggcgaaaccctagaattgcctaagaatcgcctcccgtaatcttcggagccataactaataaaaatcatctagggtctcattcatcataaattttttaagtagtaacagatatgatttagttagggtgaaatacaatgtggaaatttgcttcatattttttttagaaaatcatgagttataattaggagtctaactttcatctcaagttagcatgtaatttttttctaaaaagatttcttatacgactccttttgtatttctaaaagccaacgaacttaaaatctgacttaaacacggatttgtagtttcaagaatgaacgtttaaaaactgactcaaatacaaatgacgtattaaatactgtcaaaaatatctttaatttttataacagtagagaagagatacagatgaggaccgatttcttttctctaaatcgggctacggatgcagagcaatctcgactagaccctcccctgagaaaacggccttgggctgatcggaggccaccattagggcaatagggcgtcgctgaagtatctcaggccgctctccgccgccctaattctccaatcggggaggtaaagatcaactttcccccttttttttgttctggttttctcccttcaattccgtctttcagagccactcctctcaacaaatcctcacacatcgtatattttttgtttgatatacgacggacaagcgttcaatttcagtttctttctctggctctctaaattactggtcaattgatccacaagagtagggattgtagtactctttggtgaatctgtcaggctggttctcgattggttggtgagactaccatttccctctgatctatgaactcctttattttgagtaccacttgcatcatagtgcattgttagtgttcgaaaattctctctctcccccaaattttcaacaaagtcttagttagtaccaacctcttggcttctctttgccccgctaattgatcaatatgttgtattgggcttgtcctaattctctctcaggaacaaacaatgttcctagtatttttttggaaaaaactactgtcttggcgcattcgtccaaccacactacagattgaattggctggccatcctttgtgcaatattttatcttccgcaaatatctttgcttgaagcatgagcattactgtggtgaagcattagcattagcattagcctttactctccaaatcggactaaggggctggggatgcaaccctgaaactgtatccagtatgaagatttcgctacaaggctattaatgtagaatggacagttggaccttctttgtttcactcattctacaaaaaacaatgtagggtcgatatgatattaatggatctaagcgtcttaacaccattacaattttggaaaaaaaaagggaattgccatactattaaaattttctgttactgaaaagtttagaaaaagaaaatagaaataccaaataacagggtacccaacttgcattagaaactgtctcatctattaactgagcaaaaaaaaaagcgaaaacactaaaactatataacttttgaatattttgtcttaatcctccaaatacgtgtggtcaatcttgtatcttttgaagtatttgccatactaggggggatccactgagatagattgattcaaacttcttctgggaacacctattgagagggttggaagttgtacactcattgttacggtaatttacttttatacttttctgtaggaaatgctctttctgcctaacccaaaagtgaacgacactgttcaaaactaaaaattggtttgcaagcacgtagtactaactaaccatactgcgtttttcagtcgtctcctggctcatgctttaagttgtgtgcaattcaattattagaaatgcattgaggtactacttgcaacagacttattcttttgttaactattatattatttttaaacaattacagggacttgggccaagttcaatggtcactaaggccgctctatatataccatatttgaattatttgttgtgcttattgttaagaatgaatttcatagctacattgatgatatttagtgtgtaatgttcttgaacagataaataagaacgcttcaaggtggaagcagcaatgctggtacaagttatcttgacatagatgaaatggtgaagtcttaaaaattgaactattacctatctatagaatgttcacatgtgagggtgagtaaatcatgcaaaatctccagagttccagaacacattcggaagatggatcatggggcttatgagccaattatgttatcaattggtccataccaccatggattgtcgtacttgctagcctttgagaaggaaaaatggaattgccttgatctttttcttaaactgaatcgtgaaataaagttggaggactacctaaatttggtcaaagatttagaggaggaagcacgggcatgctatgaagacattgacatgcaacatgacaaatttctgcagatgctactccttgattcttgcctttttgttcaccatttcagaggtttagagggaatacttccatccactttgggtgcaaatatatgtagtgctgacagttcggacattataatggaaagaacaatacacaaaagcactacaagtcaaggtaattttggtgagcaatgcagcagggataactctatctgcacacagagagaacttgtccttgctggttcaagtcgggaagttactagtcaaggaactgactttgatcacactgaggaacttgaatcttctcaatgtaataattggcaaattggaacctggtttgacagctgtattgaacaagacctgatgctactagagaaccaaattcctttctttattgttaggaggatatatgaactttttgctggaaatgagaggcctatttcatttctcacagacaaagtagctcaatcgttggagaacttcatacaataccatccaagagcaatccaggaagcacatcggcctaaagatttccatcatatgctgcatttgttccagatgtacctcaagcctagtaaaaagctggttgagggttcacaatacctggagagaggaagatattttcattctttcgctaatatatgctataggtatttgaaaattggacgtaagcttgccgatagcaatca

SEQ ID NO: 32186 - DNA, 10505 bp, Oryza sativa
tttctgcactttcttcctgccatatcttacttttaaatcaaactaattgcggaattagttaataaaagtgtgttggacctgaatattctgtttatctatttgatgcaaataacacgttcatcaacaatgccttttaaataagggcagaaaggagatcacattggtatctagggttgatgctggcttagttatttaaaaatcaatttattttcaagcatagctgcaaacaataaactcaacatgaaccatcctccactggaatccagaattctagagcatctgggctttcgaattttgatcctgcggcacgtatgcagattcctcatcaggaatgaacaatagtggccctgacaggtgcggcacaatctcagtgagatgagagatgggtgatagtttgttggcgtggaaactgaccagcattgtgtcgcccaggaaggaaaaagattaaaacaaatattttgaattaagtgaaatccagaagagaaataacaaatgaactccaaaacctgcagattttttttgaactaagtcacgggaggagaaaacaaaggcaacattgtcgggttacatcctgttgagagtgtggagaggggaagaaaacaagtttttttcatacatagactcatctatcatttcttttcaatcgctcggcccataggccagcctcatcaatgcacctcctcatggcattgcccatggacaaggtcgaatttctaaagatgacgtcatgtcaattgttccacagaacccaaatgcagatgaggtaaaacacctgaaagtgcactcttccgcagtcttggcgttggcttcaggcagtaattgagagcacctcctgtattgacgagcgggttccaatggcttcccaggataggcgcgcaaagtggcagtgaaggcagaagtgcatgtgccatcccctagtcgaacagttgaaagtgtctgcagagcttcaagtaggttctgcattgatcgccaatggagtagctaggtagagttctttcacaattgaggtttcaccatatttgctccagatccagtttgcccatgatgaatcagattgatgcagctggaacgatctcttgatgagcagtgcctcattctgaagcttcaggtcttttatccccccgaacgacctttgtcgttcggcaggcaaactttgtcccatgtatcctctcgtgtccacaagaatgctcttcgttttttgccaattgcttcaatctaaacacacttaggccttgttcgtttaatcctcatggacaaattgggggtgggggggtggggaggggattgagggagattaacaagccctacctggtcttaagacccaactcaaaattatatttaattcctttttattaataaaattgtgatgtggttgttatattatcttttgttaccgtgcgtgctagtgttgatctgggactaacacagtatacacataaggattttgttggtataaatatgtgttgtgactaggacctatttgtaaaatgttcagagaatagaatagaggagggggtgtgtaggagaagcaacacaccttgaaaatttccccaaatcgagcaagatggtatcagagccaaatcctagcctcactccaccacccaatcccttcccttcccttcatccatagtcatagccaaggctcatcatcctggggggctagagggggttgtgcgccctcacaacgcgtggacgaaaggaggcggtggctactgctgttgatttgtgtgggggaggagaggcggctgctgctaatgatttgtgtggtggaggagaggagaaagttgctgctgctgctctgtgtggcttttgggatgtgtggtcagcagggaaggctgtcagaagtgttagtttgaggtgagtgtcttttgtttttggtgatagaggggcctgaagcctggtccggttcaatactctgttgtgaggaagaaatggatcctaccatgcaaggggaaggtgttgtgggaagtcaggaaaaagaagtagtgattgcttcatcatcccttgtcataaaggatgagatgaaagatttgttggaggatctagtaaagttgggaatgataggtactagaggtggaggatcagccgaattgaaactagaattgatgccaaatgaattgagattggaaggaagtaagaattgtttgagttggtcaaggagggcccaactaatgttgagggcaaaaggggtggatcattttttgcaggaggattataaagagcctgctgataaggaaagttcagcttggaggatgtggaatactacaaattcaaccgtggtgtcatggttgaggaattcggtggctccatctattgctcggatgctagaaaccattcaaaatgcagcagttgtatggaaaacattgagcagcatgtactcagaagagggaagtgtaatgatgatggttgaggctcaaaacaaggtagagaatttgaaacaagaagggagaacagttcaagagtatgctagcgagttgcaacagttatgggcagatttagatcattatgatcccctgcaactgaagcatgatgaagatattgtgattggaaataaatggctgcaacgatgaagagtcattcatttcttgaaggggctgaacaatgagtttgaggatagaagagcagctatgtttcaccaggctactttgcctactatggaagaggccatttcagccatggtacaggaggaaatgaggttaaaattgatgaggggtacaaatcctatgggatcagcatacattgtagctgatgatagggaatgctacaattgtggccaagtgggtcatgtgagctgcaattgtcccactccccgaaacagtggtggtaggggatcaatgcgaggatggtatggtggatttggtggaaatcatggtggctttggaggaagccatggtggtagaggaggtgaccgtggaggtcgcattggagatcatggtagaggccgaggtgcacctcaggctaatgcagctatggaggatggtaaagctatatccctaacgggtaaacaggttacacagtgggaggaatggtagaagaacaagaccaatgaaacctctaacaccaccacttacttcggtaacttcgctagccatacccaagcaggcaaaggtactcaggcacaagcacttgcatctacatatagacatcctatagattggatcatagactcaggaacatcaaagcataccacatgattccataatactttcacatcatacaccccttatgtccactccaaaactatccaaattgctgatggtacatccaaatctattcatggtatagggtcggttgagtgcacatcaataaatttatcttttgttctgcatgttccttccattccagttaaccttctctcggttagctcggctattgaccaattcaagtgcattgttgcatttgatgagaactcatgtcttttccaggagaaggggactggaaggaggattgggactagagtgaggcgacctggcgaacaccttccatggacagttccttacataatgaccttgctcaccacagtcataacaggtagcacttactttcctttggtctgacgatgacttggctgtcgttatcttcggggatctggacagcattttgacaggggtcttcggtgccaatattgggaactcctgactctgactctgattcgggttctgggctggcatctggacttgcacctgcggttggtgacattgacgcgactcctgacattgccgttgcatctggtatatttggtaccgacgtcgcatctgttgtaacaactcttccactgtttgagtttgattagccatgacttggggttgaggctgatcttcaagaggctgatgtggaatactattagaattgcactgagttgccccatgaaactgacagggtcctgattcgatgaaattgtccctcatgctgaccatctgctgcaggcaccagagagagggggaaatgggtggggttactagagatgaggtactaaaccacttacctagtgatctgttgtgagtagatttttatggtttaagttgcttaagcaaacaacctagtatggttgcatccctaccaatgatgcaagccatacccctacacacaagcaaacaacacacgatctagaagctaacgaaactactcttctgggaaagattgggtttaggtcatctccgggaaaactcctattgatcatcgcggaacgatgactctggacagatcttctcgctctttgcacgaagcttgaggcttagcttgacttgacttccaaacatgcacaaagctgatggcttgtccttcaggtttgacagctaaaagaattagagggacagggaggagaattttaaaaaccatttcacaaggaaatgccgaagggcgagaggagacattttgcaaatagggttttcagaaagtttgtccttagggtttgaccgtttggctcaacctacagtcaagttggctctgataccactttgtcacgcccagaaatatagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagcagcagcggaaaaaggcgatcctagcagggcttcagctccactccacaggcaaaactcaactagggtctgagccttggtcctctaacttcgtcttcagctcagaagcactacacttctgaaaagggggaataatagcaaggctgagtacaaccaccgtactcagcaagccacaccaacgatgcagacgtgcaaggggatacaaggatggtttgtggctatttgcataaaggcggttgtaaaacattttattgagcgaaacagtaaaactgttgagtaattagagtaacattaaatctccactgatcaacgctacaccacgttgaacaggcccaatcaacccacctgaactacagtgtattgggtcgatttattaagtatgagactaatcacggtgaatctggtcgaccgcccataaccgcgggcacggctattcgaatagttttactctgatcagaggtgtacaactgtacccacaagacacagccccacgacacgttaccgtgcgccgacatgccaccatgacataccggaaagaggccgtgacaggacccttcacataaccccctctagccaagcacaccacacctcaggtttcacccccgtccctagcgggcgacgggcagtcccctctcgtgcctaggtgaatccggaagcgacagaggccgtcgcagggcctgccccgctctatcacgcccacccttgcctggatgcgtcagctagaggaaagctacactataagtccagccgttgcccacgctggcttgtggtaagtacgataagttcttccagggcatcccgcgaaccggtccttaattgccatgggtgcgactagaaaaaccatgcacccacagcccaccattcagtcgcattttagttggataattacgaccatgaagcatggccagatgtctcgagcacgcagctcaacaagatactagaatgtctaatactgcaattatcccatcgactgagctagtggtaattaagcatggctaagcatatagttctagctaggtcatcaaagtaacacaagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgaactcttttcctcgcgaccgcggacttccgaaatgacggattctacacgctggcatgcaaaacgaggaaaaactctaataaaaaccaagaaaatagtacataaaaacaaaacaaacatgtagagctcaattttagatgaattttgcaagttgaatggctcaattcggagttcgaatgaattaggtatgaattttagaagttttgagccatttaaatgaatttctagaattaaactcgatttattgcgcaattattatttattttctcaaaggaaaaagcttaagcgctgacgtcatcaaagaggccggcgccgacaggcgggccccacacgtcagcgggtcaagggaatcggtccaccgtggaccgggaccactgggtggcgcggttgagcacgggcacggctcaggccagcccggccgagcgacggctcgcggcggcgcggcctcctgcggcgacggccggtgcatgcgagaaagcggcggtgaggcgcggcaaggggatccgggcggcccaggcgagcggggcggcggcaagccggccggccgacctaatggcagcggcgcacggcctggtggtcgccggcggcggccaccggcgcgacagcgcgcacgggagacagaggagggaggcaaggagggagaggaggagctcaccaaggacgcggcgatgaggggcggggaaaggcgggggggggggggagctcggcgtcggcgctcctcgggatgaaggcggaacggcggcccggcggcgttccgcgagcgggaaccggcagacggcggctggaaggacctggggaggatgggggagaggttaggagggggagagagggctcccagcggcatgaatcgctggtcggaggggagaatgggcggcggatgctcaccggcgcgaggggaaccgtgttccggcgggatcccggccgtgaaaagcggcggccgaggtgctcctcggcgctgcgaagcgagcggcggcgacagcgcgacttggggtggctaggagcggcgccaagcggcggctggagtcggcggcttcggtggaaggaggtggtgcgcgtggcgatggtgcttcggaggcggggaggggaaatggagcggacgccggggtgtggcacgacgcggcgaagccgctggtggcggtcgcgcggaacgacggtggtgggagcggctgtggcgaccggctggagggtcgtcggcgagcggcggcgggaggtgcaacggtggcggggtggttttcgtgcacgggagggctcgggagaggggggaaatggagagggaggtgcggggaatgtttttataggggaggggaggcgggatcgagcccgagagaggtagaaaccggccggcgatgtgggaggagagagagaggcgggaggcggcgacgtggccggattttgcggggagagtggggggaaacggcgcggacgtgggcgacgaccgcgtccacgcacgcgcgggagagggagtcgcgcgggagaggcggtgacgtgggaggatttggcggccatggcggcggttggggatggagctggaggtaggagatgacatgtggggcccacctgtcggagagagggggaggggaaaacgggctagggaggaaatgtagacttgaggaagagagagagccgagcgggccgaggaagggaagcccggcctaggaaggaggaggggaggaatttgggccgagcccgaaaggaaggaaggggaagattattttcttttctttttattctaattggttaaatgaactttgtgctatttaaattatttcttgagctccgaaaattcacgggaaatttcagagagtattttagggcacaaagaatattgcaaaatattcccggccaatgatttttaagggaaaattttaattctcccattaattcactcaaataaattgcttaaatttttatttaatttctaggaaatgcattattaaatgatttttaatcctgaacgaaaatcggggcgttacaggcgtgatgggttgtggtacatcaatcatgaggagctgggactaactgcagtggtaggagatcattttgcttcattgtcagttaggatatccatcttttaagattttgagtaagttgtatccagacctatttattagagtggataagcatagactggtgtgtgatgcttgtgagcttagcaaacatactcactttacatatgttggaattagccttcataactgtgaaccattcatattaatacattctgatatttggggaccatgcccagttacttttgtgagtagtttcaagtggtttgtcacctttattgattgtcatactcgtatgacttggatttatatgcttaagcacaagagtgaggtctttcgatgcttctaggacttccataaattagtgactactcaatttgatgcaaaagttaggattatttggcctaataatggaacagaatatatcaataatgaatttgtgtcatatgtctcagataaagggattattcacttgccctgtaacccctcctcaaaatggtgtagttgagaggaagaatcgacatttgctagaagttgcaagatctctaatattccaaatgaatgtgccaaagtatttatggagtgaggctgtaataacagttgcatatcttatcaatcgcatgccatctaggatacttggtatgaagtcacctaccgaacttttattgggtaagcgagagttcaaggtccctccaaaagtgtttggttgtgtatgctttgtgcgagatcatcgaccttttggtggcaagttggatcctcatgcaacaaaatgtgtgtttgttgactacgcttcaagtcagaaggggtataaatgttgggatcccattgggaggagattgtttgtgagtatggatgcgacatttcgagagtttgagccctattataaaagtaaatatcttgaccaatttcttaagaaattcttgactaccatggaggttgatagtcgagagggggagatagagagatgtgacacacatgaagaaaatgctggtgacaagaatggagaggtagtggtggttggatcaatccatgctttattgatgactagtaatcatgcacgtgcaatgcacgttctctgtattatatcatgcttcaacttaatatatataggtgaacaatcaatatgtatgcattacatcttgctttaacctaatatttggcagtgaaaattgtgtccaataaggtccattttttgtttcaaagataaaacaaagaaaactgtaagcttcattgcaacttcattcatgttgaaaataaaaaatagacaacaccttagagcgttcaatcagagattcagagtaaacaatgcagacgaaatccatgttacatgaataaataattgaaatggagaagacgcctcatttttatttccatacaaaatgaaaattaaagaaaatatagaaattcaccaagtagaaccataacaaagaattcagaaaaatacaacattgttgtcatctccatttacaaagaatactaagttttagaagtaataagaatgtataattataaatctgcaattatttcatatatctccaaactgaagcgggatcattcatccagatcgtcttgattgattaaaggcttcagcttgaaaacaattagttttgaaaatcaaattccaatccatgaatgaaacataagcaaacatatcattgaaataaaataaatatgatgaaaccaatgatcattttttaataagggattttcagcttaaacgatctcgatatctcttggtatgatcacatttactgaaagaagaagctaaatgatggaaaataaattaatgatatatctgaagcattttaataaacacatggtcagctagtattatacgtttcggcctggcaaatcatctaatacaaacatatgagtagcgtgcacatgtccaatctatgttgaaggtaaaataatttaacatgcatctatatatactgttaagtgtcaagcaaatatgtccctggaacaatagggtagcagacctggcggtggagtaagatgcagagcaagaggttatagcaccttaatttgtctctgcataaagcaccacaaattaaaggtatgctttttcagattttagtaaactaaaatacccatatttccctacatgacgtcgttacttaacattatgcacattggatgtattcctcattaattagaacaaaggtatgcctcaaaatttactgacctgataagtagttattccattaaaaagagttgcaagtaaacatcaatatttttgtaatgcattcttggcacatgatagaggtatacatgtttataacatgtgacatacacaaggcatatttcacaatgatatcaactaaaatgctccttctaccaaagataagagcattttttacccaccagcagattcatctattgcaaatattatagtgatattacttaaatgcaacagattagaaaatgataagggaaaactaaccttctggaaatcgattccagaataaacaatatggcagttagaaaactcaccgatcttcttgtcaattgtctgtttagtcaaaatatggttaattgccaaaatatgaacttcaatggatttataacgaaacaaatatcccatggtcgactaatgatttggggtgaataagctaatatggtccctgaaatttcg

SEQ ID NO: 32187 - DNA, 1802 bp, Oryza sativa
tgtcggccaccctccgcaacaatgttgggcctgggttggcctattatttttttgtttgcatcttttctttcttttctatatggtatataagggtaaaattgtcattttatttatactacagcatgcgacgatgacttggcatgctcacgtggtattctttatgggttcaagaactatattaacccaaatgataaatttggaggacttgtttggacgatttgaaacctcaaggactaaactgagcttaaagcgaaacttcagggaccatattagctattcacccaatgatttgcatggtaaataatcaagcactcagggcacatgaaaaggcataattcccccttatgtttaggaagctaatagcctttacatcacctgtctttgacagcaaatcatttttgccagataaacatatggcaacttttgatcaaatttgcactgcatcaatattcctccatcagtctttaatgtacctagaaccaacgactattgagttcaacattgtcaaaataaaatccttctgcagcctactacgctcatagtcaaacataatgtagtgttatcaatattaaattgttatacacattttcttcgtgtgttactgacttgctttacacttcaaggaaatcataaatcaacacttcaagaattattgttatcaacaaacgattatgtacaaatactgttgctgaacatacgcctaaggggactaacttacagctgaaactgaattgttaggacataggaggtatattaaactattaaaggaagaaagcatataaaaaagagcaaagccaaatagtcaaacctgcttaagagaatagcctatctacataaaatgagtaagcccattagcacagcatgttgcttcagttgatatattaacagtgttctgtagccttttaacttgctcatcagctatatttgtacaaaatactatttcttcaaacttctagctacaatttcagaacctaaattaggacataagcttatgcagcaaaaaaaggaacatctttggcatggtgcacggcatgacataatcgcaataagcaatttccagataacagaagtacatatgtacatcctattaacataaccaagctaaacatttcaggcaactaccaaatattttcagacaataatacttcttaatctacatagagagtaaacctcgttaatgctcatgcataaaaaaaatgagatcacatctacatagacatagataattagatatggcagggatagttaacaatcaagcatgaagtaaaatcacccgtggaacaacatagatcatcaaatgacccttcaaaaaaaatccagatccttcatttttttttcaccaagattcacttaatccctcaaaataaaaacaaagaacacttgtattaaggtaaaggttaggtttacctgaaaatcatattttgacagtgagaaaaaggttaggtttacctgatttagagtgtacaaagaaaatatagcgactcctagcacatcaaagcttcaaggcaaaattagtgagcggtgcatgaagaaagggaacagaagaataaatccgtgagtctaccaccatgattaagcaagaaggggaaatattacaacgtcagcaacattatgctgacaaataggacaccaagtagaaagcccctctagcagtaacattacacagttacatagctatatacagaggttagccattcacagaggagaaaatcccagcggcctcctaagtcagtaaaacttaggaacaacaattatatacagaattactgatggagcaaacacatttgacatagttgcatttt

SEQ ID NO: 32188 - DNA, 4917 bp, Oryza sativa
ggatccccctttttctgatcagatcaccattatatgttttgtagaggcatggtactaatgctggatgtgcattgttgaatacaagacacattatggattgcacagtttcatttcctgcaccacccaaatatcatttcagcatattactgctgggcatacatattttaatttaaaaaacactcggaaggggttaccaattacagatgttgaaactgtctatttcttagagttagattcctcattccttcattgcctgctctcgtgattcctttgaatcttgtctccattttgtccaatgcttatggacatgtatatctccctgtcaatgacacacttcttcatgattcggcggcacttatattagtagtatcagcaacagtagcagcggaagttatgttccaaattagagggaagaacactttatcatttcagtttcagtagcagggagaaaaatcacctggtcttctagacgatgttcatcagtttgctgctcttccagtgggtagtctactgggcgtcgggtaggataatcattggtaccgttgaagacctgcaaacagcggtacatgctgcggatggaggttttctcgctgcgggtgatggagggagaggaaggggcggcaaagagtatgtgcggcggtgaccgatggtgccataggcgtgcgacctccaaggaatgggaagagccgcggagcaaacggcaggcgacggcgtcggtggtgtggcgagcgacagcgtcagtttttgggttgctggcatgatcgatcgagcgcgcggtggcggccatggtggtgctttagtcctcgatctgtgtggcacgacaatagtgaggagggtgacgcatcggttgcgggcagcgccggcggcacccatacccatcggccaccactacctcgcggtatcatcggcggattttccctcgaaatgcggggatgattgcacatggcagcggcagcggctggggacgacctcagctccggcgggcgcaacggtggagcgcggcggcggcggaagacctaggctccggtgggggcagcggtggagtgcggtggcggcggggacacgcgaggagggaggatgtgcggagcgaggaggagcaaatagagcggaggccggagtcttcgtgcggtggcgagagcgcaggcgaacattgcggtagatggataggatgaaatcgcggtcgcggtgaagagggtgaaatcacgggtggatggtagggattagggattagggcaatgcggatgcagatggatggttgggattcatccggtgatttggccggtaggattggagaggggcagctcctcctttttatattagtatagatgtgagtaaagaggtagggcaaactgttgaagctacacaagacgaagttaaagaaatggatcttcataaggaggatggagaagtagttgttgagacaattccatgtcctatggagtgagccgaaatggtgaaacaaaaggatgtactagtttatcaaaggaggcggttttgatagtcggtgggagaaaagcaaaatgttagtgaaagatcaggttgaagagttaccaaacctagagtgctcagtcccagaatcctctcagaccctctctcctcggtctccttggctcctcttgagataattggtaacacttctccaagtcttgaactagtagaattacctattgcatagtgtagagagattagatccaatgctagtagacctcctgtatgtcttggttttgagcatcttagttctatgcgtgacattgcaaacgatatatcatattcctatatttcaccaacatacaaaacattcattgtatcattacatattgtgcccattctgaaggattggaagcgtgcaaagcaaaatccaaggtggaaagatgcaatgaaagaaaagcttaatgcccttgcaaaaaataaggcttgggaacttgtgagacttccaccaggtgggggggaagggtggcttcccagcggaggtttgcattggtggtgtgtgtgtgtgggggggggggagtcggagctgcttgtcaagggtggcaagctcggcaatgataaccttcttttgctttcgtcttgacagcgctgtggcagcatgggttgttgtagttggcagggagagagagctagggcgaagaccctgctcgatcttgggctagagccaacgatgtcgacgcttgtgggcgcagttatccttcttgaaggtgtcattactttgctctccccttttattcgggtgaaaaccttattccaatgttcgggcggacgttgtttggcattgcgacgctatcttcctccttggaggcttcgtcttgaagaccctgcgctagttatctgtggtatgttgataggaagtcagagctcctcttctgagctcggcaaatatgacctatgtcttgtccttcagttgtgctgtcgcaagtttgttagtttgtttttcatgtgggttttgtccggttttcctctttaaaccgtgcttatgttaggattttgggcccagttttccatcaaaagctgggccaaatctcttcttcttaaatgaaaacaggcactcctggttctctatgaggttttcttcaaaaatatatataggtaattgatctggtctcgatacaggtagttgatctgtaacagctcaagacaattagtctgtgttgtattgtacgatggtggtgtgagaaaacttatcacagggtttgcattaagttcacctcaaaatttacagataacttaaatggaattgatgctgcataaattttcttcagaacaaagtaaatttggtgaaatggtgtaacggttttataattggagtgcattttcctaacattgtgcggagtacagttatagttaaattataatatgcttaacacggtgttacttgttttagaaaggtttatgttgtttatttaacagatatatctctttcactcttttgggtaagttcagattaagcttttgtagaagtaggaagctgcccatatgctcatctgagcattttgcaaaacggcgattcaattttttttatctgtaatttgtgtataccgtgcatatcagatgtttgaagggtgcacttgtgtcaccttttattttgttcatggagcttttaataatagtatggggaaaatttgatgattcatcagtccttaagactggtacttgaccctttgccagttgccacttcaagagttcaagtcgtagatatgaccgctctaaatgatccaagaactaagcaattgtggtaaggttccgttgttttttcatgttcccttctgcatatttaattaatagtatatggtatggagcttcgttaataacttctgtaatgttatgtttacagatacacaaatgctatgcaactgggtgttttgttcttggtaaagtttcacttcctaatacagtatataccactgatccgtaccactgataacacaaattcatcctacagtaaacttctcatatgttatttcttttttgtaattgaacgaaaaatccgttgctggcttgcttcagtgcttgcatcgtactattaagttgcagaacacaaacttagtttattctcaaatataaagatgcatggttaccatgtcgatctgcatgacatccatttaacacactgcttacattgttcggtctgtgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccgtcctatataaggtgggcaggaggccctctagggggcatatatgacacaacctgatcgtcagatcaatacacacccggcggattcaaatccccaaacaggagtagggtattacctctcattgagagggcctgaacctgtctaaatcctttgtctctgcatccatccacttttaggtctcgtgcgctaccccgttttattattgccgaatccatgtttcgacagttggcgcgccaggtaggggctgcgtcgagcttcctatcaatttcatgagtcgccgacttcgttttcgctttgggagttttcacttcctttccgtcgaccacttcttcaagctcctcttctctgacttgatccaaatcagtcaggggaaaactcaatctgatttttatcattatttatcatatggatttttaatctcagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggcctgcctccgtcaccgctgagtggtgcctccgcctacacggctggcctattatgccgccgctgttgggcgtctacgacttcaccgccggcctgcctccgtcaccgccgagtggtgcctccgcctacacggctggcctattatgccgccgctgttgggcgtctacgacttcaccgccggcctgcctccgtcgccgccgagtggtgcctccgcctacacggctggcctattatgccgtcgctgttgggcgtctacgacttcaccgccggcctgcctccgtcgccgccgactggtgtcctcgcctatatggttggttggtcacaccaccgttcatgggcgtccacgtcttcaccgccggcctgcctccgtcgccgccgagtggtgccttcgcctacacggctggcctattatgccgccgctgttgggcgtctacgtcttcaccgccggcctgcctccgtcgccgccgagtggtgcctccgcctacacggctggcct

SEQ ID NO: 32189 - DNA, 3911 bp, Oryza sativa
  unsure (1)..(3911): unsure at all n locations
cgtcgccgccgagtggtgcctccgcctacacggctggcctattatgccgccgctgttgggcgtctacgacttcaccgccggcctgcctccgtcgccgccgactggtgtcctcgcctatacgattggttggtcacaccaccgttcatgggcgtccacgtcttcaccgctggcctgcctctgccgccactgactggtgtttttgcctatacggttggcggactccgccgctgttaatgggcttcatcatctacaccactggcttggttccactggcgccgactggtgtttttgtcaccattgatggactgcttcgttcccacatcggctacttttgctgtcaccgagggaatattacaaagctaagtcatcatttattttattctttatatgatattttgccttttcctttgcctcactacctcaactggttcgccgttgactagtgagtcgggggctatagatgttatatcgtattttttaaacaattttcataatatttatcttgattgcttgcgacataatctgagtacaaaagtacctatcaagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatgtttatatcagatattactcatcctatatgtttgttctgcaggatccagatccagatatgcataaaagggattcagggctttaagcttatctcttacgctccaggaatggatcagtcagaacaccaccaccggctcgcctcgaccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgactggcttgcctatgccgccgccgactggtgttttcgcctgcacggctggcctttatgccgccgttgttgggcgtctacgtcttcaccgaccggccgcctcgtccgccgccgactggtgcttccgcctgcacggctggcctattatgctgccgttgttgggcgtctacgtcttcaccgaccggccgccttcgccgccgccgactggtgtttccgccttcacggctggcctttatgccgccgttgttgggcgtctacgtcttcaccgaccggccgcctcgccgccgccgactggtgtttccgcctgcacggctggcctattatgccgccgttgttgggcgtctacgtcttcaccgaccggccgcctcgtccgccgccgactggtgcttccgcctgcacggctggcctattatgccgccgctgttgggcgtctacatcttcaccgaccggccgccgcatccgccgctgactggtgtcaccgcctgcacggctggcctgttatgacgccaactgatgctatctttttcacggctggctacatcaccgtcaccgctaataggcatcatcttcaacacaagctgtctacgtctgctgctgactagtgccctcacctctacgtctggtttagacagctaccactactgatgaacatcctcgtcttccgtcgccgactggttatgctgtcgccgactggtgcttttatcttcacaactgcgcgtcttcactaccggtttgcttctgttgccgccgactcgtgttcacttcatcacggcaacacaactttgtcatcatggtggagcgacttcatctttattatcttcggtaccagcaaactctattgctgctacttcacaagttttgctacatcaccaaccatgacgttgttgtgaatctcgacatctcggcatgcgatgccgtgttattttactacaacaagaggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaaatatttcagtttggacgagctggacaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctgatgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcacgggtctattttatatgctcaaagactggtctatttattattccccgtaagggttatcaactgaatacttgcgccagtcgggattcaattgttatatctattttggagtatcccataagggataatcactcagatcagaagctattcatatgagctacgcttggtctatattacccggaagatttattactcgggagcatgttacatgcgtcatcctttaaagggtgtcgaaggcatattttttggcctaggcctaatatgtctgcaacccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32190 - DNA, 906 bp, Oryza sativa
atggagttctatcttcctatgctttccgttggtttgccaatggatggttgcctttgggccgattcctagcacccgggggctcgttggatggaccgagtaacgcaggtgctaagtattattcggaataaatcaaaagcatagagatgagataaatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatgtttatatcagatattactcatcctatatgtttgttctgcaggatccagatccagatatgcataaaagggattcagggctttaagcttatctcttacgctccaggaatggatcagtcagaacaccaccaccggctcgcctcgaccgccgccgactggtgtttccgcctgcacggctggcctattatgccgccgttgttgggcgtctacgtcttcaccgaccggcttgccttcgccgcggccgactggtgtttccgcctgcacggctggcctttatgccgccgttgttgggcatctacgtcttcaccgaccggcttgccttcgccgcggccgactggtgtttccgcctgcacggctggcctttatgccgccgttgttgggcgtctacgtcttcaccgaccggcttgccttcgccgccgccgactggtgtttccgcctgcacggctggcctttatgccgccgttggtgggcgtctacgtcttcaccgacc

SEQ ID NO: 32191 - DNA, 680 bp, Oryza sativa
aggcggccggtcggtgaagacgtagacgcccaacagcggcggcataaaggccagccgtgcaggcggaaacaccagtcggcggcggcgaaggcggccggtcggtgaagacgtagacgcccaacaacggcggcataaaggccagccgtgcaggcggaaacaccagtcggcggcggcgaaggcggccggtcggtgaagacgtagacgcccaacaacggtagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcggccggtcggtgaagacgtagacgcccaacaacggcggcataaaggccagccgtgcaggcggaaacaccagtcggcggcggcgaaggcggccggtcggtgaagacgtagacgcccaacaacggtagcataataggccagccgtgcaggcggaagcaccagtcggcggcggacgaggcggccggtcggtgaagacgtagacgcccaacaacggcggcataaaggccagccgtgaaggcggaaacaccagtcggcggcggcgaaggcggccggtcggtgaagacgtagacgcccaacacggcaacataataggccagccggcagg

SEQ ID NO: 32192 - DNA, 48915 bp, Oryza sativa
  unsure (1)..(48915): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttactgaagaggggaaggattgagcaagaatgagtacaaccacagtactcagcaagccacaccggcggatgcataattaatgcaagggaggtacaagggaataataatatagggattaagttttgcagtaaacagcatttaaaagacacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaggacacatcttcctcacgtgcaaacacgtgccacataccaccacggtatacggacggaagacgtgacatagttcccaacccatcctagccataaacaagagtaccgacccaatcccacctacggccgggatacccgggacaggcaggcagaactgagcccctagcagcagggcaccaaccctctgccatatgacatctcgactaccgggccgcagctcgtgtagccttcatttgtcctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccataaatagagtgtccactagttagggttttatttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacaccggcttcaacttccacgaagagcggatcttccgaagctgcagcgtctacacgaccaacggaaaagaaaaaggcttttactctaataaactccaaataacaagcaggaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaatttaaaatcgaattattgcgtcagccgaggggagagggcgcgcggaccgggtccacgggagtggggcccacgcgtcagcctctcggtccacggtggaccgggagcacgcggctggcggcggtcggcgccgtgggtcccgcgcgtcagccgcacccgcgggcgcgggcggctgacggccgggcccacctggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcgatgttcgggcgaggaggaggcgcggacggagtcggcggcaacacggcgaagcggacggaggtgtcgccgagtaaggaggaagtccggagcggcggcggcggcggaacggagctcggcggcgacggcggagagagaggagcacggcgcgagcacgaatccgacggcgagagcgagcggcgagcggcggaaacggaagagcgaagcacggggatcgaataaatagcaacgggagggggagagcgcggccggggagagaggaatcgcgcgcggagatctcggccgccattgaagacgccggcgacgattgcgggatgaatccggacgaatccgagggagagagagagggaaaagagggggaatcgggagagggaaacgcggggagtaattcgcccctctttatggcgcgcggggaaggcgggatgcggcggattcggcggcggcggcggcgctagggcacgggcggcggcgggtgcggcgcgaggagggagatgacaggtgggacccacccgtcagcgagggcggcgggcgggcccgcctgtcagcggcgcgcgcgcgcgggggaggccgatgggccgcgggggaagagagagagagagggagggaacgggccgagccggcccaagaggggaggggggggggaaaaggagacttcttttagggtttttctttttataaacctttttaactttgttcatttcttttcaattattatttgtgctctgaaaattccactaaaatttgagggctccttttagaccaaggagaatttaacaaaaattctccgggccacatttgaatttttcttgcacgtattttagtgtttgccaatttcttttcgaattttaattaattctattattccttttagcgaatgatttttatttcgggatgaatttatcaggacgtgacaaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatctgttcttcttcgcgagctcggacatttttttcctcaaagccattgcttcagttgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgacgggctttccatcctgatcgagagcaatcacgttgtaagtttccttgggtaatttatttttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgtctggctgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtcccaattatacataaatctcaatttaacataagtcccaattatacataaatctcaatttaacataagtcccaattatacataaatctcaaattaacataggtcacaatttaacttattttcacataagtcccaataacttaatttcacataagtcccaatttaacataggtcccaatttagcatcagtgacaattaaacagaaatctccatttgacataggtgccaatttaacaaaagtcccaattatacatagatctcagtttaacaaaaatcacaattatacataaatcccaatataacataaatctcaacttaaacataagtcacaatttaacataggtgccaatttaacaaaagtcccaattatacataaatctcaatttaacaaaagtcccaattatacataaatcccaatttaacataagtcccaatttaaacataagtcccaatttaaacataaatctccatttaacaatccacaattaaacctttctcaaaattaaacaatccacaattgcacatatcacaatccacgatgcacaattaaacaatccacaatccacaattgcacatttcacatttctttttttaaaagtaaatgttatcgagcgacggcggggacgacctggcggcgacgatggcaacggcgaggggggagaggtccgtgcggcggcgacggcgacctggcggtggcgacggcgacgacgaggggggagaggtcctggcagtggcgtcggcgacggcgaggggcggggcgacttcggggaggagccagctgtagcggggacgacttggcggcggggacgacctggcggcggcgatggcaacggcgaggcgggagagttccgtgcggtggcgacggcgacggcgaggggggagaggtcctggcggcggcgacggcaacggcgaggggggagaggtcctggtggcggcgacggcaacggcgaggggggagaggtcctgacggcggcggcggcgacggcgtggggcggggcgactttggggaggagccggcggtggcggggacgacggcgacgacgacttgggaaattttggcagcctggcggctagggtttcgcgggagccgggacttagaaaattttggctccccgcgctccctatatataggcgcagatcatcgtatgcgggcggcttaagggaccgcatggaaaaatatctttccatgcggtcgacataagccggccgcatgcgaaaaagatctttccatgcgggctgttaagccggccgcatgcgaaaaagatctttccatgcgggctgttaagccggccgcatgcgaaaaagatctttccatgcgggctattaagccggcatgcgagccagccgcatagaaagatctttttaccaaaaaaactcatatttttttttctctaagtaaactgtccatatatatttttttcccaatatttcgccacaattatacattccaaatgtttttggcactaagaaaactcatgaaaattgctcaaaactcgtaatcaaatgttacatgctaatgattacaacataagggggacctaaattcatgcacgtacatttggaatacaatgagaactaaaggttacaaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacttgagccatacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccatatttcttgaatggtcccataatacgacctcttttctccactcgtgtcaatcgcttcgacacggatcccactattttgtgcggtgcttttcatgtccttcgtagtcgtactcaaggtaaatccattgatgtcgtaaccttgccatgaattgacaatacttgaaggcccacatgccagtctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgcttataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaataccttctgcgaaattcgattgaaaaagtagcacaactttgttataaccacctttgtatggactggtttgactgcccttatagcaattggtaggaacaccgttagcaacctatgacagtcatgcgtattgtatcccgaaatggacaaatccttcattgatactagcttcctgatgttcgatgcgaaaccagtaggcactctaaccccttgtaaacatttacagaaggcttttttctcttcaagtgtcaacaagtaacaagcaggaggaatctcggtcttcccatttggcagcactactgggtgaaggtcatgccgtatggacaaatctacaaggtcgttacgtgacttcaatccattcttcgttttactcgggatgtccagcaatgtgccaacggtgctatcaaacacgttcttctcgaggtgcataacatcaattgcatgtcgaatctctaggtccttccagtaatctaagtatttaaagaaaattgaatgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatattagacatccagtcttccctttaatctgcccagataatgaaaagtttgcaggtaggtcattgatggtaacaaatatgatcgcacgtagattgaagtctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaatgcaaaccttacattcctaggatccttagcaaattctaggtgttttgcatcaaatgtcttccactggcgagcgtcggcgggatgtcgaatcataccatctatttttcggctctcttgatgccatctcatcaactcagcatcagtcgggtttgagtacagatgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatgatacaaagttaggcttaggaagcaacacacggaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcctgccaattctccaatcctcgtgacctacccgctagcacctctggttcaacatggcgtagcatatcctctaaatcaaaaccaccatcgaaatcatcactatcggtggaaacatcgacaaccattctttcacgcgaaatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaatttacagataaaaaaatagaccgcaggtatttcatacaaaagtttaaatgcatttgtctcccaaaaaaatacaacaatacatgtaactagtatgtacaattgtttacatgcaaaatttgcccatcaaaacatatattttgaagctagattttgcaaaaaatagttagaacaaaccttgtcaaaatattaaaaaaactccactttccaccaacgaaatataacaaaaatggagccaaatgaagcaggatagagagttcttcacctttcgtatagagttcaagtaaaaatttcgagttgaaaacctccccccctaattggtgcttgctttacgagagagaaagcttcgttttcaaatggtcaagctcgggcctggaggagcatatatggccgatcatcgcatgcggctaatcaacccgcccccgggggggcggtttttgcaggcgccgccacaagcggcccgcatggaacctaccgaccccctcgtacagaaaaacgatttttgtagtagtgttaattgcgggctggcgcaagaggacaaatttaggctgtgtgatatgcgaacgtcgtcgaagcagattttttttttttgacaatggaatagaatatcccggcctttgctcaaaacgagctacaaacaattattacaaagttacacttaaaaaagagtgtagtccaacaaaacattgagaacacgcacttaaaataaaaaataacccatctaagataaggagaacacgttattgaagtctacttgtgaatctccaaccataattggcaaaaagttgcataactgtcgtctcaagcctacggcatgcaaccttcataaactcgccatcttcatcacacctttgtagctgagcccaacaccggagccaatatgttgccctgaaaattacctgcatatatgtaatagatggtgatttgtcaaaaaccaaatcattcctgcttaaccacagagcccaacatattgcagaggctcccacaagtataagcttactccttttcttgtccacccccaaaagccaaccataaaaaatatgtgatatactactaggagggcatagaccaaaagaatattgtattgctctccatataaagtttgtataatggcaattcatgaaaagatattgaatattctcatttttcattaaaaaacaacatcttaaactacctttccaatttcgtcttgctaaattgtctttggttaacacaacccctttaagtaagtaccacatgaagatcttaatcttaagcggcattttaagtttccaaatcattttatttctctcaatatagccattattaattaaagcaagatacattgacctaaccgagaaccttccattctgattaaagttccatctaaaacaatcagaagaatgattcaactggatatgtacaatagaggcacacaactcatacaaaaaaataagattctgaccaactaaagctctcctaaaagaaacattaagtggaacagatctcataacactagcaattgaagaacctttccttcggacaatggcatataaagagggatacttatctttaaaggctaagttatctaaccatttatcttcccaaaatctagttgttccccactattcacaatccaggaacccatgtttaagaaagtatcctaaactttcatgagacctgactaaaactgaccaaaaatgagagtcaccttgcttcttatcaacttcagtaatagacttattatgaagatatttcctcctcaataagtcttgccaaaccccttgttcattaattaacttaaacaaccatttgctcaaaaggcatttattttgtatttccaaattatgaacccctaaaccaccctgatctttgggctggcaaatgatatcccatctagtaagtttgtactttttcttatgatcatctccttgaaaaaaaacgagatctataataatcaattttttgaagtacccctttcggtatctcaaaaaaggaaatcataaacatagctaaacttgaaagtacagaattaatcaacaccaatctaccacccacagacatatacttacctttccaactactaagttttttttcaattctttgttcaataaccttccagtctttgttacccagctttctaaaatgcattggaataccaagatattcgacaggaagagagcctaacttacaaccaaagatattagaatattgatcgtaatgatccttcgtttgaccgaagcaaaataattcacttttgtgaaaattaattttaagaccagagagcttttcaaatacggataaaatcaattttagattctttgcttgctgtaaatcatgctctagaaaaatgatagtatcatctgcatactgcaatatagataaaccatcatctaccaaataagaaattacaccatttatagaaccaacatctttagccctcttaataagtaaagcaagcgtatcagccactatattaaaaagaattggagataaaggatccccttgcctaagacctttatgggtttgaaaattattactaatttgatcattaactttaataccaacatgacccccttgaataaaggaagctatccactgacaccatttaggggagaaacctttcattcttagcgtcttttgaacaaatgaccatttgaatttgtcataagctttttcaaaatcaatcttaaagattacaccgcttttattcttgcgatgtaattcatgtatagtctcatgcaaaataaccacaccttacataatgttcctccccggtataaaagcagtttgagtaggactaatgaccttctaggcaacactcataattctattcgtagcaactttggtaaaaatcttgaaactaacattaagtagacatataggcctatatagctgaattttcatggcctcaacacacttgggtagtagaataattgtaccaaagttaaaagagaatagaggtaaagtaccgttatgaaaatcattaaagagatccattaaatcatgtttaataacattccaaaaaacttgatagaactcagcaggaaatccatcaggacccggtgctttattatgttccatttggaaaatagcctccttaatctctttctcattaaattgttgcgttaaagcttcgttttcaaaatgagaaacttgaggaggttttttttatcagatcgtcttttaatagactgagatattgcaaacgtatcatgtagaatatgtacgtcaaaagaccagggcatagcgtatatgtatctataggtatactagcaaaatacccgtgcttcgctacagtgtattaaaactaaaaatatttatttttagccaaagttattttcacactgtttggtacttttgcttgataggaaaagtctcaaatgataggtgacgccgctttttttttcttttttttgggattatcgttcggtttttatgttgtgatttgtactccgttcacgattaggattttgtatcatctttgatttttttcaagaaaaagtgcccgcgcgttgcaacgggaagaaaagatgagaaaattgaggaggagttaagaaagatttacttaattaactaaaatacaaatttctggaatacttgtattttttaagtattttttaagtaggtaggtgtttaaattaattgaaaagtaaagttagtgtaggaaataaaattgatatggctagatttaattttaattaaattctctatagttaattacactttctggaattttcttggaattttcagagcttaattgctatttttaataatacaaatatcatttcagcatttatttaaatagtaatctaaataaaatcctcattacacctgggccattttcagcccatggccaccctcagtccacagccgagccggcccgctttcattccttattctcccctcctcctcggcccgcggacacgcgtccgacccagcaagcaacgaaaaactaattaccctccctatctcactgtcgtgtgggcccatcactacagtgtcatcccctacctccgtcaagttcctcatcttcccgacgcctcccgatgtcaccgccttcataaaactcggccgcatcctttaagataatatgaaattagttgaggggtttcaatccttatattctcctctttccgttttcccaaaaatcaaatcaaatctgcttcatatctagctgagaataaagccctatccaaaccctatttttcctactgtattacgatgcaacccatgttatttttccgcgctaactattggagacgggcaacgcacacacgcgcgagagggggaagagggaatcgcacgattgatggacgaaaataagtgtgacgaacggaaatttatgaatctttatattagttaagatatggtcgattgggaaggcacccaacatccaacaattgaattatctgctgtttactttgttctatttataccttctatttctttgcttttttgctcagaaagtaatctttcgtcgtcatgtaagtacgatagttatcttcttttatctaaaaatattctttacaaatgtaaattagtttttgattccatgaaagtgaattgattgctttcattaaccggttttgatcttaattttaacgactctattaattataccgtaagccgttaggtaatcttttgttgaaaaaaaaagcgtcaatacttctcaactcgagagaccagcactccatcttcactaatcataaattcacaattcctaatctctgttgttcgtgtagtagcagcaagaagcaatttccgatataattgtaaatgatgttttagagaatattaagtatggttgtcgaagtgacaactgcgtacgtcgaaggacgtggatactcaatagtcactggaaacggtgaagtgtattatctttcttttattttttctggatccccgttacatggccctaggagcctatttataaccctattactagttcccctattggggtttaggtttaacaggggaatttacatggttgcccttatgaaagggacatttacatgggtatatagtgtaattaaggtatatgggcccctaatgggccgactggcgaacgctggcccagtggcctccgggcttgatcggctgagatggcctcttgggcctccttgaagttggacttgctacggcaaagtcatccgccttcgccatacactcttcgccatatagtcttcgcccaacatgccttcaaccttgtgggataccggtgcgattcttcacccttcgccatctttgcttcatagtcttcgccatgggggcttcacctcaacagactcgacgtcttgggcttgaacccacccctggttgcatggtttcggcaggtccggtcgaagggtctcatgacataccgccaacaagcccctcacgggcaagagtgagataggagcttcggctgagaccgtgcaaaccatgtggtatggtatggggcgccccctttggaccgacgctcctgccgaaacctattctggagtcctgcagagaaagtgtgcattatgtgtacgtgtacttttatggttagtaacgttttctaggtttcgcgtcttgcgaacggcgaaaccgtttttaattttctctaggccaaaatgaacagtgatgggctttccctcttacgattgggtggggagacgaaccgtcgcctgggtgggctatatattcccccttcccctttttcaccgccgcactctcgtcattttcaccgcgagcgctctctctttctccattctttcctttcacgacgccctttgatttcctagatctttcgcttgttctcccttttcgccaccgcgcacacctttcaccatggctcctcgcaagccgaacccagcttccgcgacaagccctaatccaggccgaatcgacgacgacaccaccgcctttctaggggcttcgcttgtggacgacgacgagctggcaaagcttgtcagcgccagcctgctggtggaggggaaggccttcgctccgggaaaggccgtggtgccgaaacacggcgacaaccggacgatggtatttgccgtgttttttgaggtggggcttcagtttccatgcaacgttttgttgccggagatccttcgtcttttccaggtggagcttccccagctgagcccatcggcacttgtccgagtcaccatcttcgactgggcgtgccggaccgccaggttcgaaccgagcgccgagcttttcggcgccgtgttctatggcaccgtgaactcgaagacagtggtcaccccagccgggacaaagaaaacggcgttcgggagcgtgaactttaatgttcgccccgagcgctccgatctatggccggtgaacgccgccatgtcgaagtgggatcgccattagatggcgaagtggttctaccactccatccccttcgaggccggttccgacgcggcgaaggccctccgttggcggcgcagggcaatttcgccgaacaggaagcccaaggtcgccatcgatggcaccatggaggctcggttcaccctgcttcgcaaggtctgctctcggcttagctgccgcgatctggtggaggaattttgcatgcttcggattttccccctctcccaatcgtggcatgttgtggtgaatgaagacgaggaagttcacggcttgtcaaagctcgtcatgcccgagggggcgaacagtgagcctctgcatttcccttacgtacttgtgactcgctctttttgttcaacgcttgatgtggcgatttttcgactttctgcagtgttgacccttgctcaggttgacactgaagcccggaagatgatcggcgacgtgtcgattactgagttcagccagctgcttacgcggctggcggccggtcgggcgaaccgggtatatgtcggtgaactgcctccccggacgaagtccttcaaggccgatggcgatgaggggccatctaggaagtggctgcggggcaggtgaagttggccccccggaagtgcagggcccctgcctccaccgactctgatgctgatgacaaagacactgtcatagatcacgacgacaaagaggaaggggaggatgtgggggaaacggaggttgtggccgaaaaggccacggacgaggccgccggcaaccgcgccaagacgcccagctacactccgactccgagccccgagcacgttgggaccggggtggagtcgaacttctccctcctccgccaaatggatatggagggggtgaaggcgctggttgcgatcgccgcaaccaaggtgacgaaggggggttcgatcaagaaggcccccaaaaagaaagggctcgttgatgtcgctcgcatttttagcgacgacgagtcttcggacgagacccctacttcgcccactggtcggagcttgggtctttcgaccgctctcagcgccatggttgatgcaggtggagctcggggggagtgtggccgctgggctttggcctttgctgaccggattgtcagggtcgttgctagggtctttggcagtcctgtgcggaggactgtggttttcgccgcttgtcattgagaaggggaagaagacggtcgtcgagacgtctgcttcagagtattctttggtggccccccactgcgcccctgctgacttcgagactggcgcggaccttatccccttcgtcgagggggtaagtaatctcgtgtctctggctggcagcccgagcctattcaccgagctgaacgagttcgacgaaggctattctgccatcaagcgtttggcggttcgggtatgttgttctcctttttgtttactttcagttgtccgtcttcgacggcttatgttaacgcttgtcctcttcgccctctctttttcttttgatctagattctcgcggcccattgttcaaccgaacggactatgcgggcttgccttgacgggttcaagaaccgtcttcgagccaaggacgacgaactgggccgcaagagcttggagatggagggcctcgccaataccctcaaggaggcgaaggctgagaataagcggctccaagctgaattggagaaggggagcgaggcgaaggctgagatagagcgcctcaaggctgagctcaaaaaggagcaagcacattctaccgctctaaccgattactacaatctcatcgagccgaagatttaggctcttcgcctagaggtcagcaaagcggaggcgaacaccgaacccaaaggaggcggcggtgaagcttggtgatgatggaagtgttgggatacgcgtaggctacgatagcataaatcaaaattttctatcgcgtaaaccaggaaccatgcaagtattagatcatagatcgttaccactcgacgcgctgcacagcggaagaagacgctgagaagtcgaaggaactctcgcgaagtagcgcgcgtcgatgtagaggaagtagtcgatcgcaccggctcgaccttctcctcctcgtgctttctcctcgccgtattcccacgccgatcagcaccgcaaaccagcggcgtctctaccggtatccacacgtacagggacggaacgccacgcgcagatgtgcttgcacccgcgcgtggctagggttttgctcggggagggaagtgatggctagggtttctcacgtattgcaatacctccgccggtcacacccctcacgaatatataggatccatcactcgggcctccaaggcccataggactcctattcggatccctatccgaattaagcttatattggatccctatcaaatccccttattccggcccattaagcatgcgaccctgtatgttcatatatactcggctgtaatctgaaaactccttttcggtccacgcgtcaacagcggcccctagcagaacgtattgacccaccgggcatacataaagatcatatcggttgaacctctagtgtatacttgtataaacccctttgcctcacgatatcgattaagctcaaggctagatatgtggcatcctctaatagctaatcattcactcgaacctgttgatagattatataacttgtgattgacccctcaatcacctttggcatggctatgcacttccataatctacaacatcgaggggcctagagatatctctccataggaggggcaaatcccatcttgattatacatatcccactacatatttcatagcatacccgaaaactacttttatagctacccatttacggagtagcatttagcagttcttaagtaagctactacacatgttgagaaccatgataatctcaggtctaaggattcaacaccaacactaaatgagatcactgatgacacaacacatatggctcttgcagtgtctcatgttgggtctatccaataacatgttcaccaacatgtgtccacattattaatttggtatctctataccatgatccatgagacatgatcatcaattaaaacatgtgctgatcatataaacatatttgttccacatatgatatttgattagggatcctttagaaatagtaacaaacaacataaagagtctcatgaaagaatcacatattcattaaccaataaggagttatctatttcaaggaacaatgtcggataaatatgtaaacaaagtatgtgatacaatcatctctatgattgcctctagggcatatcactaacaggaaggagcagcagggcctcgctggagatcaaaacgcggcggcgagctcggtcttcatggcgacgaagtgcttcccggggtcttcggctttggggagatggctgctgagcttgctattgaccttgcggagccgagagaggtggcggcgctgactggcgacggccgaagcgacggcgcacggcggctggagcggcggccgaaggtagagagagaaggggctcccggggagagcaattccggcgacggcggaagacaggacttgagggagaggtagaggacaacgagggggtcctttatataggcacgggagctcgggtccaggcccaaatcgacggaaaaactacgggaaattctagggatcttcgccggaaaaaggaaagattgatccgcgaaattggaaaggatttccgtagaaacttttggggatttcttggggaaaaggaagaggagattaagaggattccattcccagaactaatttggaaataggagcaacggggaggtcggatttggaaggaggaggcggcggcagtgcatgcgcacggcggacagtcggctcttcctgagctggaagatgaacagtggcgcaggaaggcaaaccagacttttggctgggcttctattgcacagcccgatagaaggaggaatgcaaaccagactttgggaagggataaggccggccgaatagaaggaagaatgggcgaggactaaaggtgaactggtgtgattatggtgaataagagcaataccggcttcggccaacaggatgtagggctattacttgacaattcaggggcccgaaactatataaaaatccctgtctccatctcttttaccttagtctcgcgtatatcctagtaccaacgatcatcatactatgcaaataccggaatcgcgacataaaacgtcgacagtggcgcgccaggtagggcgatttttggtgcttcaaggtttcgatgagatgggtttacgagatggattctccaacaacaagctactcggcgacttcggctgtgggaaaatctaacctgatcggagcatatcttccgacgagattgggactaccgccgccgcggagaaccatgatgtcggaagcagcctaaccctcgacgcgtgcgacatcaactggtgcaaggcatcggccggccgagtccaagccgaacccgacaccgattcctaccaaccaagcaagtgtgtcgaggagccaaaaatcaactgccagagtagtgctaccatgttctgactaggacccgatttttagtcagttgacacgggcgtcaactcatcacggccggcgtcaagtccaaccaatttggataacgtccatatgtgcatgcatcagatcaattaacagcaagtgcatgtgtttactgcattcatgcggctgtacacctggagaagtaagattgcatcgatctaatctactccgaatacacatgtcagaaatgtaattagtaggttaattaatttaattgatctactaatttcgtagatatatccggcatatatctacacaggtacgcattattttatataaaattttccataccaatattcagatcatacaacattgtcggatttataatttattatgtttacctagagcatgttttttatacaatatctgttgcgcgggtgtccctgatgttaaatcgactacgatctaacgctggggactcgctctgtcttcttctgtataaatcatgcttgtttacagtttacataatgccctgatatttaatctgctcgttatatcctgataatgctagaagattcatgcagttttttgagtacatactcgatattatctgctatatatcttgtcttctagaaaatatttttcaggaacaattgagcactcgagtaggttgtggtcaagtacaccgcattatcgagaacgatctcgacaaatgcagagtcgtcgcgcccaacctaccaacgaaaactgacaacctatctcatagcaccggctgtggctggactatttgagaaaaggttgttaacggataattcctcgtgaacgttgtcggctttattacctgacatgattgtgaacggacatccggatatgctacaagttgggtgtgtgagtcatgctagccacatgagatgcgcatgtaataaaccaattccagcgcctccataggtgttcgagagtcgaggtacgactacagcaataacgcagcggtcctcgtactacgacttcaaatgatcgagagacacctactcactggtcctcaaccagtcaattgtagcgatctctcgtacatttaattctagtggttgagttacgactactacctggttctgaccagaggtgtagtgattctcccattacctctacttcaacaaagttgatatcaggtgcacaatatcgccaagtgttttacccagagatcccttaccacaaaagacacctagcgttgaaacctatcctaatgtccctttacgccgtcttgacaaagcctctgaggaacctaaggaaacttcggctggggacgcccagagcggataaggctttgtcggatcctttagagacgaaagaccatgtaagatctggtcgtgtaagagttctcgccgtgcgtattaaccaagccgtgtaatcgaaaatggattttccaacttcacggctgggggctaggatcagtgcttgttcaaccgaggcaggtgaaaggtccaagagccttatcctccaagaacaattcgccgacaataaggctaggggctagggagagtgtataactcaacaaactgactgatcgaagtcggtaaaagagtagacgctcatatacaaaacattggtctgtaagtttaatgcattttcggttttccatacatattataacatgttaccctttgagcgttcgctcgggggctatttctatctaatattcttttctgagtattgattttaggaaaattctattcgacattatcgaaggctccatgtctctatggttctacaccaagatcgactaaggcgagtacgacaaaattcgacaaggcttcgtcgctgattctacgccttctcgatcactcgagaacagttggtggatctcgacaaggaatacggaatgaagaaatggtgtacccaccgagataaaatttcttgacttcaatccaaattctcgattacagcaagacgggagacttagtcgtatgctttgaactttcttggttgacgtcagagattgactcagacacaccctttaggtgcccgcacgaggctgataaaggaagtctaacgttatctctgaattcaccaagaacggtcacatgagctcgataacaattactctaaggtctgcgcgcggttgagaatatgaatttgttcatttgcatcgaagtctggggctactgtcagggttatggataccacatacctaatagtagttgactaaatctcggcaggacccaccatataccatgtcctatacggaaagaacctgtggatatgggaagagttccggataaggaaagacaactagagttctacatggaaacgacaaggactactcggattgtatccatatttgttcccctagttctacttgcacaaggggatacctatgggtataaatacaaggccccctaggaggagaggggacacacccaccatagaagacacagacaacatagacgccacaaagctacaagccaatacaagccaacatgcgccaagacaagccgccggatatcgacatcagagatacgcctggatcgaccctatccggtacgtactgaggctagccgtagggatctagcgctgtctctgacctcgccgggcacgaactcgaggaagaagactaccctgttgtcgactacgagtcagacctacagaccgcaaagtcgacaacagttagataggctaccccaaatattgtacttggtgtgattatggtgaataagagcaataccggcttcggccaacaggatgtagggctattacctgacaattcaggggcccgaacctgtataaaaatccttgtctccatctcttttacctcagtctcgcgtatatcctagtaccaacgatctccatactatgcaaataccggaatcgcgacatcaaacgtcgacaacttgggcaccctaagtatttaacaaaattgaaaccagctcatttaatgattaatttaatatgtgaataattactgaaatagtccttgtattattaaaattaggaattgagctccgaaaaatccaagaaaatttcagagagtacaattaatcatggagaatttaataaaaataaaatccagccatgctttatatttaggaaattttatttcccacatttaacttcacttgtaatttaaggaacatttaatataaattctattaatattttattaaatactttataaatcctgaaacgaaaattcaggctgtgacaaaggcgaacgatgtaaatttggccaatggccccttccctttcttactatagccaagaacggtctttttgatatatggaatggatgatccaagtttagccaattattatgcttgatgcctttggcatatatgcttgcgtcattttcgcattatttttgcatactagagagtgcttactctttttgcccacttttacgtttcttgtggagtcttaactttgcacttcgtcatttgccctttctgcactgttttagcagggtgtttgccgaaaattgtgtgttcggtccccctttgggaattggcgaaacaagaacgagaagttcgtggcggcgaagggtttgccaaaggtgcgatgcccgtttcggcctgtttactgcgagatgataataaacggcaacagctacaaggttttgaaggttgccggctgaatgcgggcgcaccccgggagaaccctggaagactacgaccgtatccatacagaacgtctggaggacatggttcgcttttggcgaaaccatcagaaaacagatcgtcaggaggcgatctcccaatgtcgttatagtctagtctgtgtttcgcccccttccctcttagggtcgtgtataatattagtagtgatgacgaacctgattcgccaaatcattccttagggagtgaggattgttgtgggggcgaatgtgtaatttatctgtaagctaggctgtaaagccgttgctttctttgtctataccatgttgtaagacttgtattcttcgattgttttttcgaagttgataaagatgtgttttacttccttttcgctattctttgcattgtcacttttcgtgctttcgttaggtcggaacgtgttggcccatttgcgtatattagcgaaataggtctgctgacttttcagctttcggcttccgttttcgatctgtagtattctgcgctgataggagcgcttgtgttttcatattgatcgagtgtaacggtgttcggttagttgtttcccgaaacaagtcgtcggagtacgtcacccaaggttgtttcgacaggctcggattaaagggtgaatgccggtgtccattcggccacgaagtcagctaggacttcagacttgatggcagtgcgggcgaggaaatgtaggttgaagggagataactccgccacccacttgctgagccggctagtaatttccttgccccggagctcttagcccaaaggatactgtgatggcactgtaactttgtgggcttgaaagtagtgtttaagctcgcgcgaagccatcactagggcgtaagcaagcttctccatttcaatgtatcgtatcttcgccccttgcaaggcttcggagacaaaatacactggtttctggcctgactctgtttcttggacgagggccgcactgaccgccaccggcgaggctgctaggtagagtagcagttcgcttcctagtgctgggctgaccaaagcaggtggactctgcagatattgcttcaactcgtcgaacgctgcttggcattcgggtgtccaggtaaacttttccgcgccccggagagtcttgaagaaacgcaagcctctttcggccgcttttgagaggaatcgactgagtgccgcaattcggcccgcgagcttttgtatttcgcgtacgctcgacgggggcttcatttgctgaatggcatcaattttctcggggttcgcctcgatatccctttcagaaacgagaaaacccaacaaattgcccatgcgaacaccaaaaacacacttctcaggatttagtttcatacccgccgcgcgtaagttgtcgaaggtcccctgtaagtcggacgcatggtcgaaagccttgtggcttttcgcaacgatgtcatcaacataagcctccacatttcaccccaactgcttgtaaatgaccttgtacactagcctagcgaaggttgcctcggcgttcctcaggccgaaaggcatcctgaggtagcaaaaggtgtcgaatggtgtgatgaaggctgtcttagagatgtcggctggattcatgtggatctggtggtagccggagtacgcatccaaaaagctcatgagttcgcagctagttgtcgaatccacgagctagtcgatccgcggtagggggaaatggtcttttgggcacgccttgttaagttctgtgaaattgacacacatgcgccctttgccgtttgatttccgcaccagtatcgaattcgccaaccactcggggtgatcgatctcctggatcaccccagatttgagcagcttttgcacttcggctttcgctgcttcttggcgattagcagacatcttgcgcagcttctatttccttggcttggcattcggcctgaccgccagatgatgcatgatgagatatggcgaaacacctaccacctcgtcggggccccaggcgcagatatcaatgtttttcttgagcacctccaggatgttctcaacttctctttcgcccatgtcgcccccagcgatacaagtcttgtgggattggcatcatcgacctgcaccttgatcaccctgccatgaggggcgcgcttcggcgtgtgcttcgcccggtcatgcggttcggcctcatcattgtggactgctctgttgattacggccaaatcgccctttgatgtagccgaaggttgaagcccattgaccacgatcactcttgcagggccaggcatcttgagcttgagataattgtggcgggagatggcttcgaacttgttcaaggttgcgcgactgaagatggcattatagttgtatgggatgtcgacaacgtcaaacagtatttgctctttgcgcctcttttcacttgtgccgaaggctaccaccaattgtacttggcctaggacttgaactgcttctccgtcaaaaccgcgaagcgaggccggtgcttgggtgagggctagggttggcatccccatcctggcatatgcttcggcgaagatgacgtcggtcgaacttcctccgtcgactatgattcgccggacttcgaagccaactacctcggccgagatcaccagggggtcttgatgcgggaacagcactccttcggcatattttggcccgaaggaaatctactgattcaagtatcacggggcctcttcgcttgccgaagtgatgttgtgcgccattcgcagctgcatcttcttttgctgttttgacagttgattcggcgggtcaacctttgtaatcacttggattactctgcgctgcacatcttggcgctgttcggccgggggtgcttgctcttgaacagcttcgtgaggtgcttcaacagctactccttgttgcggttttggatcttgcgcgttgccatgctgtcgaatgtttcggcattgatcggtggtgtgcgaacagcgtccatggaaggcgcagtaaaggtcttttctgaccttcttgcgaacgggctgttgatggctacttgcttgctgggcgtcgaactccttgcggagggcttgaacttcttcaacaaccatcacggccttgcgtggatggtcggttctgaatttcctccaagtcatgggagcttgacctggccttggcggttgtcacaccccaaagttctcctcccaagcctaaaatttaatttataaatgaccctaagaaaatgcaggtgcaaatcaagagaaaaccctaagaaggtaatgcaaataataatcagatttgacatgtggaatttttcttgagttctacatgtcgaaattcattaacaggatttttagtggaattttcagagctctagaaataattttaaccaattaaaattgagcaagcaatattttaattccagggaaaatccttttttttcctttttctttttcttttttcctctctttttcctcctttttttcgaatgggccgtcggcccattctctcctttccttccccctcctccttgctaggccggccgcaggccgaggcccagccaggccgtcccgccgccctcctctccggggtcaccgacaggtggggcccacctgtcgggtccttcccccacctcccgccgatctcgctcgcgccgccgcgcccgcaaccgccgccgcacccacgtctccgcctcctccgggccacgtcgaccacgcccgcgcgtgcgccgcgtctcccgcgcccactcctctctctctcccgctcgcgcccgcgcccgagatggccgggattcgattttcgaatcccgcctctctctcctccgccaccccccacgtcggccggcgattcccgcctctcccggccacgtccggtcccctctccccctatttaagcatcgccgtcgtcccctctcactttttccccattccgccgtactctctcgagcctcccatcgctcccgcgccgtgcaaccctttgccgccgccttttccgctactccggccgccgctagccgccgttagggtcgccgccaggccgcgccgtcgccgccgtcgggttcgcgtggccgagatccaccccgtccacccctcctccgtcgaggttcgtcgccggagccctcgttccctcgcactcgggtgagcaccacctccaccgccgccttcggccatggtttccggttgccgtggtccatcttcctctctctaatccctctcttctccttccttagggcaccccgaagctcgtccgcccgccgacgtcgtcctcccgtggcttgccgtcgctgttcgccatcgtcttcctccgcgccggccaccctcggtgaggcacccccctcccctcttttcccctccctctccctcctagccgccgctttagcgccgccgccggttagtcgtcgctttagcatcaccgcccttcggcgccgcctttgcgtcgccgtctccgccgccggatgccgtcgccggcaacgcgacgcgcgcgtgccaccgccgtcagccccgggtcggccggtcggctttgatgccgagccgagcccggcggctgcctccaccgccgcccgtccgatcggcccgagggcgatctgggccgtcggtcccgtggaccggcggtggaccacccgcgtggtcctggtccacggtgaaccgctcctcctgagccgctgaccggtggggcccgcttgccggcgccgcacccccctctgtgctgacgtcagccctgggatttattgcgcaataaatgatttaaggtttttcttgtatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccgtttcttccgacgctcccgtgtacttcgaaatagtcgccgaggtttctccagcagcagagcaaggcaagtcatgcttgtcacttgaacatgttgatcctatattgcaaatgctctattgttttctttcaaatattgcattgttttataatattactatgggatggttacctatggttaccagttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttctgatatgtcgtggtggcatgtgggcgcacggaaacgtgtcgtggggctgtgtcttgtgggtacagttgtacagctctgatcagagtaaaactattcgaatagccgtgcccgcggttacgggcggtcaaccagattcaccgtgattagtctcaccttagtgtaatcttttgaatttggataatttaggtggatggttgggcctgtcgcaacgtgggttagcgctggacagaggatgtttaattaataattacaactgtttgaatctttcagcttctgtttataaatgctcgctttatgcaaatgaacctgcttagctatcccttgttgaatccttgcatcatacccctattcctgtatgacttgctgagtaatattgacaaataaaagttccacaagatgctatcgaacaagtggttttttcttccccttttaccatcactattagcctacccttaactatactccattgcaccacacataaagtgtatttttgcatatattattctaagtgtgaaatggacttttcacatagtttatgggagactaacggtgatacaatgaaaggtaggggtgaaaatggatcggattatatccgatctgatccgttccaaatccgtcctaaacgaggatggtatggaattttagaaatcggcggatatggatgcgaatgcggatagtaaggtgcggattctgattcggatgtggtatctctaaaaaccgataaatgcggattatctggtatttctatcggattatcccataggtcgtttgccggataatccgaaaatatcaacccatgtaaccactctatctgggcatataacatgagtcggcccatccaatgacctaatttatcaattaacctaaacttccttgtttgaggcttttgccgtctcatcttacacttaagtttatgaaaggtcgtttaatgattattgtattgctgtcccttgcattgataactcaatgttgtattgattgtataaacatctaacatctgataaatttaatttgtttcccgaaccgagtctgcaccgactccgcaccatttccaacatccgaaacaatccgctctgcatgcgcacatatccgcacccgcttcgaatctgcttaaaaaatggtttagaatatggttgttgatgtgaaaacacggtggcctgggagatttgcttaactccagtgcaggtccaaaggttgatgagatgcgggtgtgccaatcagtttgatcctgcaactcacaagatatacaatagcagatcaaatagccgatcggctgataagctgatggagtagttccagtcgatgccgatactagccgatgtcaatagggttttgatcaaacggctatatgtccaatgtagataacgatataaagacaatcggctgatggtaatgtaatccagtagaaaccaatcggctaataatgatatgagagcataaacactaatccgaaggttaaagcttacatcggctgaaagtccgatgtcattaaatccaaacgattagataaacaatgaaacctttattgcgatcggctaaaaccaacttgtatgtaatccttgtaagccgatgcaacgcccatgtaactcattggctgaaaccccgatgaaacccttattagcaatcaagaagcaggctagagatcatggttctaaatacgacttagtagatcgaatgtactaatgcatcactaagtatgaaaagaaacacaatatctagacaatcaagcttttgactaatttttagggtggtggataccttagctaatccaatctagtaaatcgatttagccgataccggcataaacccttaagcgagaatcagctgatatgactaaatcgatatactaaaactagattaactaagatatatgataaataggtaggcaaaaatatcaaccgaaccagagcgatccaagaggtcgaagcgatgcagccttgaacaacaccattatagccgatacaattgccaggactggcggaacgtaggactacccccttcgccgaagatcgaaagccgatgcaaccccgcgtcaagtgctaaggtttcgccggatgataaataaaaacctcgggaaagagggtggctatacgccaagagtagctgtattgatctatgagataaattaaaattaccacatatgtacatatttatacccatgggtagatactagtccttgttggacaagaaagaaacttttcgaaagataaaaagaaaacataaaatccttatgggacactaaacacactttcctaaagataaaaggaaacacaaactcttcctaattaatagataaactgccatgccacatcttccttgaacacggtctcttctagataagctttctttaattgattaattttcttaatctgattactagcgacttgatgactctcatcggctgattccagaactctgaagccaatactaactctaggccgatcaggacttcggggcttaccaaatttcactgttaacaatggtgtgaccactatccgtccgaatccgatccgtttccacccctaacgacaggatgtcgttttagattagtggtactaggttataatattctaggaaagagggagttatatttacatatattaatgatttaagatttgatggtttaactgtacacattttaaaatgtcatatatattcgagaagctagtagatagtaatgctttgttctgcatctgaccgtatgtgtctgttgtgatgaaatgactacaaatcgggtgcccgatttttcctaaaaatcaggcattattttaccccttatgaaagagtgtttcagcactaagtgaaagaatgttttagttcttgaaaaaagtgaaacgcaatcggatcgccagatgaaacaatttggttcaataaataaaactaatgatttaaagccattgaaagatcaacaagttccgagtgaaatcgaagacaaaaattgaaacaccataaaaaaatccaagtgaaacactttgatctgactaatgaaacaaccatatacatagaatgaaaacattgaaacaatcacccgaaaaaagaccagctaaatccacttcaggttagccggatcatcgacggtagatgctgcccaagccacggaggagacgtggctaatgatggcgtgcagctgccgaagatgatgatttggctgatgatgccctacaaaccaccaccaccacccactcctacagccactcaggacatagccattgccgccgttgttgcatagactcagctaagtctacattgccgccactgcagctgcctgccaccgtcacccctattagccaccgccttgtcctgccgatatcttgccttatgtttctgcctgtcactaccttgcctccacctttgcctcctcacagatcaaaggggatagagaggagagaaatggtgaagagagagataaaggaggggaatagatgagaccgagagagaaaggagggatgtggggcgcagggcgcccgatattttccttcccaccaggcacccgagccaaatgctaccatatataactttcaatctagttagtaatagttagtaatgaaagagaattaccatttctaatatatacaccctctggaaagtcctccgggattgccccttctatccgcaatatatttgttatttgaccaatttcttcaactggtgcaaaattactctgcatggatatatagatccaccacatacgtaagttattagcaatggaaattgaactgattctccaatttagttttagaggaaaattgtttctccaagggaaattaatgtatttctctccaattcattgcttagaccccaaaataagtgctacttgctcttctaacttgtttagcataaatcaatgcttgagaaggaaacaactatgatgtatgataggaggatgcatgattaggagtaggatgggacaaagttttgaatataacatgtacttcctccgtttcatattataagactttctagcattgcccatatttatatatatgttaatgaatctagacatatatgtgttcctagatttattaacatctatatgaatatgagcaatgctaaaaaatcttataacctgaaacggaggtagtagtacttagaagaatactcttttcagacaaatttttaatcctaaaaagcattcatttttacaggacggaagaaaatttatattataggaagttcaaagcaataaattgctgctgcattttgtgtaacgtatatgcaatcatgcttgcctgccctacctcggtgggacgtaaagattgatgactgaatgtgaagatagagtccacaaacgcatccagcaatttcttggaagcactgcttcctgcagcagatgcctccctaagtttggttttcaatacttgctgaagctccttgaaacgaggtggctgtatgtatcaaatgaacgtattaaaatggaatcatatgatcatctcattgtacatatgcaatgcaacagtaaaatatacatttttttttggcccaaacagtaaaatatacaatctcaatctcgttgttgcatgcttatagcagtagagctagctagctctggaataattgatcagttcagttgttatatgcagagagacagaaaggagactagagaggctaactacggagggaggtgtggtttagtactgtgcgtacgatgtgcgcagaggaatcatgagtcgccaaaggcttagtcctggtgatcttggctggccttcctccggtgctgcacaggcgtggttgaagagagaagccatacatatgcatggatgctatggtcgccattgttgcaagcttgttgctcctaacaactcctccttttataaggctattccaagagatagatatagtactcgccttctgtcccagtatgacgttgttgactttcacgtaatgtttaaccattcattttatttaaaaagttatataaatattatttattttattatgacttattttatcaccaaaaaaactaaaatcctagcctgtacttttacatatttatactacatttataataaaacgaatagtcaaatgctatgcgaaaagtgaacgatgtgatctattttagctgggttttcgcaacagaacaaggacaatcctccaacataaggattctgacatattcacgtgtaaaaatatctagatatttatccaccctaagcttgggtatgttattattgcatatttattaattagagatgcatactactactccctccgttgtttataaccgatagtttggatagttccaaaatataagtattcgtggattgtttgggcgtttagcagagataagaaaaaagaactttgatatccttcattaaataagactttattaggttagattggtaattctatatattaaaaaataaaaagagaggtgattgattacacgggtataaagtaatacgaatagcacttaaattacttagatttcggtacaaatttcaattgttagaaccatttatattgtataaccgaccaagcaagcatattatattcaaaatagtggtactatagtacttcctctgttagtagaattacgtgaacaatgctataaagttttataatataaaacgttccatctccactctactcacatgaactacaataggcctagctaacaggtaccactggaccaagcagattgattggctcaacgaaattgccacgtgaatttttgtaccgtctggacgatgctttcaccaactttcactggccatctctctcactcaagagtcacggtcggcacatgctagaggccgagatcctggctaggagtctgtttcaggagttttttccaaacagtttaattaacttttcattcagattttgagaagctataattatagaattcagaaaattaattagaaaatataattaagttgagaaacttagtttctcagaagctgactaccaaccggctgtttcttaaaactttaaactacccaaacataccgtacgaccgaccaaggtttgaaatttcagtaatttcgaccccatcggcaaacacaaatctccccaaaagttccatttttttatcaaatatttctaaatctgttcaaattcagtcaaaatacgttacaaattcaaatcacttcggtctgaaaaatccagaaatcacgacatttccaaatttcggtaaccaccgaaatttcggtggggaccaaaattgaaaccttgagagtgacccggcctgacttgcgcacggggtaacatcgtcggatcgaacgacacgccaccacacaggatggataagctagcgtgcggcggcctcaaatatcatccgcgtcaacgtcgtcctcttcctcttcctcttcctctcggtgcctcaaatttcttccgcgactctcattagtcctcggatgccggccggtgtcgatcgatcggcaagctatagatagacagatgtggcacggtcgatcgacaagcaagcgggcgtcgctgtcgggctcgtgtcttttgtcacctggtaatattgtaccgatcgacgatcgagcttgctgccgaagtcgatgggcatttgaggggacgctctcttgtctccttgctctctctctctctcattccatgtacagggtaaacgatgaattggatggacactaatagttgccttatcgtacagcttccactgatgcagcttgatcctctgacctttctcctcacttaattaatgggtctgtctcctaaaataagtaataacaatttgtagagttaggtacagacattaaggaaatagttggaattaaatataggagaatatcgtgattttctattaaagaagacacggcaaaggaggtccccgttgttattgcatgctttatttaatatataaagaaaaatgtaattacaatagaaatattaaaaaacactgatccaatacatggctacatctttatctctctctctctctctgctagcttgaaaaggagtagaagatctccttttaagagacacctccaagacgacatggaaactggcttgctttcaaaaataaaaccatttctcactttccaaacttttcaagtcaccattaaaattttctcgataaagcatctttctcggtagcgaagatagacaccaaacattatattctccaaattgtctgatgttttccagaaaatcctaacaacggcccagcaaatcttgaaaaggggcactcaaaatttagatgcaacatggtctccacaattccatgtccacataaaacacacccgcggtcacaatcaggaggtgcatattttttatgatctagcatgtatcttttattcagtggatcctttaatgaaagccagccaaaagcttttatgttagacatacatttactcttcaagattcaacagcaaaaccatccacaacttatggatgtgcacaactcatgttctcactcgcaaaaaaggactagttcacagctacacatcttcaaagagaagattaattatgtacatgaacactacacgcattcagaagagaagaacaaagaaacatacaagagctcctggccgccgcgcacacgccgcggcgctgttcgtctccgccgtcgcgcggactgggcccggcgttcctcccttgagccgaggacgagtacgccgactccgacggtgacccggccgcctctcacccgtcggcggcagccgcctcccacccgctgccgacgccgtcgacggagaggggaaggggaggtggggaagagaggggaggtcgctgccgccgctcgccaccccaatactacataaacgatttttgtgtacgagacccttggtaggttgcaaacggaccataacttacagcatctggaaaaatcgagcggcattttcgcatatggctccttaagacgcctgtatggaaaaatttacatacgggcatcttaaggagccgtatgcgaaaatcgatttttccacaacaaaggtttctctttttaatctttgactaaaacttgtaactagtgtttttccctcatactaacttcaaatgtgttgattctttcctaaatgtttctaaaatcatgctctattatgttattgtgttcctactgctattagtttggccaacttttcatgtgactttgttttatcaattaaaaatttgaatttcaaaaaatggcaacttcaaataatattttgatgcagtaaatattttcagctgaaaaagtcatgaacataaaagttgtagaactcaattttttaaaaaaaagttgtagaactcatcaagatatacaacttttcttttagtcattttttcatccgataaagtgatagtaacattgttcacacaatttacatatctctcttacagtttataaaaccatatgagagatatgtgaaattcgtgaacaacattacttatctttttgttgatgaagaaatgataaaagtaaaagttatagatcttagtgagttatacaactttttcagttgaaatcatttagtttttgaaaattttgtttgaagttgtcatattttgatgtttaaattcaaactgttcaaacaaaatcatgtagaaaaatgattagaacaaaagttgtagatctttatgcgtttcacaaatttgttgttgacaatttttccagttgaaatcatttactaccataaaattatttgaatttcttatattttaaaatttaaattttatgtagttaaatcaaactcagatagagaaatgacgaaaataaaattggtagatctcaacaagttccacaactttgtttttgacaacgttttcacatgagtttatttagtatcacaaaattcgatttgaaattctcatattttcgcatgtggccccttaagaggtccgtatgcaaaaatagatttttgcatgcggacttcttaagtggttccatgcaaaaataccaccccttcacatatttttttcatctccctccactcttttttccctcccaccacttcaatttttttcaacccatctcctctctctctcccctcacctctcctactattatttactttcctctctctctctttttctctccctttctctcctctcccctctctctctctcttctctcctctccctctcagagcgggcacaggcggcctggagtaggggtggtgatggcgtcggtgggcggtggatccggcagcgctgccctagggagcggctgcagctgcggcggcgacagcgagcggcggatccggcggagcggagtattttctcacgtgggtcactaaagaggcccgtatatgaaaataggtttattttcagatgcaggctttttaagaggcccacatgtgaaaattcatttgcatgttaaggttacagttcgcgcctgcaacctacagggtcttcgtcccgaaaaatcttttctatagtagtgtcctccctccattgtttatagcaaatagtttggatagttctaaaatataagcatttgtaatttgtttaactgtttagctgagataaggttaaggataaaagattttgatgtctttcattaaacaagagattgttagtacaaatttcaattgttagatgtattcatattttagaactgagagagtgtatgtttgaattatataatagagccggccgcttccatctccacttaattcacataaactacattaggcctaataggtaccctgcagattgattgcctcaataaattgccagtgaagttacgaaaagtgggtccagataggacaataattgaccctgcagattgacaggctagtgaattattgtcctgtctggacccacttttcgtcacttcactggcgattttttatttcaaatattaataaaacagtatttttaattaccatacaatatttattttgtgaaattgtgcgttttatcatgctaatataattcacgtgacatttgattaatgtcacttcagtttgaattaatgacgtactccctccggttccataattcctgacattttggacaaggttgatgtcaaacttttgcaactttaattatcaataactttagaactattaagtttaaaggaactagaacaacatatatagattcgtctttcaaaataatgtaagaaaagtaaacatgcatttatttattgtatatattattttaggaaaacaaaatgaaatacatattttgaagaccgtgtcattatccaaaacgtcaagaattatggaaccggagggagtagcaaattctggtcaagttggcaagaatctacctatgtagtatagcattactccctccatcccaagatgtagcaatctaggatgggtgactatgaatctggacataagtcttaggacagaggttgctacattttcggacagatgcagtattaaactaggtgaaaccctacgtggtactgtgggagtttactatatgataacaataagtaattataatgtgtaaaataacttaaacaacataagtttatataaacataagtttatataaattgatgtaatttaaatttaaatagtatatacaatgatgactcaaatataaaagtaagatggtgtggccttatgagagaataaaagaaggaagataatttagactatacatataagggctaaaaaagttgagatgatatggcttaatgagagaagaaaaggatagagataatttgaaccacggattaatcgcataagcacaattcatctgatacgacttaacgagagaaaagaaaaatataatgacctaagtgaggatgaactatacataggtatatagtgtattataaaaaaatgatggagagatatattgaaatattatgtaaattatgtgggatgatttaacattattacattttaaatctttaaaatttaataaattattaaattatagataatatagcatgtttgcatgatacttaaatgtaatacttgttagtagatgatgatgtggtatttttacactttagaaattagtgtactttaactttatatatagtatatagtaagagaggattggttgttgtccacaccagtttaattggtgtggtaacctcgtgcaacaatgctaaactttatggcgtgacgacttcgtcgtgcatgcatgcatgtatttgtagacaatgtatatgtttactagatgaataccccattgtgttgctgcggagaattaagttgcataatatatacaaataaaatataatttgattatcaaaacgaaaacaatttgatataattttgagcctgaaaataaatgagattgcatgttttatgagagaagaaagaatagacaatttagaccatagatcttttatccaaaggctagaaataattgaggtggtgtggtttaataagagaagagagaaatatcatgaactacatttagtggggatgaactatataagtatatataagtatatatatatatatgattaccttggttattctaatttgcaaagaagaaccttgctttcacataattaacaacaatttgtcataatataattatttagataactttcaatatatgtactgtttttggtaaaaatatactgatatgtctttatatatagttgagttcgatataatgctgaatgttattggtgctcgtctatgttgacaccccgttcatgttgaataccacgttgattatattgcgtggatttttttttggtataggtgctcgtctatgttgacactccattcgtgttggcgtgacattagttaaataccatgttaattatattgcgtggattttttagagaagaatattttttacccgatcggatatatgcaatcttttaaattgggacttagcttctcaaacaatctaatctgaaattcgctcctataaagatgtgaagtcagtactactcaagtcactacaattaataggctatatgtccttttgctatattgcgtggatatgaggttccgttttgaaaatagaattttatatggtctgtcaataatatattattttagaaatgttgagaaaacaaagcgaaattcttcacaggctttttttgtcactgatcgatccagtagctgtcggtgggcggtggctacggctggtggccagttactatgatcctgattgaccatgagcaaatcgtgcaacacgcgtagggtaacgagagacgctagctccgcagcctcatcatcccccctctccatcgtgcgccacggatgtgtgctgctctgctcgggatcttcatctaccgtgtgcgggcgtagctaggtggtagtttcctgatatactcgaaactactcgctccgtttcacaatgtaaaattttctagcattacctacatatatatagatgttaataaatctaaacacatacacatatctaagattcattaacatctaaatggatacagacaatgctagaaagttttatagtgtgaaacggaggaagtaccaccgattttggcccaaggacccctacctcctaaattctgtctcaagagtaagcacaagaaatgaaaagaagccagcccaagaaagagaaagagaaaacatagcagaagccctaggctgatcggctgggacgcgaccctccactccttgcacgcccgtgagagagccgcaccaccactattctctggctctcgcctctctccactcctcacctcgccgcgccgccgttttcctgtatcgatttgcagagggtagaggagggcagacgggcgacgtggcataggcaaggaacttgctccccgcccagcgcccagctggcttccccctcatggtgccatggcgcccccaccggccccctgaggccctacttgatatctctctctaccaagtcctatcatcctatgctgtctggttgtttgttgttcgatcttggagcgtgcaatggaggaaaattttgatcttggaagagtgaaacaaaacaatgtagtttagctctgagtaatctgcgttcttgggttggtacaactggagaaggttcaaattttctcaacatatagaagatcatgtcttgattaattaccgatattcttcatcgctaacaggcctagtagtccggcctgattgagatataggatgtaatctcaatcgggcctaagggagagcccgacactgatgaatgtcatcggtgatgggctataggtatatacacctctattatgtctatataagtacatctacaacgatgttaatttaggcccgattgagatggcttcattttaacggcccatgttgcctaggcatatgagcggatttgtactagtggctcattttgcttcacttgttctgtgtggagatcagattctatcaacctaatcagctgtttgagagcaacagagctgagcgggagcaccatcagcatgaccgaaaaccagctactcaccttgattaggccaaacctggttcatctaatttgtcacattggaaaatatatggatcgtctgaaataaatgttactcatgtttctttatttgtaccatattctcaacgtattactacttgtatatatcattttaggtgtttgaaaattttgatgtgtaatatgaacttgtgaagtaggactacctatcgaaaaatttctaactacaccagccactctggctcattccggttctggcagcatgctaacctagctagcttagggcaccagcaatgtacaaggagagagagagagggggggggggacattggccatcacggacgggaatggagccaacgacgggggttgcggcagcatgtgcggtcatatgtggcagcatcgacggtgatcgttggttgatctcgcggcggcaacagtgatagcagttgcgaacgcgcgcacgggcgaattcgacggcggtcctggctggatctctggcggtgtcggcgacggtcgaggttggatgcagcgtcagcgatggtggtcgcgggcagatcccgcgacggtgcgaacgagcggatccagcggcggtcgtgggcagatcttcgacggtcgcgggtggatctccggttgcggagatggcagtcgcagggggatttctagtgatatccatgcaggtgcacccatgctctctcactctcccacggcggactacttgctgcttctcctcccttacgggggcaaccaaaagatttggagagagacaaagttggagcagagaagattgaattttttattctttatgagtggtccttttgtataatgcttacttaagtaaagaatagctataaggatcatctccacatacaacgtataagtagatatcataagcataatgccctttccgattttcatattgtggatgccctaactattgagttcggtgtgcgtcgtcctcaggcgtacgtgcgtgccgctgtcgggctcgtgccgcgtcacccggtaatgtgtgacactgatgagttagccgccgaagacgtacgactcgatcgatcgacactgagcggacactctcttgtccccttgtctccttgttctctcctgcacgcggaaacaatgatgaattggatggactataatagtagccgtacaatgttttaattatagtactttgtctaatgcagcttgatacttcgtggtggtactatatatccgttttaaaatatggcaatacagtatcagatggaacatatctcactaatataaataatatggcaatacagtatcagatggaacatatctcactaatataaattttggacagaccctttgtacagattaataatactaggatgcatctcatccgatgctatattgctatattttggaccgatgtagttcaatcaaagcatgcatctaaactattttacgattagaaaaatatctgaattacccactgaactatcacgacattatgaattgtcctctaaatcccaaaatcagacttttaaaccccgaactatttataccagacaaaataacccccgcgaatcaatccgatgcagttttgtcctacattacgtacgtacgcgtggcaatccagttagcatttttctttttaaaaataagtggggtggagcagttagactctcacctctctctttactctcttccccgaccattaacgacattgacgacggcgccgtcgtcgccactccctcttcctttcttcctcgctatcgaccacggtaggtgacggcattagcaggggagaggtgcttgcctgtttccgccgtgtcggtgatatgggcccgggggtacctatgctgaggggaagggatcctttcccgtcagccacgtggccgcgtggcccaggccccacatcggggggttggacgcacggacggtgaatagcccaggagcgtccgcgctcccccagggggctcggggtatctcgccatatccctcggccccgaggggctgccttacctcgaggccctcgctcggcgccacgtggtgaccgcgagggggatcgagcaggcgggaacgcggggactgccaggcgcatttatgggcagcgccccaaccgcccaccggaagacgtgcgtcaagcagccttgaccggtctgcgaccggcgtgcgatcggtgacagacggatgtgacaggcggcagcgcacccacgccctaccctgtatcaggcgacgtgggggcaggtataccccgtcccatcgacagcaggggatcgacgtgcaggtcggtgcaccccacgcgcgtgaacccacgaagtctccaaaaatgtatgagggaatgataggggatgtcccccgtgtcaggcgaaggacttcgctagggaccacctgaggacgagcgcacacttcacttccggccaaaggattgggaagctgttcaacccagaccgatgtgggcccctctccaaggtagggaccgtagcggcggtgtatgtggtatctccttgaactataaatggaggaccttgcccagcgagcaaaggacgactcttaagaactctagctctaggaagagactagaaaaaccctagttgttttccctgagatttggattccttgtaacttctcgaagatcaacccatatataggagtagggtattacgcttcatagcaacccaaacctggataatctctcgtccccgtctggattaccatccactttgcgagcttagccccgagcgaatccgattcgctaagtagagatagcgctcctgatcatcacgcctaatcctctggccgaactcacaaagggggggtctcacgtcctcccgctagagatggtcactcctcgacagctggcgcgcaaggtaggggaaatcccgcgcgtttgtgaaggagccgtttttcttccgccccaagtttccttccatcctcaacgaccatggtcgaggtagtggaggaagaagtggtggtgtacactcccactccgtccggaagtgaggacggtagcgggagtcgtaatccccgccaccaccgccgggactctccgacccctcctcgcgaagccccagacggcggaaggaccccaaccggttaggaggttcggccctttccctgccggctgatgggggaagggcgcgccgcgccggggtacaccgccgcctcacctacgacgacggcggcacgccccaaggcgcgctccaggccgtggaggctctcctacggcaccctcccgtcgttctagagccgaagaccccggtccagcggtggctggatgatgtggccaacttggtcgtagccgcacagcggcagctggccactaacggctggcccttaactgctggtacctcacgtacctctactgccctctcctcatcggcgaggaggagggcttgtcggtcagccatgatctcacggcgatcgacaaccccgacgtcgtcgaggccctcgaaaagccgagggcgttacgatagtctttacggggaacaggacgcccgaatcaacatcaagcgtcacagggatgagcgccgcgctccctgcgcgggggaaggcgcctccttatcaggagtgtcgcgccaccccgcgcgaggcggccggccccccacgcccccgtccggtggggctgggtgcaaggcctttgtggcgagtctccgaaacgtccggtggcccccgaagttccgccccaacctcaccgaggagggaggaggagggaggcaaagtagacttcgtgggccgagggcgtgggccgagggagagaggacagcccgaaaggaaggaggaaaggagggagggggaaacaagccaaggagagagagggagggatttgggccggtaggggcccaaaggaaggaggggaaatttaattggtttttcatttaatttaattgattaattgaattttgtgactttaaaaatttacttcttgagctccgaaaattcacgggaaatttcagagaatatattagggcacagagaatattacaaaaatatttccggccatgatttttaaggaaatttttttaattcccttaataattcacttgattaaattactttaacttttatttaacttctagaaaatgtactattaattgatttgtaatgccgaacgaaaatcggggtgttataaggacttccctaaaaaggaaaacaactgcggcaccgttctaggaaaggaaaggaaacggtcccgcgaacaaaaacggacacggttgatcatgcaaaatgaaaccgcggactgagaaggcagtgaattgggcacaattcatgaccaaaggcaaaaggaagaattattattaatgtgatcttgacatttttaaacttagcaacattacctccggtgctctatgaattccgctttaagtccggttagtcatttttagagcaaatagaatttgaaaaaaaatttcctctggcaattccgattattaaatatattgttaattagggttttctcctggttaaccaaagtaatttctatagactatttattagtgaattggaacctaaggaaagggaaaactctgggtgtgacattaacctgggaactagcttcacatgagtatgtgtttagagcatttgcgatgttgtagaactctagcttattttttcatgtctcttgagatgtgtaacctggtcgccaccttcgtgtggtttgacggttgactagcacgttgagtcctagtagtcctagtaatatctcctatgctctgtacttgaggcttcgggtttcataacgtgttagctttttgatttgatagggcatcgatgaagttggatggttaccattttatttagattttatcgagaccccatccaactaaatatttcacgatgtcatttgaaataagcttacataatatttaactcggggtgttatctatatttttttaaaaaaaatataatcatttcgttgaacaaaatgaggggatgttcattcgggtgattaaaagagtttgccattgttccaagtgctatcagccatcagtatcaggaaactcaggtggtcacgtacgacacaagggtttagaatcaacattcttgccccatgcatcaccagtgaagttgcttctgccatgccaagaccagttgactgataccttagtaacaacctaagtctgtgtggcctttaatcagtttaagaagcaaaaccaatttcaggcaagctagcatctgtcttgtgatagctaggtatgctcggcaatttacatccttaagctgtaactgtggtggtcttcgttttgtagttaattaagatttaagaacatacatcatgtagccttcacatgaagatttaagttgctgatcgaatcctacaaggcacatagagttaatttccaaatcctttttcctggcactgaaccggaagagctgctcctagctagcctcctagggctcatggaaaaaaagcgtgaaatttgcagttttgcactcgaacgacgtaagcattcaccacgctctgcacattattcctggcatttttcgtttctttatctaaggagtgtatctgtactttgcagagagtagtaatccaagaggctgtctcgttttatgtttaccactgcgttaaattgcattcgtttgaaatgctaatatgctaattaattaaaaacaaaagaacaacaaaaatatatagcgaaaaggagccgtaaggatgatagtgccgtcacgaattattgacttaaaataatcacagttgttgtatcttcgccggaccggctgaaagccggccagaatgtattaagacgcgggagcttacaattcttgtaccgtacatgtcacctcggcagtaaatatattatacaattcttatttatttcttgatatatgaatgttccatgaaaaccgtaggatactctttatgataatgttatctttaccaatttagtaaattgtgaaatctgtgcgcatcaaatatacttagggctcctttaaatcataggattgaaaaaatgtaggaacaaaaaaaaactcaggaatagtataggaaatcataggtaaaactaatggttgaaaaacatgggaaaattataggaacgatcgtttgattgatacaaaggaaaaacataggaatgttaagtattaagttaatagccatcaaaatttgaatggttttatgagggtaaacattgtctttcaatagtgttttgcctcgatcctactcataggaaaagaaaaatgagctcaaggtggatgttaattttcctatggaattcccttaaaatcatggtcataggaaattttcccatgcatttcctatattcaattcctacaaatcaaagggatgaacagtaccaaatcccataggattattgatcctatgtttttcctccattttttcctatgaatcgatggaggccttaatgtgctgaggccgtgggcgggtagcgcgctggctttgcttgcctgaatagcattgcgacgacgagcatgtgggcatgggtgcgaagcagcggcggcgagcgtggcggcgcgcagggcgtaggatgatcagatgacgctcggcccatgacatcgcgctgggatgacacgcgcgcagcgtgtgacgggcgcgcatggagcgcagctgcgctgccgtgtcgcgctttgcattggcgcgacgccgacgaagcgacgagctgcggagacgcgcgcgcgcgcggggcggcaggacagcgcgccgcgcggcgcggctccttgggaagacgtcgcgcgaggaaccaatcacagagcaggaatcatatcaccagtaaaaaaattattttc

SEQ ID NO: 32193 - DNA, 1691 bp, Oryza sativa
ttcttgtatgtagttcttgggatgaatgtgccatgaaagccatagggtactctttgtggcaatgttatcttagcaattggtccattttcaaatctctgagcatcaatgacatgtgcctgtaaagttaaagaatcacagtttaatcattaataatatatacccgctgatgggttataagttattcttttaattttcttatcaagctttccggtttgtgagttggtgtcgtcggttgtcaaatctgacacctatgaaggattgccaatcggcatttactaggggttttgtactggtgagtagggagtaaaaatgattatatatgggaataacatgcattgtaatgtaatgtcaagaatataaagaatgttgtaattaacatgctagttcgaatatcaaaagtaattttgaattttattttatctaattttctagacagaacagtcacgatagtttagcacatataatagaagaaagatgattctagagagctcgcctgtgaagtgtttatttcctcgtcatgtacaaaggaaattatccatccatcatcttcatttgctccattgacctttggaacaaaagttgctcccgagcaaaactgatttttaccaagatgatgatactccacatttattagatctccaccaaactatctcaagagttgcaaaccatgatgttataagatatttcaaaaaagaaagcagcaagacaaagacattgttttcttatatatatatatatatatactaccttgttgttatcttgaagatgtagttttgcgaaacctccaaattttggtcgcactacataaaacgaaagtaaagttagcacatgatgaatagttgaatatatccttcttggtcagtttttttaatatacccttagatatggtagatccgacatgatatgcaatatttaggttatgcggcagaaatgttattgtacattttcattatattttccttgttgaaattttttatcctaatcagcaaataaactgtttaacttaattttgtcagttcaacttagtgctgaatatatttaagacaaatgcaatctttgctgagaaaatacctgttccacagccaccttccaggctcccttggacatcaatcacttgtgcatatgcatacttgtgatgcaggccagcatatttgttattgatcactgggaattccagagcaacatctgtcccagttaagtatttacctgtgacagccctgcttttcatgtttaatctccactcatataagcgaggaaaagatttctcactgggtccttgattagctggctcttcattagccgtgtgctcaagtgttatgccagtaattatggaacccggcactcgaaatcctctgatgacaacctaataataaaaaattaaacaacgccaaattatattttgaaagtgtttgcacatttactctacatggatttgatcttgaccaaatcattcaaacacttcagcaatttgattgtttcttcactgagtgtgacaaaaaggctcttgatttttaatgtgtattatgataaaaaaaaacataccacaaccacttgtttactgacaaaatggcctctatgatctaatcatccaattcaaataactgctaatctcttggagcatacattttagtgtagcagttcaattgtgcaacacagcttcatgtcgataggggggatccactagggctaga

SEQ ID NO: 32194 - DNA, 2600 bp, Oryza sativa
acttctttccaattcctctatatgttactgtgagccaatccaccaagcagagaagcacaggggaagaagaaaatgaagagaagaggagtagaggtagatagtttggagagttgtgttcaatataaggttttcggttgaaattaggctagatgtatcaattttaaatacaattcaagtttaatagtgggcgcttcaaatttaaccttttgattggtaagatgaaacaaaacattgtaatctgggattgatctatcaagaaataagttttatgttctaaataaaagttgtaggtatcagtcatatttttctaatggcacttgtttcatttattttagatcggttatttgtaagtaattgctaaaattttgctaacatggtaagaaaactggtgcagcaatccttttatttcattttgataattataaacacataactaggtcatttgcataacatgaaagttgcaggtactcttctatagatgctccagatgtacttaatgttttcttttgtttaatggtataaaagcaattgctagaatagcgagcaagcaagggtttaggtagttcataaataaatttctatgttttggggttttaaaaattatatcaagaaattagtgtgttgtttatttactagcattgcagttttttttttaatttagatgcatgttatttcgttctttttgtttggaggattctgataccaagttaccactaaggttaaggcaagtgcacggtaactatttgtatatgatgcgtgaactagtttaatttaattgtttcacttttattatgttgtaattattcatgtgattacgtgtaatcttgaatttggtttcatcttatcaatcatgttatatattcatgtttcatgattctgctctttttttggtttaatatcaagtgccacgcatagccacggaactgtaatttggttctttattcatgacacctgagttacattgaacctaatactcaggttaaccagtaaatgctaaaatgatattcgcgtaaaataaaaatagtttccgactcgctcttttttataaattattccgtacacattttctagttccatataatcttgctgagtattttatactcatctttgtgctttatttggtttttaggtatcacgtgacaccagcatgcaaggacgggaatagcacccaacatcgatacacttatgcacatatgaaaattaaacttagtttgtaagattagattaacttggtttcattatatttggatagtttacttcatgtttatgttattatggttgttcctgatacttctaggatgttgttgatggtaccatattcattgatgctggtgtgtttaaatattcttataattgctatcgtgcgtgtctataaatataaatagaactttgccatggtttttaatcaattttagattttagactaaaaaagtttttatgtgtggtgttgatatctaacactccagatgaatagacatagggcataaggcagttaattaatcaaattctcttagttacttaagaaatcaaatgacccattcattcctatgatgtttcacaagtgcatttgaaccatttaagatataggtctatctaaatggaagtcatgcactctgaaggacgggactacagagtgcatgtgcactaattagtgttaaccacatatcatcctcacaaatgctaaagttaatatgtactctcttgctataaagttttggcgtaaaccgccacatcggatccaggggtgtaaagttttggcgtgtcacatcagatatacggacacacatttgaagtattaaacgtagtctaataacaaaacaaattagagaatccgtccgtaaaccgtgagacgaatttattaagcctaattaatccatcatcattagcaaatgtttactttagtaccacattgtcaaatcatggcgtaattaggattaaaagattcgtctcgcaatttacacgcaatctgtgtaattagttttttttgtttatatttaatactccattcatgtgtctaaacatttgatgtgacagagtgtaaaattttgtcaggggatttaaacaggacctctatgttccatattgatcatcataaatgttaaagtcaatttacatgcataaatgcagtaatactacatgtgaagtgaaggggccaaggttatatgatgatcaatttggaatttttgagttttggttatatgatgatcaatatggaatggatggaatatatctttcctacgcaggaatatacattcttgtaataaggaaacgattcctaacacctaaactaaaacaaaattttctcttaagttacttttgtaatatatgcaaattatttttatactttattgaatttacttctagatgtctaaaaagtaatttaatggagtctaaaagtaactagatatgttatataattaatttgtaatttttcatcaaaatataatcatgtgatatcttttataaagatttaattgcaacgaacacaacagtgtaatcggatcttagaaaaaattgaagcttatgtggtaggaatatatatatattttacttgcttgatgaagtagaacagtgcactagttaagctagatttcccggaa

SEQ ID NO: 32195 - DNA, 15138 bp, Oryza sativa
ataatttctatgagactattctctctgttctcaaatataaggatttctatattggttaacaaagattatgtttgatcatataaaactttatatccctttaccgaggaatgataggagtttagaaaaaagttgagagtaggataaaaaaaattgaatggaaagtgagattgaaggtaagttaatctataaatccttatatttttgaataaattataaatatttgtgatgcttatatttgcagatagagagtagctacctttatgcttttttgaagggattaaggagagggcaataaaattaaatgcgagggttgtgttttatttttatttttgatagaaagtgtgaaggttatggttgattgagataaagaagtatatgaagaaattaaaaagataatggttgtagttaattgagatgaaggaatatgtaaagtaggataaattttatatactgtcgctgcgggtgaatgagacgagctgctggtgttctccatctgaaactatctgtatatgcaccggtgtgcaccgatggatgcacaggagctattcatctggaactttcctgatgtgtgattggtatacacaaatggatccaacggtccaattttattcctcctctcatcctaaggctattattcttcacatgacgtggcttattggttttagaaagcttgttgctttcacatatgtagattactatattatgatatcatttaaatgatacaaaagcataataataattaaatacttttgaatacaaatctaataataaatataattgtatcattaaaattatatcgtaatagaataattgttggtcaaagcctatcgtaagaaacaaaatatgtcttttattttaaaacggcgagattaatactttagtattagcaattattacttaacattaattaaatatgggctagtagcttttggagaagttttatctgtcatggtatactattttttcagagaagggtaatttttacccggcctttatttccaaccggatatatgcagccttttaaatttggaacttatcccctcaaacaagccaatataaaattcactcttacaaagatttgaactcaggaccttagggtgttactcagggcactgcaatcacttggctacatcatggtatatgatggtcaatatgcttttttatatgtttggtgaactattgtaatatagaactagtgccaaattttgatatagataaaacaagaaaacatgtttttttgtttgaaaaacagttggtagtggcattgaacttacattttagtgaccccaatttcatggcaatatgtacatctttctagcttgagatcaaccttccgttcaagtttctttccatcctctacagaatgtgtttggcgtgatcaaatgtacttagtacttttttttggtaaaaggatatgcagaaaaagaattgagattgcagagctaccaaacctgagacaactccaatagttaggaagggcttcacaatgttaaacccatatatgactaactctcctgaccctggggctacctgcgcccatagaaaaattggatgcaataaggtaacatgaaatagaattaatgtacaaatcaaataattataattaagcatcccaacgtttcccatggtcactcatattcttagcacaagcatacattttatgctagatgttggcctaacatattaaatactccaagaactgctgaatttagcattaataaaatggtaaaaggtgacaaaactataagccagttctttaccatgtttgtcaaggtaggtcaatctgtgaatggcacttttcaagaaaaaacaagtgctgcactattgaccttttttccactagttgataagcttaaattatctctctaccttttttttcaaatttctttctctcctgctcttaagatagtaatgtgcttgtaaatttcatcaaaatggaagacaaacagatgttgagacttatagccaaaagcaacgcaaaacaaaactgaaaagagatagtagaaggcaagtcttctgtagaaaatgctggtgaatatggaacaattaaccaagaataaaacaaactgatacataatcttcatgtattcagattcacatgtttaagaggcagagaggcatatgcagagggaccaaccttggggtgtgctgtgaatggcatgttccactgaccatcgacgacccagctacacagtgtgccaagattgtccaagtcaatctcgtagggaatgtcattctctgccactgagaaaaccctctcggcgtgctcaaacacaccggtattactcatgtttctaaacaccttgccaaacctcagctacagcaagatatgcaattaatgatcagtgtcacttgaacactacgtaactacggtgccttagcatatgacactagaacagaagaaaatgctattatcaaatctttatgacccagagggtactatggttcactagagatgtgtggtagtggatcaagggcgaaaatcaaagaggacaaaattgaaattgtgaagttgcaaatgtttgtcaacatagaaaatactccgtgtttgtttttataagacctgtaattttttcaatcttcctgcaaaattgaagtcttgcaccatgagtttgttgaatatgttcaatgtttggacatggatattacatggcctctctcctgcatttatcagaagaatctcactaaccatgtcacttcagctatctataagaagtatgagaagcatggaagttttaactcatactccctgtggcatccctattttcaaaacagaaatcaacatttgaaaatatttttcttatgatgtcaactccgtccatacttgtttgtaatatattatgaaagaagccaatggtaaaactataatattgtataccgtgtagcaaactaatatgtattacttcctccgttctaaaatatgggatattcttgttttccataaagtcaacaattaaaattttgactaattattgagctaacaattaatatatctgtattgtgtcatgcatatagtgccattagatttgtatttgaatgtattttcatccgatgttaattttgttactattaataatatattataaacaaaattagtagttgaagaataagaataaggctggagaccgtgtaaaaggctgttacacataatattttcaaatagagggagtttctctttattgtaaactctatattcattctagctacttaaagtaataattatattttgatagagacaagagtagtaaaaagttccttgccgacaaaaacagagggtgcaagttatttacaaaccatgttcaaaatgctggctgcgattatggcaagagggtcacccttgattgctgagaggaagcatggtctctgacgatccctttcagtattaaaagtgtcagattgcacgtagcggttgttgtatgagactgaccaagtgtttccttctctgctcttggtgaagtagagggcatgcagcatgccttctccctcgacccagatgtcttcagactggccgaagattgagttcaccttgtgcaaggctccaaagagagggttggaacctgcattatattggttgagttttaatctattcagaactagagcaaattaagatcaaactttgcgaacctaataatagcattgtgaaaagtaatactgtgaactagcatctgagcacataactgacgtagcacaaaagtcaagagttaagggcttaaactacaatagttttcgctagcttgctagttgctaatgaaagattgaaagaaaattaccatttctgatataaacaccctcaggaaaatcatctgagatcgtcccttctatcctccatatctctgttcttccaccgatttcatcaactggtgcgaaattgctctgctcatggatagatccatcatataaattagcacttgcaattcagccatttttccgatagtccaaactacaccccttaactattggatttgtctaataatataagaaacatccattaactacaaaatcagatattttataacccctaggccttcaactattaaaacaagtcaaaattcaaccataaatgtaatgatattatacacccagttttagtagcggttttcatgattttcacaacaaaatatatattttttgacttatattaaaccactttctacctatctgtctaacttggtttttttatcgtactatttggatttcaaatcatgaatattaccattaaaatcaggttgtattctatttcatccggttatggtaatggaaagctgtaaaatatctatttttttagttgatgggtggttttctaagaaacagggagttcaaaagcatgtgatgaaaattaattggaatctgaagtgttctcccctctactatacctctaaattaaaaaaaaaaggttcaaaacaatttaatattatgatttcttttttcaggcggtgctcttcagcagccatcagcgaaaattggtttccatcgatgggaatataacaaacatgcttgtaaaaatagccctatatttataagtagaccccttaagtgacagccggcgataatcgattttcattggcggtaccactactgcagatttgattttttttctatacaaaacccacaataggttgtaggcagcccataagtgctcccgcatgcaaaaaccactctcgtgggggcgattgatgggcagcatgggataatccagatactgtgattatacgacaattccacaacacccccattctagacgaccatgcaagggtgcaggtagctaaggtccacgctgaacatgtcacgttcgagctagacatccctaaaccagaggggatcgaacttttgggagatgcaatgaaccagtttgtcttgtggcatcatcgagacatcatccttgccggacaaccaccatctgccctagctccatcccaaccaatgacagttgccgctcttgcaccgacctccccgctaggatcaccttccccacaagcttccttgcctctagtaaggtcaccacaccatccaccatccctaccagtttcgattcctccggtaacgtcaccacatcattcacgttctccacctacaccttctgctcaagtcccttgccctcccccttcgccacctaccgaacaaccatctcccattcaccaattaatctcctcctacaccacaatttgctctcgcccaacaagtcccacctcaccaagtaaatcaatctggccccatttctactacccttgaacatcgcaggctcatacgaaaattggtttccatgtacgaccacaaggaaatgtcaagagataaagagaggttcctgttttcaatcttcagtgggagaggttgggcaaagaagaagaaagaagatgttgctgagctgtaaaattcctagaagtcagtagtatgggccaaggatgagttgcaatcttggctatctgtagatgtgccccaagaatataaatatgacaagtcattcttaccatggtacattatgaataatctaccacgacagatgagggtgatgcatgaatggtacctcaaggtatctagaaaggccctaagcttcattagtgtcaaggtcccacgagacgatttcatgagtaaaaccaatgagatctttatcatcaatttccgggacctacacgccctcttcaagctcgataagatggacatcaatctcgttgttgcattttgcgtgtaagtgtttttacactagtttgttgtaagtgaaatgtgtgaaagaaacttccttttcaatcaagctgcattccataggtcacagttctacgacacagaaagagcgaggcaactcgttggctatatcgagccaacaaggatttgcaggccacacaacaaactgtacagcttcttgctaatagcccggaactaacagataagacaccggaggaacacaagcatatatcaagaaattgcacaaggaagaagattgaagtagcttgctacttgggaaccgcaattctcatgcactgagacaaaaacatcataatggtcccttacgtcttatataagcagcatctcttccatttgattattttttttcttgtaatacaagataactagcaaatgtcatctctaattcatctatcttgtttgcaggaccactatattttattcccggtatatccgagggaccacttggtcgtcgcgcttgatctggcacactatccaagaaagcctatatggagttcctcactatttcgaatttcaacgtagtaacataccacctcagtacctaattgccgttccgaaatttgaaagtaacacaaataaatgttttatcggcacagagcacgtaaattttatgtcaaacatcacaggccagtaaaggatgtgcagaggaaaaagcttcatgtgaagacggactggccggtatgtaatggcgtgtgccatgcacacaaattgttgtaatcattactatttttaaactgactggtgttattatcatgtttgttgtgtttcaagcaaccctaggcactaacctatgtggatattaagtgtgcaagatgcttagggtcaacaggagatgcacaacaaacaacaataacgtaagtccggagattgttctctacatagattatttagtcacatttcatttcctgactttcattgtcttcgttttttttcacagatccctcaaataatccttatgtagcaaaccggttcaacaaacaaacaatttcgaacatatgcgctgacctatgccacttcatatgtcgtgactgctgcaatgcattagggaatcctatcttaccataaaattataacccactaaatcctaaatcttaacatacaaagatatcacaacattatacaataatcttactataaagttataacccactaaatttaaaaacttaacatgtaaagatggcacatcatcatgcaataacaagatacaacatcatcatccactaacaattattatatttaaacatcatgcaagcatgctatattatctataattctatcattaattttattttagagttttaaaatgcaagcatgttaaagcatcatcccatatatttcacataatattttaatatatctcttcatcatttttgtaatatcatatatacctatatagttcatccttacttagttaattaatgttatttctctcttctctcattaagtaatatcacctcagttgtttttagccttagttgattaatctacagtccaaactatctccctcatttttttctctcataaagccacatcactttacttttacatttaaatcatcattctgtatactccttccgtcccaaaatataaacatttttgggtctcgacacggtctccgagatactactttgattaacaatatctatggaagtaaaatgttttaaataaaaagagttgcatattatgatagttcatttaatgataaatatagtaacatcaaatttatatgattaatctttttagtttttttgctattaatagtcaatatttaaaaagtttgacttggcactattctaaaaatgtttatattttgggacagagggagtattatttaaatttaaaatatcataaaccccatcaacttatgtaagtttatactatctagtcatcttacgcattattttgactcattgttattatagtaaattcccgtagcaatacccgggattcacctaatttctacgattatcagagcgaactgggcaaagaagacaaattcaagcccctgaaagagagtaggagaaagaacgtatacttataataattatacacacatatatatgtacctcggtgggacgcaaagattggtgactgaatgtgaaggtggagtccacaaacgcatccagcaatagactggaagccatggttactgccgcagatgcctccccaagtttggtggtaagctgctgctgaaactccttgaaatgtggctgcaagtatatatatcgacaacgcaattaaaataggatcaacattagaggaggggaggtcgttcttacattggatgtgatacatttggtgaaatgatcagtcgcattaggccttgtgattgatggtcttggtgttccagtagtgctgctccttctgcacaaccatggttggagagtgccgccatacatggatggagatgctgcggccaccatattgatcgtacgtacgttgtgcgcttccttgctatctaatttgtgtgacagctacaactattgtttcatccactctatttgtcagaggaattcggcaagagacgctcacttttatagtaacctagtagctaagtactaccgtcgaggcatgaggcatccatgcatgggcgcatgtgccgtatttaagacagctttgccccagtaatcaattgtatggtatttttaggacttataaatttgaccacgcggtctatgatattatcacatgtatttattagataaattttatgcatgcattctttcattttaaaacagtatttgaaagtttttttttttgagaagtatttgaaaaatattaatggttgaaatttcatgagtccattaactaagctttgtgtatgtcagatatatatatagttcgatcggatatacagtgtgattttgcaatgcgaacatgcatggtccattgactcatgatcgagttaatcaaagcagccacacagtaatgttgacttcgatcttggaagccacagtagtgtttttggtgtagaatctggcattagttcacccttcagcaaccaaatttgacgatctatggaatgattgtatataagacaacgcgcagggaggcggcgcctacgtacgtatggcgacgaccagggcacacgtacgcttatataatgtcacgcccggaaattcactagtaatttccgaacttattagtgcataaaatcctcgtccagaaatcagccgaggtatacaaactgacaatttaatatacaaatccatcataataataacgttacacacttacaaaagaaaagaaaacagcagcggaataacggtctagcgatagcttcagctccactcccacaggcagctcaactggggtataagtcaaacgtcttctccttctggatcctttttcttcaactgaggttgattgattattgcaagaatgagtataagccaaacgtcttctccttctggatcctttttcttcaactgaggttgattgattattgcaagaatgagcatatgacatactcaacaagctacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctacacaggcccaaccatcctgaacaaccatacccggctgtacagatctaactccaaaccaggagctaagcaaattattaccaggtataacatccataataattgtgagaggtgtgagactaatcacgaaaaacattgctcaacccgcccataaccgcgggtacggctattcgaatagttttactctggccagaggtgtaccactgtacccacaagacacagcctcaacatcatgtctaccatgcgtcgcgatactggaaagtacccgaatagaggctgtaacaataccctctgcacaacacaactcaccacagtgcaccattcctggatcataattacccccttataaaacagggcatggactccccagcgacccccgtgggcttatctccgccacttctcagtctggtgctccgcaatgaactatgctatacaaaaggtaaagccgttgcccacgctggcttgtggttggcacggttaatgtttcacaacagtagctcgcgaaccggtccttcattgccatgagcacgaccttcaaaaccatgtgcttacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaggctaacacgcaaaaccaagaaaaagactaataaaaaccaaataaacagtaaaaaacaagcataaacagtacatataaagtaaacaaacatgtagatcatgattttgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggatgcgactttggaggacatgtacacgtagaggacgacgagacgaacccaacggtactcaccctcgaaccaaacgacgaacaacgacggccggcgacgaggtctagcggcggcgcggcttcggtcgacggcggcgacggggctccggtgaccggcgacagcgaggagggagcggccgagcttgcccacacctcggcgcaccttacggcggtgacggcgaccggcggcaacggcggaggcgacggcgcgacacggccgaagttcggccggcggcggcggcgaacttggcggcggcggcggagaggctacggggcacgggagaccacgggagtggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttggggtaaagatagaggaggataagaggaatatttcccctcaactaaattggaaaaaggagcaacggggaggcgagatttggaaggaggaggcggcggcactgtgcacggcacggctggctcgggctctgcctgagttggaagatgaacagtagtgcagggaaggaaagtagacttcttgccgggcttttcttttctcagcctgattagaagagggagcaaaaccggactttggctgagagaagaagagaggatgcaggctcgggttgggccggcggaagagagaggaaggaaaggaatgggccgattcagcctaagacaagggaggagaattttattacttttccaattaaaataatcacttaaatgatctttgaattgttaaaaatacttccaatgctcaaataatttcaagaaaaatcctgaaaatactgggacactcaaagtacttaacaaaattataattagaccatttaatggttaatttaatatgtgggtaattactgaaatgctctttgtatgattaaaaattaggaattgagctccgaaaaatccgagaatattccagagagtataattaaccatggagaatttaataaaaattaaatccatccatgctttaggaaattttatctcccacatttaatttcacttgtaaattaatgaacatttaatataaattctaataataatttattaaataatttataaatcctgaaacaaaaatcaggatgtgacatataatgtaggatcgaatcacaacaactaagccaaccagaagggggtgaatggttgatatgcctaaaaaccaaaacttttagtggaaataaaagttaccctcaaattcgacggatcgcggtctgaccgaagtagttccaccggtctaaccgcctggaacacgccggtctgaccgagatcgaactccggtcgaaccgctgagatcgtctgccgctccctgtcgctgccgcccggtgtgaccgccttgtgcccgccggtcttaccgccatgatgccgccggtctgaccgccggtgcgccactggttagaccaccgaaacccggtgaaacataaatcgaagaactcttaaagtggatgacaattttattgattctctctgtgtttacaaagtgcaccaatagcactcattacaaaaatttcgactaaactcgaaaccctaactcaactatcaactcaattgctctcaaaagcgataccgggaagcctcacgctccccctctatttatacccgaggtaggcagcctaaagccacgaaccaaactcatgctagaagtcctaatcaccctaggaaaccctctagtacaagaaacaaactttacataaccaatcataccaaatttggactccttccaaattcgactccgcatcccatacgcacacaatacctccatcgtatgccatatggaatcttcaccaaccatgtgcattgaactctaaccttagtatcccgcatgatctctgaccaccacggacgtcgtcttatccccaagccgactcccggtccatcaccgcaaatactctcccagcatctcgagtcacctacacatagaacaaacaaagaaaccaaaccatattccgagaccaagctatccccaacatgactcattagtagcaaacggcagtattacatacgcatagtatccatctagaagtcataacaatgaaaaaatcacagatatctaaataaacaacccgaaaccgaaaccgacacagcgtcggccggtcagaccatgggctgcgccggtctgaccgcgtgatacacgccggtctgaccggcaacccatgcccggtttgaccggacccaaatccagcagtacctgtagatcacctatgaaatagaatcatctccaaaaccacttcgcaaataaattccaaatcacaaaaccaataatctccaataccaattgttcatcacagaataataatcaaaaacacttttgattttacaatctcccccttgataaacacattggcaaacttatcaaaaatgttttggtgtttggaaaaataaaaacaaaagtggtaaaaagcacacttcatacaaacgtacacatcgtgctcaaaaatccaaaagaaaacttccctcacttttgaaaagaaagaaatttctaatcgaaccaaaaacaacatgctcttctcaactcatttgcttctccaaaaattttcaccttgcttctcccccttttgacaatgatttcatcaagcataggaattatgttcattaatgtttaagagcttagcatacatatagcatatcaagtcatgtgttgcaataaagagaagatgaacccatctataatataacaagcatgcattaaccatgaaccaaagattttacaattaagcttgaatcaactatcaaaattcatgatttcatatgatttataatgcaacatcttaacaagcacataggttgaaaaataaacactaaacacatataccaattgcattaatcacactttctcagatgagcttttgcacaaaacaaccaagagaatttttttaacgttttctttttcttgagcctttttgcccatatttttctcttttattcggggtacgtccctgtcgtcaagactgtttccagggatttggtacccattattttgctcacatcgaatacgtccttatcgtcaagactgtttccaaggattcggtattcatttttttcatattttttattctctttgcacaacgagcaattaattcaataaagcatataagtagagcatttatagatcaaaccatatgctagcatcaacattgcatattagcttaattcaagtatagaattaaagtgtcatgcatcatctcccttaaaaacaaaatctaagtctcataaaaagactagaatacatacaagctatgctagagacaaataaaccttcaaagtattgctagcatgcacaagaaaataccatatgtatagatcaaagctctcttttctcaatttttctcattgtcatattgttgcttgataaaaccatgtgatacaaaactcccactcaaatcatgccaaaaggatgaattattcccaattcaccacgaagaaaagcaaaacgattagaatccaaaggtttagtgaaaatatcagcaagttgcaactttgtgtccaaaaactagaattcaacatctcccttgtcaacatgatccctcaaaaagtgaatacgaatatcaatgtgctttgtgcgtgaatgttgaacataattcttagcaatatttatagtactagtattatcacaaaagagaggtactttctcaaaagtaagaccataatctttcaaagtagattaaagccaaagaatatgggaacaacaactagcagcagcaacacattcagattcagcagttgattgagcaacactagattgtttcctagaagaccatgcaatcaatgatgtaccaagaaaatgacatgttccactagtacttttcctatcaattctacaaccgccaaaatcagcatcggaatatccacttaagcatatagaagatgaagtagaataccaaattccaaactcgagtgtatgattcaaatacctcattattcgtttgaccgcttgacgatgtgaagcatgaggagaagcttgaaagcgtgcagacaaacacacagcaaactgtatgtctagcctagaagcagttagatacaacaaaaagattcaatcatacttctatactccttttgatcaatagcttcaccatcttcatcaggatccaacacaactgtagaaccaattggtgttgaaattggcctgcaactctccatcttgaaccgtctcaaaagatcctttgtgtacttcgtttgatgcacaaatataccttgagatgtttgcttaatttgcaatcccaaaaaatacgataactcacccatcatgctcatctcaaattccctgcgcatagtctcagcaaacacacaaccaaagcgtgagttgaacaaccaaagatgatatcatccacataaatctgaacgaacagttgattatcaccatgggctgcaggaat

SEQ ID NO: 32196 - DNA, 1830 bp, Oryza sativa
ttaagaacaaaaagcgttttgtcaaccattcccattgtaaaaccttacgcaagcaaaaagttcttaagcctatcataccatgctctaggtgcttgtttcaaactatacaaagctttagacaatttaaaaacatggttgggaaaatcaggattttcaaaacctgatgattgtttgacataaacttcctcctgtataaaaccatttagaaaagcacttttcacattcatttgatacaatttaaaaccttttgaagcagcaaaagccaacaaaagtctaattgcctcaattctagcaacaggagcaaaagtttcatcaaaatccaaacccttcacctgggtaaaaccttgagcaacaagtctaactttatttctcacaatcaaaccatcctcattttgtttatttttgaaaacccacttgattccaataatattttgaccaggcacttggttccaataatattatgcccagaaggtggttcaactaaagtccaaactttgtttctctcaaaattttcatgttcttcatgcatggcgttaatccacgattcatcagttaatgcatgtgaaacatctttgtgttcaaaagaagcaacaaatgcagaatttgcacaaacatcatgagtcgttattttagaccttgtagtccgctcacctatattactaatgatttgtttcggcggatgtcgtcattgaatatgcaaaggaacagcgacttctgaagttgattcacgttctgtatcagcactggtcgaagttgtaatctctagaggaccatctcgatcagcatcaacagtacccgaacccgacaagcctggccggtctgaccgcaccccctgtggtggtttgaccggtggcatgccggcggtctgaccggcctggcgctcggtctgactggccgagctgacctcgtcgtcgtcgtcgctctcgtcttcaaaaatacgaccatcctccccctgaacctatgacaatatatctgaaatatcgggtctagtacctagactagcctcatcaaaagaaacttcgcaagtttcaacgattttgttagtctccaaaataagtacacaatagcaacgagaatgtgcagggtaaccaagaaacaatcgatcggtagaacgtgcctcaaacttatacaaatttctagatttcaagacaaagcatttgcaaccaaaaacacacaaatgtgaaactttgggttgacatccaaatcgaagctcataagaagtttttccaagttttgaccttaagaaaacccgatttgaaatatagcatgcagtgttaatcgcctcagcccgaaattttctacgagttttatactcatccaacatcattctagccatctcaaccaaaacacggtttttcctttcaacaacaccgttttggtgcggaacacgaggagaagcaaattcatgttcaagacctctttcattgcataaatgttcaaatgaagcatttttaaattcaccaccattatcacttcgaattcttttcaaagagccaggaaattcaagatccaatcgaagaaactaaccacgaaagtgttgaaaagactcgtccttagttgccatgaagaaaacccaagaatatcgagaaaaatcgtcaacaataaccaacacataccactttcctccaacatattgcactctagctggaccaacagtgtccatatgtaatagctgtcccggtgcatccgtcatcacagaaacaataggagcatgtgaagaagcaaccatcttagcatgacgacacggtgtacaaaccaaatcaagatctttcttaagtttaggcaaaccacaaacaagatccaaaccacttaactaggggctgcaggaat

SEQ ID NO: 32197 - DNA, 1137 bp, Oryza sativa
ttcagaaaaatttctccgaggccggtctgaccgaaggggtactgccggtctgaccgggggtcggtcggaccgccgctgcaccgccggtctgaccgctgcccagtagccggtccaactggtcgccggtccgaccgctggacccactgcagtctgaccggtttcctcgagggaaaaccaaatttttgccactttgaatttgcaaaatcaatctctctctccattttctttttatgagccaatctgaaacaaaaaccaacaatatatccatctttcccacaaaacgagcaagcatatttttcacgatgattagaaacattggtagactcagatggcttagcaacacaagcaacaacatgagattttgcatgcacaacattggattttgaagatgatgcactcaaggtagacatgatgccaacagatttaaacacagtgttattagtttcatgtttaaccaaaatgtcaccacttactagcactaatacctaacacagtaggaggatgtttagtatgatcagcataaggattaaaacctaaaccacggttatgtgtgctaaccttagattgatctagaatcatgttgaggttctttttaccatcagaaaatcttagcaaagaatttttcaaataagaaacctatttttccaaattagcacaattttcacaatctaccatgacacctttgcttttacgacacttggggcaagaaagcacttcattgtttttcacaacatcttccttgtactcaacatgacctaaagcgtcctttaacttcaacttattcaaagtacatgttgagcaatccaaaacactatgaggttgttttaactttttagcacaaatcatgttaaacatcaaactagcatgaaaagcaatttgttatttttacaacaactttttagtcaaaaacaactcatccaaagtgcgtgtgtgcaaagcaaatccaagagctagagaagatctatttttcaaaccatgtgcagcattaacatctctaaattttgaaatctcattcattaagacctcacaacttttgcaatcatcatcattgggaataagatattttaatctagcaaattcagaattaagagattcgataataaactcttgttttctatacatcttctcacacatcat

SEQ ID NO: 32198 - DNA, 1003 bp, Oryza sativa
cttctccaagtttcatatcaaatttaatgtaggcggcgcaccggcggtcagaccggcggcatcgtggcagtcggaccggcggcataagggcagtcagaccgacggtggtgacaggcggcagaagctgatctcggcggtcagaccgaagatacaatttcagtcaaaacgacggcaaccaggcggtcagaccggcgcatctacttcggtcagaccgcgatccattgaatttgagggtaatttttattttccgctaaaagtttcggtttttgggtataccaaccattcacttttgggtataccaaccattcaccccccctctggttggcttagttgttgtgattcgatcctacatataagacgatgacgtgcatggaggaggaggctaagatgtacgggagcatagctgaccatagccggtccaaaatgatttgggatattttgggagattttgatgtctacagtagcaatagggggtaagtacaaaattagtagcacgttgagatatggagggggctggatgtaagatgttgcctacgtgaagcaccacataggcggtcagctctgatcaaacgcgttttggaccggctatcactactagagaaaccctcatctctcttggtttgcaagccccttaagtccggtttagcaaaccgggagagagaatctaggacaaagatggcgatctttagtcccggttcaaatacccaggagtaaagatgtatctttagtcccggatgataacaccaaccaggtctaaagagggctgcgccacatgcctggcacagccatcattagtcattttttattgttttttctgcttgaatgttgattttaaaccgaactcaatgataaaatcatcctcattcacaaaatcatccacaaattcaacaacaaaatcatccacattcacacaaacatcacaaaatcatccacaaattacatcccaaaatcattcacataaacatctaaaaatcatccccaattttatgacacaaaattcaca

SEQ ID NO: 32199 - DNA, 3416 bp, Oryza sativa
  unsure (1)..(3416): unsure at all n locations
aaaatcattcacagcacccaccgccgcctagccgccgcccttcgcgacggccgcgccccgccgcccgtagcctcagccatgaccggcgccaccgcctaccgccactctccactatggccgctacatcccgcgacccgctacccacctcatcctgccgcatcccgcatcccgccgcccgccggccgcagccgacgaagaggggaggggaggagaggggagggcctaggggaggaggaggataagaggataagatgataatgatgagttctagtagaagaaaataagattgagggggagaaagagagatagagattttttttgttctctcccccgcgcgcaaatgtctctctcccttccatgcgtgctttttctcctctcccttccgcgcgtgctttttttaatctttaatcctggttggtataaataaccgggactaaagtaaagtactgatctttagtcacggttgttaacactaaccgggactaaaaatactagggtatctaccacgacctgacaatgaatgaacagggactaaagatgaccaaccgggactaaaaatggtttttagtcccggtttttggatgaactagggctattgtggtttttgcgcaacccacaaaagatggtttctccagttgtatatgattcaataaaacaagatcgtggactgcaatgtataatttttaaatttacggacttaagtgacatcttcactcaagtttaagaaccggccatatattttactcctatataaatatgaaactcgcatggtcctgtgttgttcgtttaaaaaataaacattgtaagaaaaccataacgatccaacaatcatgcaacaagttgagagtagttgcaagaattgatgagcccttcagtaccatgctgagagtcggatatttattatatatagtagcttagctaggcggctgttgtgctgaaacagtgaatgtatttagagatggatttgtgaaacacggggactaaattttcgtgcccgttgaatccatctgagacattggatctgagacattggatcgtctgagttacctgagatacttccgtaagggcatgtacaacggcaactaagagtggacacagagttgttgacgaggtaagtttgctgacagggaaaaaaaagcgagaaagaaagagaaacatggatagttgttatgttgataacgcctttacatcgacacttaacgtttataaaatgaaactttgttgtacgagaatatagaaaaggaaataattattagaatattttatcattaaggatagtctttaatttttactatactccaccgccgtcgacacccctcccctccggcggatctggggagggaaggaaggggaggggagggcggccagctgtcggatccgcgctcccctctggccgtgctgccgctgatggccctcccctccgccggatctggggagggaaggaaggggaggggaggggagccagatctcggggggagagggcggccagctgccggatccgtgcgggggttggccgccgcccgcgggatcccgcgcaccgtcgccatgccgccgccgggactcgggaggagaggagagaaagaggggaaatttaaagtgggtaggagggaaagagagtggtattttcgcgtgcggtgatttttccgtgcggtcctcttaaatggaccgcacgcgaaaatgagcttattttaccagacacgaccagttatggtccgtctgcaatctagctaaatgggtccatgtccaggaaaatcgttttttattagtgtagctatgcctaaaccttatntnaannttgggnnnnnnaaaaanattttttnggggggggggnnngnnnncaaaaaaaaaaaaagntctttttttttcgcgcgcaaaaaaacacgggttttggaaacgttccaacgaggccccggaaaaattttggggccgggcccgccccttggggggggcccctcaaggtttttgggccccgggcccgggggggggaaaagcggccgtttgtttgggggnggcgagggcgccccccccccccccccgccgaagaaaaaagagggaaaaaggccccggccccagcccgcccggtggaaagttgggnnccnggnncacnntcgcacntancgcattgatantttnagaaaangagttaagccgcgcgaggntnaggccnnncgntgnanntatagnnattcacccccagagggggatgnacccaggnannaactgcataggcttagggccanntccccaacgaaagccatagctataagtagcctcaggtgagccatacaacccgagactatacacggcatgggatacatatctcccaatggaagacacacttaaatgggccctacaaaatctgaggcaactgtttgaaagtactcgaatccagccacaatgtgtgtccctactatatttcacagcctggtctcctctttcttttttttttctccgcccgccagccagccaccccatgtggcctcatcttttctcgtcgcctcgctctccctctctctctcccgccgctcgtcgccatccaccacgtcggtaacaggatcccctctcccacgttgtccctcaccctccgcccgtcgccgcctctctctccctccgcacggcaagcaacacgcagggcaggatgcccgacatcgagcggggcgcaggacgcggtggtcgacgacgagcggctggtcaggaggccagatctggtcggccgtatcacagatccatcttcaccaggaccgccgacagctcctccatcatctcaccgcctctgactccttcccaccgccgtgttcctactcctagcgacaaggccgagggtagaagaagaaatctctggtgcgggagcagtgtccatgagtatgaggctaggcatgacatcgcccaacacagagcctagctccatggctcgatgaaaaggagccgaggagcacagggaggcacgtacctctactagggagcgcactagatggctccggctccaaaagcgatggcgagccgaacggcgtgaacaaggctcctcgccaacggcacccatttgggccgggatggccttaagctccgctagaattgaaaattgacggcaataaattgaattattaaaaatgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32200 - DNA, 19396 bp, Oryza sativa
ttaggggcttacgaaatttcgatgttaacaacttcataaaattaacattgccaaactgttttggtctcattcgcataaactagacaagttcgtgtactgaaacgaatattttacaattttatatactaaattgcattcaccttacaagattgtgtatcaccgatgcaaatatgcaatttactctttacttaaagtttacagcttttctagaagaacctgtttgctgctcaccacagtaaatgctatccattttcagcacttcttcattctcacgaacgtgccttctgtcttcaccggccatcattgttgagataggtgaggtcctcatatctaccccctccgtcccaaaaagaatccaattctagctacgaacctagacataggttcgtagctaggatttgcttttttctgggacggagtagtactcattccacttgtcccattcttgttgtccgccaccacgctgtgttgtcgccacataaatgaccaggttatctgttgacatggctgccattgcattgtgatgtaagcgccacctacacattcctgtcctctatggcgtcccgtgtggccagtggcgtgcgagatggtatgccatctcgcccggccgatcagtttctatcgatgtagaccatcgattaccgtgtaccacctcgctggacttggtccacactaaacctctctcttctgcagtcagtggtacattgccagtttacaactgttggtgccataaatcttcctaccactaaaaacaaatgctttgtagagacatttttctagtgctgtagaggcacttttcaaatgcctttacaatactatagagacatttttaaaaatgtctaataagtgtcttatggtgaattcaaatgaagagacattttataaaatatctataatatggtagaggcattttctagagacattaaattatatcacaaatatatgaaaccagtccaaaaaggagaataaaatagtttctttgcttttaacaagtcttaaacttgagatcacttggacaaatcatttttatcttcaatgcactaactaactcaactccatgtcattacttgtatgtttgtgcctttagttaattatatatagtcctttagtacacattatcattgtaacaagtgtctgtacatagtttaaagtgtctcaagaaaatgcctttacatatcaggctattttacagtgccgaaagaatgcctctacaagataaaatctaataagtagagcagaaaacgtctctagagtaaaagtttgtaggcaatttttaaaatgcctctataaaatatctctacactataaaacttctgatcttaaaagtaatttgcaaaatgtctctacaaaagtgctcacataaaaccgctgggtgaaaaatttagaaccgacgccatagataaaccgttatatataccggtggtatatatgaatgtactaactatcattgctgcttcacttttgtggcggagacaatgtaattggcaattatgggcaccggcacacatttgtacttttatctaatagtgcatactccctctgtgccataaagagataactcctagcttcccaatgcgaaattaatgaagaggataaaggaccaaaatacaattattaatagcttttttttagataatggaatagagcatcccggcctttactcaaagagctacagccaattattacaatctcacactcaaaatgagtgaagttcaaagaaacttaaaggatgaaaccaaccatcaagaagaaacaagctaaagactgccaacccaagataaagagtacacaattattgaattatgtttgacaaaaagttgcataactgttgtctcaagaatacggcatgcagcctttaaaagctcactatcttcctcatacttttgtagttgtgcccaagaccggagtcaatgtgttgccctgaaaactacctgcatatattaatagctagtattggtagatatgtaggcaaggggtattgaaggaataaatttttttgatttgcgaatcaacagtgaataagaagatagaagttgatttattttaggacaaagtttgaattctataagttgatttattttggaacggagggactatattcctctattatctactgataagctccctcctactcccacggcacgcatctgactgtgatgtgtattgcacgtgcacaataaccagcactacctttaaccttcagtccttttgaagcaaaatgtgaatccacttattgatatattattctattgtttgtttaattattttgggattgtcctcgacatttgtcttttttagcctgatgccctctgtatagaaaaaaatcgttgcatgtacgcttgaatggaagcggtgtgtgtggcacagatttataattttggagatgatttgaaattagtcaaagcatatctcataaaagtttatttggtgcccttcaagctaacgcatgcagaaatatctccatctctcctctgatactcaaatccatatatgtgcctcaataggattaatcccaaattagctaggagcctcacatgcaactatgtaaccgtactttggtatgagtttgctatctcctaattgcattagctgtgcactcagcacaatacataatttccaaggacaagtttaaactccactattgcggggtacgtaggggttttggagaaccattggcggttgatgataccctcgacactggtttaacaaaatacatactccgatccctctgtccttaaaatgccaaattttatctaatcagaagtggtttttgttagacggattgtgtataattaaattaagtgctatatatgtagtattgtgtaaacaccatcccatattgcacggcaataaaaaaaagctattttaagcagagtatattgtgtgtgaacgcgtcccaaaacacatttttggcagcaacagtaagaaatgtgttttcttgtgctggcaacatttttgtttggcatttaacttttttctagttagaagggaagtttacagctaatatgaatatctcctaattaaagtttacagcctttctggagcaacctgtttccagcacagatatgaacatctacctcgtttctcccggatctacccctactccaatcctcttttcatctccaaatcctctcttttgtctctccttctcttcttgcaggtttcctacttctagacccagggcaccatcagaaggggtacccatggaccatctggtcttccatcttctggtgatggcaaaggcaagggtgtggcaataacaggagctaatccatggtattcgggtgatgactctgatggaagcaacagcattagtgacagcgagagaacagttaccgctgatttcagaatatttgtgtgcatcctggtggttatggtgatcaggaggtggattctcgtaaggctaataaccacgaggcagattcagaaaccgatagcgagagaactgaaggctgctagctttgggatgatcgcaaatagttttagtaattctctccatttctctcctatgtggactctgagttgcacccaggaaaaaggtagaaaaatgtagtgtttcaacctgaggttcatgaatttctatcatatcctgattttttttgtctccatgatctttttatggttcatcaaaaatatcagatatcgcaatccattagttttgatgagaatatcacaaacggtgcttcatctcagttaacttttaaatccagctcaatctgattgttttgcgtaggtttatgttcctgattacgataaatagtgctgtaacatatataacaaatttcaacagattttgaagtactggaacacaatcacctggaaaaacaacaactgtaatatattaatttcgacttcactttttctctataactaacacaatatgattgcgctccatgggattttttacttcccttgttatttctgttaaacagtcctgcaatacaacatatattccaacatcttttctgaaattggtattctttattatagatgcaaatttgaataaagatacaattcttatagtttctagaaaaatgtatgcaatccggtgagcagcacagtgatttttgagccatatgtgtgtgtgtgtgtgtgtttgtgtgtttcctatcacatgatcgaattagtttaaatcgttcacgagaccttgtattgtcgtactgttcaagattctcaccatggttatatactttcagaggattctaagcggtgacaatcttgtctagagtggtcaacgacaagatgcagactctgggttgtttctgtggtcctcaggaaaaacacaagtgaaaaagaaaaacacaagtgaaaaacaataaggatattcctgaatcatggaaggttcatccaagaaaagatgaggttgatccaactggatgggacatcgagaatcatcttcgaaatgatcagaagaccaaagataaggttagtgaattaatattatatgttgatcagttatatttgtttcataaattttcatgattaattaaaagagttaaatgtgttctttctcaaatttatgagtgtatcacaaacgaagttttttttttaaatgttttgttttacttcgttagggtagatagttttggggaaagataaccagccctgtcatcaatataacaataatatgtagggatttttaatcttagcaggttcaacgtttctgaaagtaccggtgattgtacacatgaaatagtaatcttggagattggctgaaaatgttaaatgcacaaatgtttttgacataaagatgtgttatatgttaaccctaaaagaatgatgcatgatcgaaaaatgagctatatatctatcatttatttctttgtgtaaacccaaacatgtgttactcttttaaaatttatactttgtataactacagtataaaacctgacacatggaacaattgaaatccaacaaacagatttagtgtttaaacagtactgttggttgggagtactacccacatttagtcattcattaaatctgaatattaagtctcatatcgtctagcaaaaatacttctcatgctacaattaaataatggtaataaaacaatttgcattcttagaatatatctggtgggatatgtcacatctggccaatatgtaacatggaaccattggaatgcatagttctttatctagtaatgacatatggcaggattggagtggtttgtaaagttacattcctttttaaaaacatattcttgtttatataacatgataatttgtgtgcagtcaaagtaatatgtacaaaaccaaactattttatgatagctacctttagtacaaatggcattcagaaaatatatttgacttttatttttcaaatataatcactattagaacacagtatgttgcatataaataatatatcttcttgctaattcattaatctaacttatcagttctaacaatgaattgcgagaacatatcaaaaattaatttggatcaaagcctgtatactgtgaatccttgcacctttgggtggctaactagggtcatacacgtgatgcagtattgggatatattgagtttttccctcccatatccccttccaaccaaagaaaaaagaaagaaaatgcatgttggttatttctaaattatacatatactaaatttattttgttgttcatatgttacatgaaattaatttttttctcacatagcagtattaccgccacaaggattacaatcataaatttcgctcaaagcctgaagttcaatattttctagatactggaaaggttatgattccataaagttccaggcattctacagaaggtgccatgctacaacagtgtttcgaacattgtattctgcataattttcccgttccaaatttgatactgattcccatacgttgtttctgtacagtgatcagttgatgcacgtgttcctagcaggggtaagatttcataaaactgtactgcagcttggaatatttaactccataggaatacattttcattcttacagatcattgaatttcgcggatatgaattgtgttttagatgaattatatatgggaagacctgcacgacgattaaagtatttgattaaactgaatcagtacaactgacagaaacaataaatagaaaaaatatataacaccattcattaatatatatgtatagctatatctaattttttagataatggaatatcattgcggccttttctcatatatatatataatggaatatatatccatacaaggtattttagattattttcatcttgtatatattgtcaaacatttcttaactgctatagaaaaatattatgttactcactgaatcgaactgctgtatatgacatatggacacaggccgcgggtgccacgcccatacaacgtacatgctgctgttctcgtctactacatgacgctcgggtgtacgaggtgttccagaactatatggtcagctacctgctcgacgtacgggcggtgagtacatcatagtcgtacggaaggctacaccacctgcgcaggtggtgcagccgcgacaccaacgccaccaggtacatgctggtgacgtagttctacaccctgtcctcgcactacctgcagcctagtggcgctcgacacgaagatgatggaacgatccctcgtgatccctcgttgagctaccgaggtaagtatctgcgggcgtcaaaggtgtacaacaaagaacggagcttcaaagccatagagatggccggcgtgatcgggctattcgccatagacgacagatgcctcatgctctgtgtctagctctggcacggctcctgaaggtgacgctgtgggagctggccaggcagatccctccctttgccccctgccgctccttcccaccatgagccgccgctgctccctccctccacgagctagtgccaccgcaagagagagagaggcaggatgcaagagatgaatggatagggttaatatgaatggataggattagatgaggatagggttgcttcgagggtattctaatcgttatgaaaagttattatatttctttttttgaaaagtaaggtaaaaaaagtagggtaaattagtagttaggcttcgaaacagagtcaaataaggaattgtctcatatatgtggtatctttccatataaggcgacaagatacaactcaacacaacgcatgcatgcttttcagatcatgtttgaattgcatactttattaacagtgcaaactctactgtgccaccaactctcacgtgggagttgcagagcacggtaaaaaaaaatcacacaagtacttgtaccagtactagtaccagtactagtactacttcactgtgctacccactccactcacttttcttcaccctgaagacgaattttcccccaatcttttccccaagaaacgaagaagccgcagcagcgatgacctcatggtggtcttggcgcagcctcttctcctcattgggcaatggagggggcagcaatgccgatgcttcctccggatccggcacctcctcccccccacccccggtcccttatcctcaacaagcagcagcaggggcgcctcgctggcgaagcaattgcacgatgaagccttgggaggaagggccggccgaagcccaagccaaaccctcgcaatcgcagccacagcccgcgccccgcaagaatcgtccttcaccccgaaaggccatgcccaaggcgtccaaggcgaaggcgcagctgcacctcggcgacgtcgagccaaagaaaagctagccccgaccccgtcttagaagcacaataacaagagaaagcgggtggcgagattcgagcggtcatggtccagggctaacgggatcaggattctagaggacatggccaaccatgccaacacccatcgcggcgctctgccggataccagcgatctctttgccgcctttgccaacagcctcgacaaaagagatgccgaccaggccaagctcactgacaaagtccacaagttcaagagatgatatgacactgcacgcctgcagcaatgcagctcgactgacgacaatgatatgcatcgattgttagatcatggagcagcactaggtgcacctgatcggcacaaaagtggttgcacatgagcctggaggcagcgtcgccaccgggggtggcggtggagcttctgcaacgtgaatcaagttatttctctacaccctgccatggcgatggcagccaccttttcttcctccttcagaacacgaggaaaatgcagtttagctagcaatcttatataatccactgtctcccagcattgcaacaatcgcatgaagaaataatctagttttctttttgaatgtactatatagccattggaagggtgtttttactatacctcccactagtgggtgtactagtgtagtaagaataaatcccaccgttgattttggtattaaggtggaaggataattaagtaattatacttctatgatacgctgatgcttgccagctgcctagcccaaaatagatcaatacttagctcatgaagcagaagcatggccactgtatcgcacctagccagcgtccgccatcgatcgttgcacttcccttcttcgcatgaacacggggatgggcacacggcggctccgcccctcccaactgtgctgccaacaactagcacccatccttgcgcagagcgactgttataaaaccagccctgcaatcaacatcggtagttaaacgcggaagaaacatcataggagatccaaacacgatgacgtcaccaaggcacgatatttgataacggagttcagccgaggcctacatctctggggtactgattacaggtgctcttccaccatccagcatattacagtgtatcagaaagttacaatgagccgtgccgctgccactagccgagagagagggagagagagatagacgggatatgagagatgaatggatagggttaatctgaaaggataggattagatgtggatagggtttcttcgagggtattctgatcatttggaaaagttattatattttatttcttttttaaaagcagggtcaaataagcaaactaaaaaggtagggtcagattagtagttaggttaggcatcgtaacagagtcaaataagaaattctcccatatagatggtatcttttcacaaaggacggcaagatatagaacatgcatgttttcaaatcatgtttgaattgcatactttattgatagtgcaaactctactgtgccaccaactctcatgtgggagctgtagagcacggtgaaaaaaatcacacaagtactactgctacttcactgtgccacccactccactcacttttcttcaccctaaagacgaatttcccccaatcttttccccaagaagctgagatgccgcagcggtgatgagctcatggtggtcttggcacagcatcttctcctccttgggcaacggaggaggcagcaatgctgacgcttcatctggatccggcacctcctcctccctcctgtccctcatgctcaacaagaagcagcaggggcacctcaccgttgaagccgaagcctcaggagggatagccggccgaagccgaatcccaagccaaaccctcgcaatcgtagccatagctcgcaccctgcaataatcgtccttcaccccaaaaggccacgcccaaggcgcccaaggtgaaggagcaattccagcttggcgacggtgagcctaagaagaagccaacctcaaccccatctcagaagcgcaacaacaagagaaagcgggtgacagcattcgagcgcttgtggtctagggccggcgagctcaggattctaagggccatggccagccacaccaacacgcatcgcagcactctgccggatacctgcgatctttttgccacccttgccagcaacttcaatagaagagacgctcttgcggacaaagtccagaagctcaagagaggtatgacaatgcacgcctacaacagcactgccctactaacgacgatggtgtgcgtcgattgttggatcgcggagcagcacctggtggacctgatcaacacgatggtggtatcaccgcatgctacacctgagcctggaggaagcatcacccccgacggtggtggtggggaggcataatgtctccttgtttttgtcactggagctggaatccatgagcttttccaacgtgcatcaagttatttctctacaccctgcgatggtgatggcagccaccttttcttcctccttcagatcacaaggaaaatgcagtttaactagcaatcacatataatacaccgtcacctaggattgcaacaatcgcatgaagaaataatctggttttctttttgaacgtactatatagccaatggaacggtgtttttgttgtacctcccaccggtggatgtactagcgtagtaagaataaatcccaccattgatttcggtattaaggtggaaggacaattaagtaattatatttgtatgataggctgatgcttgccagccgcctagccaaatagcgttcaacccttagctgacgaagcagaaggatggtcgtcgtatcgctcctggccatcgtctgccatcgaccgtcgcacttctcttcttcacatgagcacggggactggcacatggcgactccgcccctcccaatagcgctcccaacaaccgacgccgatccttgtgcgaagcgactgttataaaaccaaccccgaaatcaacgtcgatagctgagcgcagaagaaacgtcataggagatccaaacatgaagatatcactgaggcacgatatttgataccggagttcagtcgaggcctacatctccagggcactgattacaggcgttccaccccgatccagcattttacagcgtatcagagttacaacgtgctggcgccgccgccgccacttgccgagagagagagagacgggatacgagagatgaatggatatggttaatctgaatggatagaattagatgcggatagggttgctttgaggcattctgatcattatgaaaagtttttatatttcatttctttttgaaaagcagggttaaataagcaaacaaaaaaaagggtcagattagtagttaatttaggcttcgaaacatagtgaaattaggaattctcccatatatatggtatctttccataaagggaagcaagatacaactcaaaacaaaacatacatgtttttcacatcatgtttgaattgcatactttattaatagtgcaaactctactatgccaccaactctcaagtgggagctgcagagcacggtaaaaataaatcacacgagtacttgtactactactagtactactttaatgtgccacccactccactcacttttcttcaccatgaagacgaatttcccccaatcttttcaccaagaagcggagaagccgcagctgcaatgagctcatggtggtcatggcgccgcctcttctccttgttggataatggagggggcagcaaagccgacgcttcctcctgatctggcacctcctcctgccctcccatcccccaagctcaacaagcagcagcaagggcgcgtcactgccgaatcgctcacactcgtggtgtactagtatagcaagaataaacccaccgttgattttggtggccatttgagtcatttatttaattaaggtggaaggataattaagtagttatggttctatgataggttgatgcttgccagccgcctagcccaatatcgttcaatccttagctcacaaaccagaaggatggtcgccgtatcgctcttgcctaccgtccgccatcgactatcgctcttcccttcttccatgaacacggggacgggtacacggtgactccgtccctcccaactccgctgcaaacaatcggcgcccatccttgcgcaaagcggctgttataaaagcagccccaaaatcgacatcggtagctaaacacgaaagaaacgtcgtaggtgatgccaacatgatgatgataccgggtactatatttgctaacggagttcagccgaggcctacatctctggtgcactgactacagacgctcctccatgatccagcatattacagcatatcaaagttacaatgactcatgactggacgccgccggcaaccgctccttctcgctatgctaaatcgccatgtggtcatagcaggtccacccctctatttaagagagatactaggatagagacagactcttactctattcctaacatctaatacaactccaagtcctatactgcaaccgacaacatacacatattcgacacaaactccaacaaactccaccttggcacaaactttgtgtatataaactttagacatataaattttgttgatatatatttgaaacaaattggaaaaagattagagaaataacataacatatatgtgggatgagagacccatacgataaacgggccaagccaatgaaagattggactcatttttgccaaaaaaaaaacgaaaacaacactcttcataggaaaaaggaataaattcactctaggtccattaatttgtcgctgaatctgaaatctatacctaaatcgacataccatgtataccctatgttccaacttgcaataccatgtcaactttcagtctagaagtattgtggccggtttgaactgacgtagcaagtgggccccacatgtccgttccaattcttctgtctcctttctctctcctctcgtatccttcacatggcaatggtgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgcccctagaggggctccctgccctccttatataggttggggggcaaggttataagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgactagatgcacctaataggtgtaacccccgactatgtggttaattgaacaaaccaaacatataatcaaggaataaataatctaaccaaccgagtggtttcgataattgtagtcaaccaagcgacttaatattaatatgtagcatatgcggtgtgaatccctgaataatatgatccaagtgatacaccgactgctttgtaaaatatgatgagtgtaacctaaagttggctacattattgaaaattcacatagcaaaacagctataaagaagcttgtatgttgtgaataaataaatttccaaagtattggacatacgccatgcgcacactgctttaacagacgtgctttaatccctaaaagacacatggtttcaccacacctggaaacatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaacatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtgatagtaaaaacagtgacaccaatcaaaggtaatgaagttgcataaccatggaggcgaagaaaccagtcggcaacagtcaggtcagctagcagtgaaggtgtaggcgcccaacaacaacgaaagaacagtcggtggtgacaaaagcaaaccgacgatgaagacgtagacgcgcatcaacggtgacagcgaaatccaccaatcatgaagatgaagaaaataatcggcggcgacaaacgcatccgacggtaatgatgattagcggcaatagagatagccgactatgatgacgaagtttcccatcaacggcagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatattcgaagttgttgaagtagaatgtctgttccgaagcgaagatgaagataatgactcctggagttgactcattggctgattaattgatttcttcagcttgacataaaatttatcaaattttgagccttgtatttgtgtagcccccgactctttgattagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagtaaaacttgcgaagtagcagcaatagagtttgccagtgccgaagataataaagatgaagttgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtaactgtataaaccagacgtagaggtgagagcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataacaggccagccgtgcaggcggtgacaccagtcagctgcggatgcggcggccggtcggtgaagacgtagacgcccaacaacggcagcataataagtctgccgtgcaggcggaagcaccaatcggtagcggcgaaggcaagccggtcggtgaagacgcgccccagccgtgcaggcggaaacaccagtcggcggcggcgaaggcgagccggtcggtgaagacgtaggcgcccaacagcggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcggcaaaggcgagccggtcggtgaagacgtaggcgcccaacagcggcggcataataggccagccgtgcaggcgtggacaccagtcggcggcgacgaaggcgagccggtcggtgaagacgtaggcgcccaacagcggcggcataataggccagccgtgcaggcgtggacaccagtcggcggcgaagtaggcgagccggtcggtgaagacgtaggcgcccaacaacggcggcataataggccagccgtgcaggcgaggacaccagtcggcggcggcaaaggcgagccggtcggtgaagacgtaggcgcccaacagcggcggcataataggccaaccgtgcaggcgagaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagatgaatattataaaaaatatgatataacatctgtagcccccgactcactactcaatggaagaccaattggtgtagtgaggcagaggaaaaggaaaaatatcatataaagaataaaataaatgacgacttagctttgtaatattccccttggtgatggcagaagtagccaatgtgggaacgaagcagtccatcaatggtgacaaaaacaccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccaacaacggcggcatgataggccagccgtgcaggcgaggacaccagtcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcgacggcagcgaaggtgagccaacggtgaggatgtagacgcccaacagcggcggcataataggccagccgtgtaggcggaggcaccactcgacggcgacggaggcaggccggcggtgaagtcgtagacgcccaacagcggcggcataataggccagccgtgtaggcggaaacaccagtcggcggcgacggaggcaggccggcggtgaagtcgtagacgcccaacggcggcggcatataggccagccgtgcaggcggaaacaccagtcggcggcggcgaaggccagccggtcggtgaagacatggacgcccatgaacggtggtgtgaccgaccaaccgtataggcgatgacaccggtcggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgcttgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgcccctagaggggctccctgccctccttatataggttggggggcaaggttataagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacaaatggccgccggcggagaggggtggttgccggcctccttcccttctcctctctctcccttgatgcaaccggtggctggcagaagaggaaaaaaaccatcttcttcatcgccgaccttccctcctccttcctcgagctcctccgccttcctcttcctccacggcgtagcttgttgaagctctccacagcagctccctatctagggctggagatgctgacggcgttcgtcagctcaggcgtctcgagctcctcgccatcatccacgtcatgcgcgagcgtgttgagtacctgtgctctctcatcctctccaacaaagtcgaggacctcgccatacggtgtgtcgacaagcataacatgtgcagaagattggataggattgcaatctgtaagtaaatcataaatcatgctctttcttcactggacattttaatttttttagactaaatccttcaatatcaatattgagcaaa

SEQ ID NO: 32201 - DNA, 4797 bp, Oryza sativa
cccacaaaacatcagtcccaaaaggaaagaaaaaagacccgacaccctgaaccgaactaaaagctgaaaattaaaatccgaccacgtgcagtgcgaccaatcgcttaataaatagtacctctctccctctaatataagggatattcattattttcttataatgtttgactacttatcttatccagaaaatttgtgcaaatataaaaacgaaaaattgtgcttaaagtactttagataataaagcaagttacaaataaaataaataataattctaaattgtttttaataagaccaatggtcaaacggtataagtaaaatgtcaaaattccttatattaagagaaacagagggagtactgtttcgaagctctccgcgctcccaaattcggtgcatacgcaggataaatcgttcatcctcggaacgtgcagcgcgccgacgccgtctcggccttcatccgttcatcgtcccctctcctcactcccgttagcgccgccgtcttcttcaggagcaagcgagatagaaaggtagagaaagagagctcagaggtgctcctcgctagcgactcccctcacctttcgactccaggtgacgtcgccgccttgggttcgcgtccaacgccagcctggctccctctgccgtccatctccagtatcctgtttttccatggaaaccctagaaaatctatttcctccgtttcataatgtaagtcattctagaattttccacattcacattaatgttaatgaatctagatatatatatatatatatatatatatatatatatatatatatatatatatgtctagattcattaacatcgatataaatgtggaaaatgctagaatgacttacattgtggaatgaaaggagtatgttcgatatgtattctgaatgcagagaaatattgttttgttcatgatttgtactgtgaagtataaaatggtatgaattatctgtaaacccttacataatacactactgtcaagatgttgtattttttttttctaaatcttccaggttatcaagcactactgcatcgtagcagcgccataggtaggaggtcgtatggctggggatcgtctcgaccttccgtttctccacatgtgcaacaagacgtcgatgaactatagcggcaaaaaagaaaatcagaggcagcagcgatcggcgaggcgtcgaggtactgtagcggcaacgtatccacggcaagaaaaaaagatcgatcaactgaactaggcccacatgcctacgtggccaacaatcatataatattaggatttttattttttatatatcactgaaattatatatcactgaaaatcggtctgttatcttatatgccacttaaaattggctcttcctctatatgcgattggcttaaatttgtgcaccctctcactctcgactgttgactgcgtgttgactgactagggtcaagtcacatgtctttttttttcttgcataaatgaccaaaataacctttggttcaaaatcatgtgactgcaaacattcatatattcaatagtatgataaatagtgaagatctagtggcataaagggaagagccaattttgagtggcatacaagggaaccaactaattttcagtggtatataagaaattctcaactttttattagcataataatttttgggacggttttagtccaagatttttgggaactaatttttaatcttctcttggagatgctggcactatgccactgtctaccaaaacccccgaaaaaatgaggattgagattggttttgggcaggaataagttcacttcgactccattaggtagtacttgaatctgattcatatccttaaaccacgatactagatatcttgacccccccaactattaaaaccgatacaatttgactgcttcggtggttttggaggggcggtttcgctgacgtgacgcttacgtggcagggttgacctagtttttgtttcacatggcattgacgtggcacttatgtggcatttaattaaaaaaatatgtgtgggacctactagtcattcacacaaaaaaaattttgcgacacactgacatatgggggcccacatatcatcctctctctttctttcctctcctcttcttattcctctacggcctggcaggcaagcgagggcggcgaccgtagcggcgatggcgaagaaagcatcagagacgcggttgacgaggcggagacggcggcgagcggtagagacacgtgcgtggcatctccgaaatgagaacggcggcggatgaggcggcggcgacaacctcgtgaaaactcggcggccaagaactcgccgcgggtgatcctcctcacggagccactcacctcaccgatctccgactgatccgccgcataggcgtcgcccgcgcacgcctctccaccaccaccgcctcttccttctcaaacctcccgccgcgcgcctcctcgtattttaggatcgtcgtctggtcttgctgtgcgagcggtggcacctcggcgcgtctttcgtcggcagcgagaagagctaaaagagagaggagatgggcaagtgtcggcctccatgagggagtccggaaggcgaaggggcgagccaacctcaccgtcgacgccaaggacaagctcctcctccagctgcagaggcgagacgccgagagggcgaagacctcctcagccgcaccacccacaggacgtgtcgtcgttgctccagaagtccggccaaggtgaagagaaaatgggagagagaaagagagaagcgagagcgggaggaggaagaaggatggagatagagaggataatagtgggctccacacttttttattgtgtgaatgactaatgggtcccacaaaatttttaattataatgccatgtaagcgtcatgtcagcgaaaccgctctccaaaaccgttgaaagagtcaaattattccggtttcaatagttaggggtcgtgatatatggtattatggtttagggataggaatcagatttggacactaattattaagggagtcaaagtgaacttattccttttgggcatccgttggtggcgctcgtacagattctctaataaaccaaggaggaggaggctagtggaagtcaaccctccgctggacagaagagggcatgccgaaaacgaggtgccgtgaagaagatagagagtcggcacatcataactgaagtgccacgtcagatgtagccaggaattacgtacgacacagctgttgggttgtaagggataacgtgcctattagcaaagtgtactagcgcagaacaagggcacgcagggattatgacgctttgtcgtggattcagagaaagagatgctgtggaccacaatgctcgagacattcacgctccctgcgggtacggagaacatagtgaaacagtggactcttagcaaaatggcagaacagttctagagcttcaagggagatctctaccataaatacatcctaaaggggcagacaccgaacttcaacatattctcgaagctaagggatcattgggatgagtttgttgcttacaagacagggaaacaagggcaagcgctgatggaccgaaacaaagaaaatgccgctaagaagaagtaccatcaccacctgggtcaggcggctatagcgtcgcaatgccgaagtgggaggagatggaagccggcttgattgagaggggtatcgaactggccacttctaaatggcccgatcgatcaaagttatggttctatgctcacggtggaaagctcaaacctgttgatggctccctggtgttcagcaatcagatacgtgaggctgccagtcgactaacggacgcagtggaagcctcttctcagggcacattccgacccgacagagagaaggatgagctgacactcgccctacagactctcgagcatccaggacgaacacgagggaaaggcgtggttccttggaagattggattcatggaggacatccatacgtacaggagtcggatgaggagcaagagaaatactgaggcaaaaattgcagatcttgagtacaaggtatcgaactacgagcttagcatgcaagaggaggtggcaagaaaggtggatgaacgcatggccgcatatcggagccaggatccccagccatacattcctcctatcatggtcagcccctcaggcaatcgtagtagctgtgcctcaacggggcaggtaggatcacagagcatggacgccatgcaaactcaggacgaaaccacctgccccattgatgaaatcacgtagcggacaccatgtgagctgtatattcccttcaagaacttatcaatcaaggtatgctcatagttttatgatttttgacatgtacattccgcaagttgctacttaggttgattactaatagaagataacctctcatcacgtgaaggtggcgtcgggaatggccatcccaacggacccttcagggacttaacactgcaggccgattccaccaagatactcgagggtcgaagttgagctggtggaagccgcgtacgaggacctcaagttggactaccttgaaggagacggtgatatgcatctacgagacacaagccaaaccattatactatggcgcaagtgctacatcatccttcttgggaaacaagcgacgtctcctgcaccatctccttcggctctgccatctcctccgcctcctccgcctcgtgcaccgtctcctcctcaggctcctgcaccgtctcctttggctcgtgcaccgtgtcctctggcaccttccaagtcaaggtctcgccaagctccaccgcctgcctgcacaacggcaacgcagaaggcgaaagttgatgccgccgaaaacaagg

SEQ ID NO: 32202 - DNA, 4277 bp, Oryza sativa
cgaactcggtaaaccgcttgtcaagcctgagcagctaaagtccctactgacacatatgtaccgattccatgaacagtaaatggaaatgattgccaacggtagagaggtgatcggaacgaggatcagaacgtccaacttcctgcaaggagaagatgttctctggatcccgttcgacatctctcttctaagcgcatggattttgtaagtattgttgagttagatttattacactccttaattagctctttgtatatatgtacaccataataattcattttctcattgtagaattgagattcaaagggcccgatggcggggggatttcgatactggattcatcgaccctcggaaagttaacatcgaaatgatcatgtatccgaaaaacacagaggacactcttgtccatctcctgaaggagcagcatttcaagacattcatactactgccgtacaacacagagttagtttttactatcttccgaacaaatttcgttcccgtacatacatgtatagtttcatatatcatctcacgcaaattgcatattccaccgggtccttttacttttcgacttggaggctagcagagtcaatgtctatgactcaatgaataaagatgagtctacttttgaccaagtttttgaacttatagacaggtgatatcatctgttccactgttattacgaattttgctattgctactatggggatctcgaatagtaattaatcatagcttgaaactccatgtagggcttaggatcagttccgtcaattggtctgcggttcttggaaagaaaaacttagccggaggttcaattttccagtgagtacatgctccaaaattatatcgaatctctaattcaaatataagtgtttattaaatctctcgtcgtttgctatgtatattgtgcaaagcagagccagggaactaacttgtgcggctactacgtatgcgagtatgcccactgcctttcaacccaaatctacaccacaagagagcccgatgtacgtataaaccattcaaaatttcattgcgtactatcgatttcttgtttattaattaatttcatacattcataggttattcacatgagagacaacctaacacacaaggaatttatcgcggctgttcaagaacaactgatgggattcatcaatgaacaagtccttgatcccgagggtgaattctactacgacagatcagcaattcataagatcattccttcttcttctgagataacaccgatgtcgaagccgtagctagagcacgtaatgaattgtaatacatgtctatatttatatatgtacacatttactttagcgtaaatatatattttggtcatatatgcacattgtcgacgtttgatgtcgcgattccggtatttgcatagtatggggatcgttggtactaggatatatgcgagattgtagtaaaagagatggagacgcggatttttatacaagttcaggcccctgaattgtcaagtaataaccctacatcctgttggccaaagccggtcgttgctcctattcatcataatcacaccagtataatatttggggtagcctatctaactgtagtcgatatggcggtctgaaggtctgactcgtagtcgacaacagggtagccttcctcctcgaatccgcatccggcgagattagagacagcgctatatctctcctgacggtatccgtaggcaccgtaggggactagccgtgcctatctctgaagtcgatatccggcgtcttgtcttggcgtatgttggcttgtatgttgtggcttctgttgttccgtgtctcctctcctcctagggggtcttgtatttatactcataggtgtccccttgtccaagtagaactagggaaaccaatatggatacaatccgagtagtccttgtcgtttccatgtagaactctggttgtcttcccttatccggaactcctcctatatccgcaggttgtttccgtataggacatggtatgtggtgggtcctaccgagatttagtcaacaactattaggtatgtggtatccaaaaccctgatagtagcccccgacttcaatgcaaatgaacaaattcatattctcaaccgcagaccttggagtaactgttatcgagctcacgtgaccattctcggtgagttcagagataacgttagacttcccttatcagcctcatgtgggcacctatagggtttgtttgagtcaatctccgatgtcaaccaagaaagtacagagcatacaactaagtctcccgtcttgctgtaatcgagaatttggattgaagtcaagaaattttatctcggcgggtacaccatctcttcattccgtattccttgtcgagacccaccaaccgttctcgagtgatcgagaaagcgcagaatctgcgacggagccttgtcaacatttgtcgtactcgccttagccgatcttggtatagaaccatagagacatggagtcttcgataatgccaaatagaattttcctgaaatcaatactcagaaaagaatattagatagaaatagcccccgagtgaacgctcaaagggtgacatgttataatatgtatggaaaactgaaaataaattaaatttacaaaccaatgttttgtatatgagcgtcttctcttttaccgacttcgatcagtcagtttgttgagtcatacactctccctagcccccggccttgtcgtcggagaatcgttctcggaggataaggctcttggacccttgacctgccttggttgaaaaaagcactgaccctagcccccagccgtgaaggtggaaaactcaatttccgattacatggcttggttaatacacacggcgagaactattacatgaccaggtcttacatggtcgtttgtctctacctggcgcgccactgtcgatgggagatacccgtagaccggatatagagggtattagggtacgctggtacgaggatctacgtagtacgacatcaagcaaataggaaacaaggattatactggttcaggccccttgataggtaatagccctaatccagttgatattagattatatagtgaaaaccacagattataaagggaatagcagaactctatgataccgacgagaccgcagtcgagttggttcgattagatcaccccgatgactaggctcctgaaggctccgactttgtaggctgtggtggttgtgttggcggtgagattcgatgccttagatcctcccggggggtccctcttataccgcaggtcagttggtctccaagtagaactcggagacatcggaccctacacgatacagtgacgacccagttctatccgagtaggactccttccatctgtggactccatgatgaatttccttaacatgtacagagaacgtccgtatacgcgcaggtataccataccagtacatgacgtatatccaaggatagagggtataccttatccgtaaccctgacacacataaaatgttaagtgctttaaattatacgtgtctaatacatatatgtgtattttgtacatatacatatgcatttgcatatatattttttttgaaacataagacggtaggagatctaccggatatattagaagagaattgaccctgtttataaggaaaatagggcccgaaaaccgtacagctgcacagtttgctaaagggaaactggcaaaaccttacacaaaagacacaaaaaacctgtgacaaaacgactagacccacagaagtgatccagagaagagcaaggccttcaaggcgtagcctccaaggaggtgaacaatgacagaagccgctgccaacgcccgcccaaaactggactgggttttcacccgaagtggagagagtccacaaggcaacacctccaatgaggaaacgacacccataggcatcgatgtcaccgatcctagaagaccaggcagggctgtcgcccaagactccctcaagaagtacaggacctctaagaagctagagcaagagtgttgagtgttatcgttgcctagctcatcggctgaacccgatgacagctccaactccactttaacacaaaaactctaacaccgtagggggtaagcacatcgctccacactcggcacaactacaggtttacatagccacagggcacgtgaagcatcggcgaggcccaagcgcccttactaccaacagactagaccaccaacacggacgaaaaaaactcaaccaccaaaagactccacggccggtctgggagcaggcgaccaagagaagggaggagcatcaaggaggggaggaggcctggccggtctgaaggtgaaactg

SEQ ID NO: 32203 - DNA, 1905 bp, Oryza sativa
ctgcttgtgccgagacggtagaaagaggaagaaagagtagggaaggaaggagataacatggtggctgccagcgactggagcggtcggagtcgccgacgcgaccccccggcaggacccaatcccaccgactgacggagacagccggcgcagctgtaggcaggccatgcgccgccccggacgccgacctgccgcgagcgccagccaccgccggccaccccgcgggccgccaccaccacgctgccccgcgccgcaacaacctccgccgcctaatcgcctccacatcgtgcctcccgacgtcgccgtcgtaggtccggtgacggcggggccagatctgccgccgcccagcctgggagaccccgtcgtcgccgacgaacaccgccccccccccccccccccgcccgcgcgcagaggagaggcgtcaccgcgagaaggtcccaccgcaaccgtcctagctcgtcagccagttttgccggcggcaaggtgaggtagagggggagaaggaaggcggcggtggcggctagtgtttcgccccccgtgtcacctgcgcgggggcgacgagcttcctccgaaaatttcagtatatatcctatttgcatatatagatatatatgtatatatatgtatatatatatatatatatatgtatatatatgtatatatatatatatatatatatatatatgaaaatgaatctgtacacccaggtgtttgtactcccgctctaatccaccgtccatcaaaggtaagcaccgatcattccatcccaccctcctaccaggtctttatattaaacccgtttgatccttttctttttgaaaagaaattctattaattctgaattatcccggccggttatgcatatatatatgtttgcataagaaaagaacggtttgttttttttcttgggccaccgtacgtttcacatcaaggcccatagaagagtccatctccaccttgaccagccactacacagtccacctctctcttccacttgaccgaggccgttcccaccctccaccgtaccgatctctccacctccccctcctccgtaccgatctctccacctccggaccgagtatcgagtgttttccctatatcatatatttgttgtatcggatttgagatgtttttataaaaactgaacctacatgatatgagcaatccttttttgaggtgatccaatattagttttgttctttgcatttgagtccctgtaatattcatatttacatttgagtccttgttcgaggttagtggttcagttcttgttgaaaaaaaaagtaaaaaaataaaaaagaaagaaaaggcagaaaggtgcaaagaaaaagaaagaaaaaaaaagccgcacctaaaaagaaaagaaaaaaaattgcagaaacgtgcttaaagaaaagccgcaccaagaaagaaaaaaaaccattcatcctttgagtatgttttcagagtgcagagttgtgcattgattcatatctagtccttagtgttgtcgggtgcttgcttgagcaagagttgagtctagactaggccaacacattgactagtactttgaactattattcaactttgcattttctgattagcacatttgcgttcctttgctactatatattgtgccttccaagctacacatatatacttctggtcagcaccgctttgatccttgcaatcgccacatcatgtccttcatggtgtcacgaaccaaccaccgattgtaccgtccttagcattgctggtaagatacttgtaagagcttggtaaggtgctccatttggctaagttgttgaggggcaccactacaccgcgtagcagattattagggataacctttattgtttgctgttgtttttgtgtttgcaatgacaggtatgagtggcgctcaaaatcagcgataccaacaaggtgcac

SEQ ID NO: 32204 - DNA, 7593 bp, Oryza sativa
agcatgttctttgttgtttggtaaactatgggtatatgataataatggtttgcataattttgttgctaatacatacacatttagacataatggtcgaaaaatgaaattggaaccataagcttttctgaaattttcaaagatgatcttgaaaggttgaagaatagaatcaatgagactttcagagataccaggaaagatactattgtgatgccttcaactaagtctgagttattacaaaacgaacgtattattgtgcatattgctttggatactaatattttgcaggcatctgagaacaacaaaggtaatgaggaagagaagaaagacgaagaggaaaaaaacctatacatagctccacgcatgcttgaggaatgtttaattgaccaagtgcctacaatttctgaagatgagaaaaaaggtaaagataatggtgctacaagtgctcaaggtatgcatagttataatgtgccaactatgtccactacttgtgctaagttagagcaacccatagtggaaacaattgttgaaatacctttgtcacaaaacaaattgcttgatgtctcttgtgataaagaagagttgtgtgatgctacacttatatccatggcacaactagtgaatgaacatgttagttctatagtagagccacccagtgttgagtttaaacatgttattcacattgctagcgagaatgaatagcttaaattgctatattctttaaatacttggggttctattcaatttgatgatttttgtccactcaactatttagagaagaaattatttgctagatttgaattgccatgcccttctgatgtgatttttcatattattggcaattatgatagtaaaggagaatataatgtgcatcaattatatatttgttcgaatttaactatacttccttttcatgatgaaatgtcttgtctagaggaccgcatgcatataagtaattaactatctagttcctctagttatttaaatgagttacaggttggtttgcaagaaggggagtgttgtagtttttcgactacaaagattttaggatccaatcatatggacatcaagaaatgttcagcacatgatattgtgatagacaaagataagtgcaatactctccatgacaaggtgaaactgaggacggtttctaatcaagaaggggaggatgataaggacacaactagctcggatataactatgaataccttatgtattaatcaaccaaaggtgcatatgttctacattatatttacatgttatatatttgaacaaacgttgctacacaatgagtttcctgtgtttttgtttgcagaggttcttgcttgggcgaagaaaaagagaccgagcgtaacgaattcattgatgatcaaagaagttgattggggaccatatcaaggccttcttcaagtccacttccatctcatcatgtcacttttggtccatagaagacaagagataaagttctacacgttttggattcggattcgggcctcctgacagcatcaatttcaaacagacctagccgctgatctagaaggaatttcggggcccatgagtacttgttggaaagcttatggggtctactttcagattgttttggttccacgtcaaaattcttaccaagctgccgggaatctgcaaaacaagccacgtacctcatctagtccgaatctgatttgggttttgggccttgatattgtgtcgtgggcttagcccaagggggtgtgcgccctagggcaaccctaggacatccctaatcatattaattcagtagccttcatcgtttagagttgggttttgcttagattattctgtcaagaatagtttcgccgctagatcggtttttggaaccccaaattcaagtgcttaatcattcatatgcaatttggttcaatctatcatgttattgcttgtgttcttcgattcgcatgcaagtattagccttctcggtgaggtcaaccgggtttcggcacggttcataaccagaggagacgtggtgctgcgattgcggggcaaagtagcatgtttgttcagaagccggattgagttgtgtcgcgacaccacccaaatcaactgtttatcaatacctatcagaagatcaggacctaactccctcatcagttgcatatgtatatgttttgaaacatatatatatgcataatatattgcaaataaaaaaactggatcaggctgagccatctttagtccctgttggtgttaccaaccggaatcaaagatcgatctttagtcccagatttttcacccgggataaaagatagtgatctttagtcccggttgaaaaaccgggactacaggtgtcgggtcccaaaactaatgacatggatccgacaatgattaatgtatcatgccgtagatcagtaaatatttgatacatataatacagctggttcttcattgcatatgtaaagtttacaatacttgggatttacaaagattgttacttaactaattatacatagggttactattgtacggcggaagtctattgtagtttgactaggaaggaacaaactctaagggttctctaaattatcagggtcgtcgtagtagtacgtagtcataagggtcctcctccggacccagatgtcaaaaagggttaaattgagcaagggtgagtattcacaatactcagcaagatattgtggaaatatgttatgcatggatatagagtggggttcttttcataaagcaaatataggcaatctggtagattaagcaagaatttaacaagacacaattatcaaatttctaacaaaatattgtatgagtccaaatgctcaaaaccgtgagcatggctattcaaatagattcatatatactttactgtagtaaatgtacgctttacccacagcccacgacgtgccgataattatcagcttaagtcatggcccagcattaggttactaacaatagtggcacatgttccatgaactctagtccccatacgctctgaacgtacgttatcagcagtgtgaggagttctggcgttcctggggtatttagagagaactgattgtatgataccatgccatcgcaatcagggtttaaataaatcacgtgatataataattcatcttaaatatttacctgcgcctcggtaaatattaccattgccctgctcggcaaaagtttgcctactgcgcgaggacttaaacaagaactactatatacagaggtaccacattgttaaataacataataactaggtctgttcgcatcctagaaccgtggtcgtactcatttgttcttcacaagtatttcggtagtcttatgtcggttgaaacagtactagccacccggaaatcaaccaattctagcgtactgttccaatctaagtatagagcattataactagattgtaagcaaaataagcataactatattatctgggtttctatggttgaattatgcatataaaagagatatttgaaagaaagtgtataaatataatttattgaaatataggcttaaatgatcaagaggtgaacaataacttgccttgctcgatgtcctgagattgattggtaatattcaaaatctcataagagtcctcaagacctaggggtagccattcaaaaatcaagtttaaaaagaattcaaataaaatccaaaaatgggaacaataaaataaaatgataaaatagcaaaaatagactcagaaggtagagaatgaatttagaggaattttagtccaagtttcactggatttggatctatattttaaaagttatgggcttctaaagtttgagattgaaattaaattgagaaaaagttaaaaactattgtgcatggtcccaccggtcagtctctctctcttcttcttcttcttcctccggccgttctctatttgtggccggcggcactagggttggggattgcggcggcgattggagggggaagtgcttgcgggcggagaggggaggttgctagggttctccggcgacggtgagcggcggcggaggggttaatttactgtgtaagtggcatgacggctagggtggcggcagtatagaagagtcgtaagggcgattgggattgtggaggttaggcatggctcagggagtgtattggaagcatctctagtgtacttagaagggtttagaaagcttaacaactattgacaaggtgtggaaggcatacggccgcgagcgtctccattggcggccgtcgagctcacgtcggatgccgagtaggggttaaattagtgctaaaggaatgcaaaaacggaatctaggggatacgtagatgcttgaaacaaaagagctcactcagttagcttgaaacggtgagatgcggccggaaaaacttcatggcggcaaaaacaaggcacggcggcggtggcggagctcgatcgaatgcgacgaggtgaaagtcattgcagagcttcggcttggtttcggaatgatgaaacacgactagcagaaggtgttcggatggttggttaggactaggtgtggaggagaccgtacactaggtgttcgatcggcggacggcggttgtgggtatggtgtaagggtggaacagggattaggtgtagcatggttgtggtcgatggtgattgatgatgaatgagagagggtctggggtcctatttatagggccttgccgatcggatgagctcaggcgtggtgatcgccgttgatgagctcaaaagccaagcttggcagagatggcaggggttgtgagagggaagggaatgtcaatttgggtggcgggagaggatgtttgaatgtttgacagtggctgcgtggctttaccgggggtgaaaatggttggcggcgtgctagtgccgttccgggctcgacgcacggcggcggcgaggaaggaaacggttggttcaacagcggttggttcgattcatgagagggaaaagttactgccacactttaactcaaacgcgcggcgaaatttggcagtttcatccgtggtagaggcaaaatcgacctcagcgttggaattaggtgggcgcacatgacggcaggcggtggcaaggctgcggcggcggccgtcccagattccatggtgttgacattggtgtggtggcggtgaattagggtgcactggacggttattggcgcgccaaggcgatcggacgcgcgcggttggccttgagaccgacgcgcggcggcccaacacgcgcaacatgggacgctaaagtcgagcggcagagggcagaaaggtgatgcaaagtcacggtttttagagggttgtggtcccctaggatctaatctagacattgcaaaagttgaggtggagattgggctacccgggctgggctagacatttcatcgagcactttgtgtgcgataaaccgtacttttcaggaatttgaatatatttggctaaaaagagaagaatttacctagggtctttgaacaagtttttctaggtttttgaactagggcatggttaggtttcaaaatttgaaagaattttactagagacactagggttttaagttaggacaattattctagggttttagaaataaaataaattggagggcttctaggagtaattcttgaaccaaaattaagaataaaaaggagagctttaaggaagatttgaatgtttaaatcaagattaatataagtcaaaagccagcatgatgtagtcaaattttagtttaaaatttcagtatgttacaacagggggttacaaaccgggactaaaagaaggtttctcaaccagtgaacctacacctaacttacaaaaccaatacaaacgaggcccctcaacagtattatccccgcttttggctgaaatggcacctacgtgattccttttactaggtcttcatcccacgtgacattgacatggtgcttacaagacagtctgataaaaaaaataaaagagcaaaattgaaaactaaaaatttaaaacaaaatatacagcacccacatgtcagtcaaacaaaaaagtaaaaaatagtgggacatgcatgaccctctccacctctatctcctcgccgactggatgggcttcctgaaccgtctccaggctgtcattgcaacggaacatctcaggcggtgcgaggctgccacgggatagaggagcggtgcacggcggctagcgggagaggaccccggggttgtcgctggcagagagcagtgttggcactgcccgagtttgcctcttgaactgtatcttcctcgcgcgtcattggtaggggtggacaaaaagctcgaaactcgtggctcagatcggctcgtagcaagctcggctcggatcgattcgaactcgtagtcttaacgagtcgagtcgagctagccttttagctcgtgagcttaacgagctagctcgtgagctactcgtttagctcgttagtataaaatatcgccacatcttcatgaacttagtgtttgttgactagtgcttagtcttttaattacatcaaaactattcatatttagtgagtactatattagttagtgtttattattatgttaatacataataaaatgttaaatttgaaactattaatatgatattaatgagatatagctcgttaacgagcctaatgagcttaacgagccagctcgcgagccgtgccgagctacccttttagctcgttaacattaacgagccgagccgagctagctcattaagacaacaagctcaaacgagccgagccttaacgagccgagctggctcgttatccagccctagtcattggtgtattcatcgcccatgtcgtcgctgcgagctgtctcctttccctcccagactggctctaccaagctcgccggaatgtgggggagaggagaggcgcagggtggccgcgcaagagaggagtggcgtggtgacgggagagaggagtggcgcagcggcgagggagtggaaagaggagtggccacactcctttccctcctagatcgcctccccctcggcttgcctccccctcggctttggctccacaaagttcgctggacggtgggggagaggagcagcgtgcagtggctggtgggagaggagcggagcgcggtgcggcagcgagacaagagtggcacgccatgtgggagtggtgtggagctatggacagctaatggaaatggatcttcgctggcggccgagttaagagggccaccagcgaagatgtacaccttttcgttggctgcccacttaaacgtccgccagcgaaaatagcgaaaattcgatttttgcaggcggctactatagagcatcgccagcgaaaaatcttgccacactaaaataaggcaacattaaaaagacaacccatggccatcgccacccatcggcaacgggtccagcggcggtgactcttgcaggcggtgactcagtgacggacgagggggctcacgaaggtcgcggcagctgctcgggaaggcgacggcgaggagaacaactccaccgcaggccacaggttggacgccgatgggccgcggggagaacagatccaccgtcgtccgctcgtgggggcacggatccgccgcttctaggcttctccaaccccctcccctcacccaggtttggcaagcggcgggtcaggtcgtggactttggcgagcgacatcatgggccgtggatctggccgctggaggtgcgcgggaga

SEQ ID NO: 32205 - DNA, 2972 bp, Oryza sativa
tggttagggaaacaagctaaaacttgagctcggctcggctcgtttcctggcccgagccagctcaagctggcttgcaagccttcctgttgaaacacctctctatatatattttgtaattattaaaaaaagcaagaacaaatcattaacatgtaaaatttaaataagtttatatattcaagtctacaaaatcttaatgataaatttcaagtggataaataataacgccatataaagtgaaataatcgatataaacacacaatagtctaggctcgcgagccaaaaacaagcggctcgcaagctatatcggcttgactcatttcagcaacgagctgaaaaggaggcttgggcttggctcgtttggcttacgagccgaaccaagcctgagctgagctcacgagtccgagctttttatccaccatcagtcggagctggccttcctcacgcggctctaccacaagcaccttgtcgtcttcgttggctactgtgaggagaatgacaagcagctgctcatctacaagtacatgaagaacggtgtgctcaacatcacttccacgatggcagctcgatgacggcaacttagctccggcaacgcatatgttgatttggacaatgatttgggattgtcattcgggatttgggacaatgatttgggattgcgattcgcgatttggaacaatgcttcagaatttgtgaaactgttttggacctgaattttcaattctttattttttctccacaaacgttttcgatggcgggtctcttaacattgctgccagtgcggccatcttagcttcgctacgaaagaaaacccattttcgctggcggctgtcttagcatggccgattttccatggcggcaggctgtccgactgcacaaatgcattattttcactggcatttggtccccggcggcaccgtcggccgccagcgaaaacccaatttggcttttggcaaaaaatcattttcgtagtagtgcctctcatactcaaattcacatatggcccttaataggattaatcccaaatttgctaccagccgcatgcaactatgtaatcgtagtttgatatgcgttagctatctcctaattgcatttgctggtgcactcagcacaatatataattttcacggactagtttaaattccactgtaccggggtaatggttttggagaaacctgcacgaacaaaatacagacactatagatggacaataacccatgatatagagtctacacgcaagtctatatggttcagacgatatatcgtataatatacaatagtcatatatgttttacacttatgcagatagacttaacatgttcaataaaatattagagaactagcaatgctgggataacggatgaaaccagagtagtcatgggccagagggaggtggtagagcaaggtccacggtgataactagctgaggagagacggcgtgtcttcgtggcacgtcgtgtctaagaatagtggagaggggttttaattggggttaaaaccttagctatatggtcctccataaggccactaggttttagctcctgacataccaatagtgcatattggttctttggctagaccatggtttaaaccacaattttatggtcaacactcatttttgatgttgtccaattaccaggtcaacacggtataacccaatcattgaccgattagacggacaaacaggctaattgacggtttatgccctaaactggacgataacccatggtataatgtctagacacggtctagaccgtctatactatggtctagcgaacacttgatacttcctccatcctttataagaaaccaaattttatctatatatccaagggagtaacaaattaagtggtatatatatatatatatattgtgtgaacacgtcccatattgcattttttgtagcggcaataaaaaaaagtagttttaaacggtatatattgtgtgaacgtgtcccataataagtatatttttggcagcaacaataaactcttgttttcttgagctggatacacccacacgtacgtgtaaagagtttcccactttattatttgacatttagctattttctaattaaagcttttacagcctttctggagcaacctgttcactgctcacaccacagtaaatgctagccattttcagcaccactcttcattgtcaccaacgggcaccttctgtcttcaccacagtaaatatttgccattttctgctcagatatagatatatatgaacgtgcacctacctcgttttctcctggatctaccccaaccttactccaaatcctctcttcttgctccaaatcatctcccttctgtctctccttcccttcttggtttcctgcttctatagacctagctagggcagccatggaggggaaaccatcaggtcttccatcttctactggtggcaaaggcaagggtgtaccagtagtaggagctaacccgtggcattcagatgacggctgtgatggaagcaagagtagcagtgagagagagaactgtcaccgatgattatttcggaatatttgtgcatcctgttcatggtgatcaggaggtggattctcgtaaggctaatcgccatgaagcagatcattcagaaaccgatagcgagagaactggaagtgctggctttgggaagatcgcaaatagtgcaggcaattctcgccatttctcatatgtagattctgggttgagcccagaagaaaaaaagacagaaaagtgaaaggtttcaacctgaggttcgtgaattcctatcatatcctgattttttttgtgtgtccatgatctttttatagttcatcaaacaaaaggaattgcaatgcattagtaatgatgagcatatcaaacaaatggtgctttatctcagttattctcgcaatccagttcaatgtgatctcctgggaaaatttttttttactagaaatgatcatatcagctctggttcagccatagcggcaagcaaaacagaagtaa

SEQ ID NO: 32206 - DNA, 16299 bp, Oryza sativa
aaagatacaattgatgaaatttcaagaaaatcatatgcactcaggtgtagagcagcacagtgatgtttgagccaatatttcctatgacattaattaatttaaaacattcacgaaaccttgtattgaaggacggttgatgactctcacaatcgttatatactttcagaggattctaagtggtggcagcgagatgcagactccaggagcgaatagttatggagcgaatagtggtcaccagcgagatgcagactccgggatgtttttgtcgttctcagagaaaacacaagtgcaaacaaataaggatattcctgaatcatggaaggttcatccgagaaaagatgaggttgatccagatggatgggtcgtcgagatccatctccgaaatgatcaaaagaccaaggacaaggtttgtgaattcatgttatatgttgatcgattatatttgttccacgaattttcatgattgattaaaagagttacatgtattctttcccaattttatgagcatatcatgaaagaagttttttttaatatgtgcttcgttagggtggatatcattgttttggggaaagataaccagccctatcataaatataacaagtagtacatatgattctatatcttcgcagcatcaacatttctgaaagtcttggtgattgtacacatgaaatagaaatcttagagatcggctgaaaaagataaaatgtacaagagttcttgacatgaagatctcctttgggtgttatatgtattatttatttctttgtattaaaccaaacatgtgtacacttttaaaacatttgtactttgtatatctacagtataaaacatgaaacatggaatagttcaaatccaaacaggtttagtagttcattaaatctgaaggttaagttctatcttgtctagcaaaaacacttgttatgctacagttcaatcatggtaattaactacttgcattgatagcatatatctggtgggatatgatcatatctggccaatatattacattgaaccatgggaatgcatagttctttacctagtaatgacttgtggcaggattgagtggtttgtaaaatttcattcctttttaatacatattcttgtttatatgacatgataatttgtgtggagtgaaaaaagagttctatcacttatggagtgttcacaatctgtgttataatactcaatgaaaacataggtgtcattttataaaaagtaatatgtacaaattaaaccaaacaattttatgagatagctacctttagtataattggcatacagaaattatatttgacttttatttttcatataatcactatcaaaacaaagtatgttgcacatcaataatatatcttcttgctaattcattaatctcacttatcagttctaacaatatgaaaagccagaacatcacaaatttaatttggatcaaaacctctatactgtgaatcattaattgcacctagctttgggtgcctagctagggtcatacatgtgatgcaatggcaatataagtttttccctcccatccccttccaatcaaagagaaaagaaaacaaaaaatgcagtttggattttgctgaaatatacttgcttatactaaatttattttgttgttcgtatgttaaatgaaattgacttttttcttacttcgctgtattaccgccacaaggattacaatcataaattttgctcaaagcctgaagttgaattttttctagatactggaaaggttataatccgtaaagttccatgtattctacagaaggtgccctactacaacagagttgatttcaaatactgtattctacttctacataatctctgtttccaaacttgatactgattctcatacattgtgtctgtacagagatctgctgatgcaagtgttcctagcaggggtaagatatcatcaaactgtgcaccttggaattaggaataccattgcatttttactaatcattgtttggcgaatatgagttgtgttttagatgaattatatacgggtagaactgcagtatgattaaaatatatatttgattgaactggatcagtactactgacagaaacaataaatagaaaaaaatacatattacaatatttatttatatatatctacatatgtacaatcatgatattttagattatgttcatcttgctagcttgtatatatttttaaaaatttaagcaattttacagtttttgaggagataccatgaggtaccactttttctattgtaaatttagtacctcttagtacttatgtactatgaggtatcaaattttacactaaatttttttttaacatggtacctcctcaaaaaccgtaaaattgctcaaaaaattttgtcactgctaaggagaaacgttgctcacttaatcggactactatgacatgtgaacacaggtcgcggtcgtggcagacctcgtacaacaaggacgatgaccctaaattcaggtaatgtgcttttgataacagaattttgcattgttgttttttcttaaaatatatttactactcattgttagctctggatagtgaatcagaatgatatattttcattttattccatgaaacttgcgtaacataaaatgtggcccaaagtgaaatttcactcttaaacaaaaacaagatgaaacttttttttaaccagctgcaagtggtcgaacgattacgtgggtccgccggcggatctcacatcactaggatggtttgtatttcctgtgttgagcaatgtctaaaatcgtttaagcctgtgtttggtccacctctgagttgttgcactggcaactaattctgaaaagaccagtgttctacctttgtggcatgtgtgcttctttaattattgatgttttgcgataaagaatcttcttttggccagcaacgatttattatatctatatatattgttatataattgattgctgcactgtttcaattcaaaatattgcaggcctatatagtttgtttcagaaaagatttatattcttgttcaccaattaaatatgtctgtttcttttttacacaggttctggtatgtctgcctctggagggaaaggtccagaatcccccttacaacttccgcatagttttgtgtagtcaatgcgtgtggagattgtggatatcccatatctacacggcagttatagtttagttgggtacagggtaccaaatatagatagaatacctttatgaggattcggttagtttctaaactcgtatatcaaggaaatacccaggatcctagtcggttacgattgtattttatctgtaatcacatattccgttagggatatgtgttgtattttgtaatacggactccttcccctatataaggaggggtccgggtccctctagggacacgatttttctcgcagatcatacaatcaataatacactcggcggaatcatcctcggacaggagtagggtattacttcttgaataagaaggcctgaacctgtataaaattccttgtcttcaaacccatccacttttttagcttgatagccacccccttttagtattgccgaaatcttgtttcgacagttggcgcgccaggtaggggtagcgtcaagtttcttgccgatcagtacgatgggttccgtctccggcatcgacgacttcgtcttccctcccgggcaggcgtttcggttcggcagcctcgacttcatcaccaacgactttggcaagatctctcctcttgactcggatccaaaccagtcgggaaagaaccaggtctcagccccgtttggtattccgaacaaggccgagatctactccaagcttatctcgaccgagtcagcttcaaaccacacgaacgagatcccatctactccgacaccactagatcaagattgacggagcgtggggctcctcaccgggagaccgcgcaggcccccctttgccggttcggccgggggccctgggtgagactctaagctccttgtctgagtgtggaaggttcgcgagagcgaaaatacacgagacacgggcgatgtatacaggttcgggccgctgagtagcgtaataccctactcctgtgtttttggtggatcagtgtatgaagaagctacaaaatgccagcccccgatcgttctaggatcgtttttctccctctttcatccccctctctaagtgggcaaggtcctccttttatatctcaaggggataccacatgcaccatctctccctctctttcttttgcctggggactcatcctctcttccctccaatttgacttctcttcattaacggacggagatttgcatcgctgtcgtccgaatgaccttctgacgggacggcccatacctacctccacttccgccggaggcaggcgcgacgtgggaaaatggctgtctgctgatgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccatgatctgaccggtctgtgactggtcacagaccggataaacgagcgcgctgcactgcgttacatgcggcgtgaggcgctcgtcaaaactgcaataaatgcggttaggtgagccccgccatgctcacctaccccatatacgcggcgcaaaacccacaaggggtcggggcgcctcggccctcggggccgagacgggagcggtccgacccctcggggagacaaagagaagggcggctgtatcaccctcgggcccgacccccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacagtatcccccggcgttatgccagggcgatcgccctcctcgagggaagcggtcgggcgtgacgccacttcctaaggcctggtgacaggtggggaccggtctccacagttgggcagaaacccaacggccacaaatcacgcacatcggcaatggttactcggctgtcaataatgagcggtctcttcaagactgccacattactcgagtaacacgcgaatcgggacgagccgattcgttttgcctggagatatggtgatggcgcttcggtcggcgcgcgcacaagatgttccatctcgactgccacagccgcatatccacctcatacaccgcaaactggcgaatgggattagtggaagcgtgggcgcgggaaacgagggggcaagatagtgggcgcgagaaacgaggagccgggcatagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgttgccgccttcccgcatcgtgagcgagagacaggccgggctgccgcgccgcttcatgccggaatatgccaccggccgagagatagtctcgctgggcgagggatgcctggcgccacgctacccggggcggtccgtcttcttcctcccttttgctatggcagggctggttccgccattttcttctttcttcatggatgttctggagttttacgatctccagatggcgcacctcacccccaacgcggtcatgacattggccatcttcgcacacctgtgcgagatgttcatcggggtgcgcccatcccttcggctgttccggtggttcttcaccgtacagccggtgtcgccgccgtcggtggtcggtggctgctacttccagccacgggggccggtgctgaaccgctacattccctgcgccctccgcaagaagtgggatgactggaagagcgactgtttctacactcccctcgccgacgaagcgcgcctccgacttccgagccagcccccggcgcaggcctccaactggcgggcgccggtagatctgggagatggctatgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggagtcagatgggactgggctcctgaggacttcaagatattggtccaacgggtgctgaatctcagctccgtggaggcatccatcattcctcaaggagtcctccccctctgcagcgctccagaccgtgcctccatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcagccgccctgccgacgcccgggggaagaggaagcagggaggaacccctcccccatctcctccccgagggggcggggtggcgcgggccagcagcaggcgcccggagggggccacgccaacgtcgcagcccgaggggaagcggaagaagaaacggccccgcaagatggggggacagaaccatcccggggaaacctcatttcccctccaaggtggtcgtgtaatcgaccccctcgcaggttcgtcccacgcccatcgtggccgtattcattccctcaatgcgagttttcactcatccatcttgtttgtcttctggtctttcttctatttcagcgagatcccgtcgcgtccctcccgccattccaagtccggccagtctgaggccgaggacccggcgaccacagaggcccggaggcgggaatctgaccggcgagaagccgcagatcgccttcgggaagccgaggaggccgctcaggaggccgctcgggctcgccagaccgaggaaaccattcgggaggaggccggactccgccaggccgagacgacgacatcctccgaggcgacccgtgaaactgaccggcaagaggccacggatcgccttcgagaagccgaggaagctgcccaggtggccgtccgagctcgccaagctgaagaagccgctcgggaagaggccagacttcgccaggccaaggcggcaacgacttccgaggcagtttgcgacgagggcgcgggcgcatcgcttgggcccaatccctcgggcgacgctcaggacaagccaggtccgggggacatccctgagtccggcacgtccctcggcgggccgagccgcgcggcatcctcaccgaggcggctcttccccacgccttctgttgctccactgagtgcagaacccttctgcaggccttggccgtcgcaaacaccacggtgttggacgggttaagtgcccaggtggaggccctacaagcagagcaggcagagatcgacgccgcatgggcgcgtgtcgaagaggggcgacgctcggtggaggccatggtggaagtgggccgcaaggcacaccgccggcacgtctcagagctcgaagcccgtcggaaggtgctggaggagattgccaaggaggtggaggaggagcagggggctgccctcatctccaccactgtgatgaacgaggcgtaggacaccctccgccttcaatacgggagctgggaggcggagctagagaaaaagctcgacgccgcccagggggtccttgacgctgccgctgcccgagaacagcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacattggcggtgctcgaagccgcctgtgccgaagaagagtccgcgctccgcctccgccaggacgcgctcaccgagcgggagcgagctctcgaggaggccgaggccgcggcgcaacggctggcggacagcctgtccctccgcgaggctttgcaagaggaacaggcgcgccgtaatctggaagatgcccgcgccgagagggccgcgctgaatcagcgggccgctgagcttgaggcgcgggagaaggagctggacgcgagggcgcgcagcggcggggcggccgcgggcgaaagcgacttaaccgcccgcctcgcagctgccgaacacaccatcgccgatttgcagggcgcactagactcgtccgccggggaggtcgaggccctccgcttggcaggcgaggtagggcccggcatgcttcgggacgccgtctcccgtctagaccgcgccggccggcaagtgggcctctggggcgggcggactgcgaagtacgccgccaaccagggggcctcgcccagcgcctctcggagatagccgggactctccaacggctccccgaggagctcgagaggacgattaattcatcctcgagggacctcgcccgcagagcggtggagctcgtactggcgagttaccaagccagggatcccgacttctcaccatggacggcgttggacgagttccctcccgggaccgaggatggcgcgtgcgcgcaggtccgggacgccgccgaccatatcgtccacagcttcgagggttcggcccctcggctcgcgttcgccctcaactccaacgaggaggatgatgacggcggagtgggcgacagtggcgacgaggctggcggcccgggtgcatcggagtgagcccccaggcccccgccaatctttaaatagtttcttcttttcttcttccgaggccttcgggcccccttcttgtatagactaatttaatctgcaatcaaataaagaagaaatttttcgtgtcaattctatttgttgtgtgtatgagacaaggatgtttgtgccgcggttcttttgtgtcttggcttgaacaagggctcgtgcccaggtcctagtcctcaaatggctcgggtcggggctagtgcctggggagatccacatgccgagactggccaggccgggagcgtggtgaccgagggttatgggtgacccgattgcgggtttttgccgattcccccccggagttcaccacgccccggggcacggctcggttctgggccccgtttggcgattttagccgacccgagcccccgagggcaggattgaacacgagtgacctatttcaagtcaagatctttcaaaaggaaacaacagcacagatacagcctttaggaaatcgaaaaatgcttttattgaaatacatatataagaatatgcacatgtggtagcccccggccaaccctgcacgcccgaggggggcgcggggttggccccagcctgaaacctgacacccgaccccccttaggggtagaagcgacgaaggtgttcgatgttccacgggttaggcagctctgtgccgtcgctcgtggccagccgaacggagcccggccgggggacaccaatcactcgatacggaccctcccacattggtgagagcttgctcaatccagcacgagtttggacgcggcgtaggacgaggtcgtcgacgcagagtgaccgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcgattcgcccagagcaccgctggcaactcctcgatccacgaatcgccatgcttcttgaggatgttgaaggtcttggttttaaggcctctgaggatttccgcattggcgcgctccacttgaccattgcttctggggtgggcaggtgaggcgaagcagagcttgatgcccatgtcttcgcagtaatcgccgaaaagttcactagtgaattgggtgccgttatccgtaatgatacagttaggcactccaaaccgggctgtgatgcccttaatgaatttaagtgcggagtgcttatcgattttgacgaccggataagcctcgggccacttagtgaacttgtcgatcgcgacatacagatactcgaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgccgaaaggctttgccaaccaaggtgcgcgaggcggagtgggctccgtattcgccttcatggatatcggcaagaagctcgacgccttgttcccgaggaatgcacttcaggaggattccgttagccgcgcgcctatagagggtcccttctaccagcacgtagcgtttggaaatgcgttggacgcgttcactcccttcgcggtcctcgggtagagtcttatctgtgaggtatgcttggatctcagcgatccaagcaatcaatctaagagagctgggagcgctcccctcgggtcccgaggcctggactccgacgggcctcgggggcctgtcaggcgcgtccgtctcccctaaggggtcgggtcgcgctgacggctgggcaagcctttcttcaaaggcgcccggtggggtctgggctcgcgaggaagcgagccgcgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcgacggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagatagggagccgtcgaactgcatcacccagtgggcggtgtgaggcggctgcgaggggcccgagctggcctcggggactgagacaggctcgggagccggggtccactctgccacaaaatcggcgagggcctggctcttgatagcgtggcgtggttcaaagtgcaaatcgaactcagaaagttcaattgcccatttcaccacccgtcctgtaccctctcgattatgcaagatttggccgagggggtaagacgtaaccaccgtgacccgatgcgcctggaaataatggcgtagcttccttgaagccatcagaatagcgtaaagcattttctgggcctgagggtatcgggtcttcgcatcccggagggcctcactaacaaaatagacgggccgctgcacctttcggtggggccgatcctcttcgctaggggccatatccctggggcgctctttgtccaagcggcctcgcggggtgcactcgtcttctgtgccgacgacctcagggtcgaaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagttggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgggccaagccagcacagggtgggggtgcgcggaatgaggattgtcctcatcgcgctccacaaccaacgccgcactaaccacttgcggggtcgccgctaagtagagtagtaagggttcatttggctccggggcgactagaaccgggggagagctgagatacgccttcaacagagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctggggggggcgcatccgctctatagctcgtatcttctcggggttggcctcgatgcctcgggcagagaccaaaaacccgagaagcttgctcgcaggtacaccgaacacacacttatcggggttcagttttatgcgggcggagcggagattctcaaaagtttccgctagatccgagagtaaggtctcttggttgcgcgtctttacaaccaagtcatcgacataagcctcaacattacgtcctatttggctacccaaagaaattcgagtagtatgttgaaaagtaggaccggcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaatgaccaccgggttcgccagccactccggatggatgacctcgcggatgaatccggcctccagaagtcgcgccacctcctcgcggatgaaggcttgacgttccggggcctggcgccgcactttctgtcggaccggccttgcgcccggccgcacggcgagacggtgctcaatcacctccctggggaccccgggcatatccgccggtctccatgcgaagacgtcagcgtttgcccgcaggaaagagacgagcgcgtcttcctatttgccatccagaagaccaccgatccgtgtggtcttggacgggccgtcgcccagggcaacctccttgaccgggacctcgtcgcatgtgactatccgctgcctcggggcggcgggggcggatgtgccaagcctctcgtcgccaccctcgggcttggacgcggcagcgaggtggtccgcgcgctgctccatacaagcaagcgcgactttgaggtcgccatggacagagatggggccaccggggcctggcatcttcatctggaggtaggcgtagtggaccgccgccatgaacttcaccaacgcgggcctccccaagaccgcgttgtagggcagactgaggtccgccacataaaagttcacccgctccgtgcggaagttggcggatccaccgaaggtgaccgggaggtcgatatgacctagcggccaagtgtgccccggcgtcacaccgataatcggctgggacggtcggagcaccatccctggggccttgatggcgtcaaaggctgcgggggaaaggatgttgagggctgctcctccatcaatgaggacacgccccagcttcacgttgcaaacggtgggggaaaccaccattgcgatctgtcctccccgggcaacgcacggagggtggtcggtctggtcgaaggtgagggcaacctccgaccaccgcgcccggcgcgtcgcctcaagagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctactgggagcgccggcctcgttctttttgtcgcccgcaggcctcccctttcgggtggcccgcgaagcgccctcgacggcgaggacatgaccctcgtcgtcggtatgggctgacctcttcttcctcctcctgtcacgccgccctgtctgagcagcggatccgggggcggtcgaagctgccacaccggaaccgaagaggttccaggtccatgcctcctccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaggagtggaccgacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcatggagggctgatccctgcgtccgtgttgaggtgacactccggacgaggaggcgccctccgttgcgtggggagctcgccgaccattacgccggcgctcgatatcgatgcgggcatctggccccccacgctgatcttcctgggtcggaggcgctgatgaaggagtggcggccgaatggcgagcaacagccgccgctcgccgcgccctccgccttgacgacacggagccggtggtagcagcgccagaggtcttggtggtggaggaccgcccaccagcacctaggcgctgccgtgccatcatgaccaagttggccacgtcgtccagccaacgttgggctggagactccgcgtcagggacaatgggagggtgacgtaggagcgcgcccgcagcttggagcgcgccctggggcgtgctgccgtcaccgtagacgaggaggcgacgctccccatctcgccgcccttccccatcacccgtggatgtcgaagtcgcggatccttcgaccctctcgagcgcctcctcccgcctaggactttggcgtggagggggcggtggagtgcgagctcgacggcgtgggtttggctccccgtcatcaccgctaatgctcggagagaggttgtgcgcctttgcttgttcggccattgggctgaacaggaaaagcttggcgcacacgaaagagtgcgagagctcagaagatcactcgcagagccccctacctggcgcgccagatgacggagcgtggggctcctcaccgggagaccgcgcaggcccccctttgccggttcggccgggggccctgggtgagactctaagctccttgtctgagtgtggaaggttcgcgggagcggaaatacacgagacacgggcgatgtatacaggttcgggccgctgagtagcgtaataccctactcctgtgtttttggtggatcagtgtatgaagaagctacaaaatgccagcccccgatcgttctaggatcgtttttctccctctttcatccccctctctaagtgggcaaggtcctccttttatatctcaaggggataccacatgcaccatctctccctctctttcttttgcctggggactcatcctctcttccctccaatttgacttctcttcattaacggacggagatttgcatcgccgtcgtccgaatgaccttctgacgggacggcccatacctacctccacttccgccggaggcaggcgcgacgtgggaaaatggctgtctgctg

SEQ ID NO: 32207 - DNA, 22775 bp, Oryza sativa
atttggctgccgtcttcactacaagggcgtcttctccccgtaggcctaggcggaagtcggcttcaacaccgatcctgcctagctccagggaagtcagtgtcatactccagccactcggcacggcttcgacggatcaattggaaggctacttcagctctcccggcgtcgactcgcgaccaacaaagatcgtggagtacgacgaattcggctaccgctacgacaaccgcgacctcgacaacttcgacgaaagcttggaagacaattacacccctctctacttcggcgtcttcatggccgacaacgagacggaggaacaacgccaagcccaagaagcagaagcaagacgcatacagcgggaggccgagcgacgccgactggaggaggagcgccaagcgcaagagcaagaatggctgcggcgagagcaacaagaacgcgagcgggcagcaaaggaggccgaggaccgacgacaacgagccttggacgcagggcgacgagcgcgagatctcatcgggcagcaagacgttgaggggacagcggtcttccgcaccccttaacagaacgctgtcgctgcgatcacccttctcgacaccctcctcaaggaagacgcactcaatcaagccgatcacgtcgtcaacatcttgaaccagactaagaccatgatcgcctcttcggtcccggttaactccgaaagcgtccgcacgccgactggcagccgggctccccatctccgatctcatgattatctgtcgggtcccaaaactaatgattcggaaaccgacatgtttaactatatcaagccctggatcagtaggttgatacagcttcaacaatctggatcgtctttgcatacgtttagacatagctttgaaggagatattattacataaagtaatatggtatttacgagattgtggctaactattacagcagaagctttaaaatgacctaactctgctgttttactatagacttaaaccatttaaattacctagacttgaagattaagttaaaagggaactaacttatgcgattgaactcctgacttcggcaagaacatcaaatggactctgagaaaggaggttgaagcaagggtgagtacaatgtactcagcaagctattatatcaaataatgaatgcatgaagtagtatttaagtagatctaggtttactggcagaaagctgagaataaagaggaagaaagcctgggatgtctttatgcaacaatatttagtaaaatcttgagttaagtttcgaaccaaataccatatgagtcccgatacttaattccgtgagcacggctattcgaatagtttcatgaatactctactgcagtagatatacgctttacccgtagtccacgacttgccaatattcattagcttagtcatgcccagtattaggttactaacaatagtggcacctgttccatgaactctagtccccatgcgctctgaacataacgttatcagcagcgagaggagttctggcgttcccggggtttttagagagaactggatgagagaccccatgtcatctcaaccaggttttcacaatatacacacacagcgatcgcaatataatcaacatatttacctgcgcctcagtaaatatcacatttgcccttcgcggcataagtttgcctccttcgcgaggacttatataagaaccactgtacagaggtaccacattgttaattaacctaataattaggtctgtccccattctaaaagctgcggtcgtactcgttcgtttgacataagtatttggtggcaattttatcgatcgagacagtactagccacccggaaatcaaccaaatcttacgtattgtcccaatctaagttcattaaattttatgcatattctaactaagcatggctaagcaaaatctagcatatatctggtttgctatatgttcaggttatgcattcaaaatcatgaattactaatgcatagaataaagctatagagtataggataattatgctcaaaggagaggaataataacttgccttgctccaacgcaaataaatccgagataggcaacctgattatccgatgctcgaaataccacaggttgccatccagaataaaatagactctatttaagaagaggaagaaccaaattcaataaaagccataaaatagcaagaaaacgatgaaaagcgagaaaggctgggtttggggtataactatctccttaatgggttattgagatagtattttatgcgtaggctctaatgggttggagattaggttggagaggggatcaagattaggctttggtggaatagtggctagggtttagttgttctcgagtcgatgctgaaatagcatagcatatcggctcgcatttcatgtttaaactatgggtagttggagggtaaatggctgatatggagtttggatggcaggctggcttgggtttcatttgattaagccaatatcgaggtaggatgactatcggctgggatttgcgtgtttgctagtcgtcattagaattgggtagtatgacgactaggtttggtgtctagccgatgtcaacagacaatataacggctagaaggataggaagtttgtgtaggtttagcggggtggaagtgttactcggacaaccgtgagtggcggcggagcggctaggatcacacagagcttaaaagctaactgtgcggcgtgctatggaggtcgagggaaatagtgaagctctgctcgttatacgcattgaggcgtaaggtgtcagaagcaacacttcgaccttaggtttgggttttgtcggactttacaaccaatggttcgacgtcggggtcagaaaaccgtgcgaacgtccccatggaaggtgtaaagttccaaccaatggttgtttagtggctaaacggtattttgaaaataaaagtaaatatttgaaaggtgaatataagtttcaattataagtttaaatcaaatatttattcaaatgatatttgaataaattaaagaaattcaaataaaatcttaaaatagcaaatttggtatcaaaaggtagggtttgaatttagataaatttaggtccaagtttcactggaatcggacctacggtttaggagatatgggtttctaaagtttgggttttgagttaaataaagaaaatgcgaaatagtactgtgcaggggcccacctgtcagtatcttttctttttctttttctccttcttcttcctcccgtatcctctctccttctgcttcttcttccagccgaacacagaggagagggagacgaggggcgccggtgctctagatggcgggggacggagacgttggcggggaaacatgttcccgagcgatgctcacccaaggaggcagtcggctggcaaagggagtgagggaagaggccggaacggcggcggcaagtgcttacctccggccgacatggatggtggtggtgatggcttgattcaaagggggagagaagggggaaaggggcaaaatggattcaccacatcgaggccgagctaatggcgcaaggttttgggatgtagggctgtggaagaggagatcggccggtggcaatggtggtggccggtcatggaggagagagaagaaagagagagatagctcggatggatggaaaaggaggagggtttctctggctatttataggcgaggagaggcggtggagagaggcggttctggagacggtcgacggcttgaccacggcgatgctggcgtgaaggaagaaaagacggcgccgattacttcgtgacgacggagggcgttggcggcggcgtgcgcgtgcacggcatgcgcgcttgcgggaggaggaggggcggctcagctatgggccgacttgggccgcgcgagagagaagaagaattcggctcaaagttaaaaaggaagaagtctaattttcctagagattcaaataatagatttacaggaatttggatggctagattttgaaaaaggatttgaataatttgaatttgaaggaaaattgactgagagagagtttagaaggaaattatatttgaatataatttccaaaagaaatatttctctagttggtttgagtgcaatattttggagagggagtttatttaatgcactcaaatagaaattcaaaatattcaacaccataaataatttggctctagatttgaatatttttgagtatgtggagggaatatggagggagtagagtaaataaatttttagcccaaaatatgtggtatgaaatttagagaattagatatgggctaaataaggttttggatttgggacggagggataaagtctattcacttagcacaagatcaattattcacaatatttgtaacaatattattcttgtgccaaagaggaaatcaagccacagagattaaattggtggctagatcaaaaggagtcctatttggatatttggattgagaatcaaaggatgggtttaagatcaaaggatgggctaacaattaattccaataaaatcggaattgctttggtttaggttctagcacaatataggatggtttcttggaccataattcataatagtaaaaagggtttttcaaactaaatttaaataaaggaaattttaggcgaaagaaggttttagattaaaaccaaattaaggaatatttcgagataaattttaaatgaaaatcacaaaggcttttgaatatcaaagagggattttatgcaggttagctttaggaggtctcggtaattatattttcctaagtttaaagaggtaattaagaacataaaacccggcatgatgcaagattagaaaatagctaattttcagtatgttacattatcaccagccaagcctcagcatcgccggcgcaggatccaatcgcaggagcaggggccacgacgagcgatctgttcactcgcctcccgagcgacacaaggagcgccgagttgaacgtcctcgctccccacttcgccggcgtcctgtcgatcttcgcgatacgatcaaccagcgccgtgcagcacgaggtcaatgccattcaccagatcgctacgacgacgacatggatggagtatctttactaacgacctgcgtcgagtggattggccagccggcctcaagccaactggaatcgagacgtatgacggcaccaccaatccggagtcctggcttaccgtctacggtctcgcaatccgcgcagcaggaggagacagcaaggccatggcaaactacttacctgtggccttagcggattctgcccggtcctggcgccatggattaccccgtggcacgattggatcatggacggaacttcgtgaccacttcatcgccaacttccaaggcacctttgaacgccccggcacacagtttgatctctacaacgtcattcagaagtctggagaatcccttcgagattacatccgacgcttctccgaacaacgcaacaagatctccaacattaccgacgacgtcatcatcgccgctttcaccaaaggaattcatcacgaagaactagtcggcaagttcgggcgcaaacctcccaagacagtcaaacagatgtttgaaaaagccaatgagtatgccaaagacgaaaacgccattgccgcatccaagcagttgggtcctacttggaagccaaagaaagatgcgccgactacgggagagggtggaagtaacaatcacaaggaccgcaagcgtaagcccgaggaacttgttgcgactactacacactcctcccgacaacgttcgcgcgtcaacacttttgacaagatcatgaactcccaatgtccgcatcatcccaactccaaccacacagctaaggattgcttcgtctacaagtagtttgcagagcaatatgccaagaatgcacagaagacctctgacggaggacaaagcacgtcgaaaaagaaggatgatgatgatgatgatgccccgacaggtttttaggatcaccgcaaggagctcaaccacatctttggcggccctctagcttacgagtctaaaagaaagcaaaagctgacagaacgggagatcaacgctgtccagcccgatacgccctagtatcttcggtggtcggagaaaacaatcaagttcgaccgctcggatcatcctgaccgagtggtccacccggggcggtaccccccggtactagacccagtggttcgcaacgtcaagcttcgcagatccctcatcgatggtggcagtgcactgaatatcctcttcgccaagacactggatgacatgcagatccctcgcaccgagttaaagccgagtaacgcgcccttccacggagtcatcccagggttatccgctatgccactcggccagatcactcttccagtcacctttggtactcgggagaatttccgcacagagaacgtctgcttcgatgttgctgatttcgagacagcgtatcacgccatactcgtacacccggcgttagccaagtttatggccatcccgcactacacctacatgatgatgaagatacctggtcctcgaggagtcatatccgtacggagcgacatcaaacaagccgtcacatgtgataaggaaagttgcgagatggccaaaacccgcgagatcgcgatagctcgagaagacatccgactggctacaaccacgtcaagggaaggagaggtgcctactaccaaggtctcaaagagtggaggaagcgaagccaagaccaagaaaatccccctagatccttctgatcctactaaaactgctgtagtaggcgccgagttagattgtaaataggaaagcgcgctcgtcacctttcttcaaaataataaaaatatcttcgcgtggaaaccatccgatatgcctggtattcctagagaggtgattgagcactctttgcatgttaaggaagacgctaaacctatcaaacaacgactccgccgctttgcacaaaacaggaaggacgcgatcaaggaggaattgaccaagctgttagcagcaggcttcatcaaagaagtccttcatcccgactggctggctaacccagtcctagttcgaaagaagaccgggcaatggcgcatgtgtgtcgattacaacgacctcaacaagtcttgccccaaagatcctttcgggttgcctcgcattgaccaggtagtcgactcgaccgccggctgcgagctgctcagtttcttggattgctactcggggtatcatcaaatccgattgaaggaatccgactgcttgaagacttcgttcattacgcccttcggggcctactgctacattaccatgcctttcggactaaagaacgatggagcaacttatcaatgcatgatccagagatgtttctcaactcaaattggtcgcaatgttgaagcctatgtggatgatgtagtcatcaagaccaagcagaaggatgatttgattacggatctggaaaaaaccattgcgagcatccgcgctttcaggatgaaactaaaccctgaaaaatgcaccttcggagtaccgtcagggaagttgcttggatttatggtgtctcacagaggcatacaggtcaacccggagaaagtcaacgccatcctcaacatgaagccgccgagttcccagaaagacgttcaaaagctgactggatgcatggcggcgctcagccggtttgtctcacgactcggcgagcgggggatgcccttcttcaaactgttaaagaaaacagacaatttccagtggggacctgaagcacagaaagcctttgaagatttcaagaaacttcttactactccactagttttggcctcaccacacccacaagaaccgctattactatacgtatcagccacctctcaggttgtgagcacggtcctggttgtcgagcgtgaagaagaaggccatgttcagaaggtccagcgaccgatctacttcgttagcgaggttttggccgactccaagacgagatatcctcaagttcagaagctgttgtacggtgttctaatcaccgtcaggaaattatcccactacttccaaggccactcggtcacggtggttacatcgtttccactcggcgatatcctccataatcgcgaagcaaacgggcgaatcgcaaaatgggccttaggactgatgtccttggatataccgttcaagccgcgaacttcggtcaaatcccaagctttagccgactttgtcgccgagtggaccgagtgccaagaggacacgcccgaggaaaagatggagtattggactatgcactttgacgggtcaaagagactttcaagcactgggccggagttgttttaatttccccaactggagaaagactaagctatgtgctatggatacatttttccgcatctcaaaacgtggcagaatacgaggtgctccttcacggactacggatcgcaatctctttgggaatcaggcgtctgatagttcgcggagattcacagttagttgttaacaaagttatgaaagagtggtcctgcctcgacgacaatatgatcgcttatcgacaagaggtacgaaagttggaggataagttcgatggactcgaactcactcacgttctccggcacaataatgaagcagctgacagactagcgaattttggatccaaacgcgaggcagccccttctgatgtgctcgtcgtacatctttatgagccaaccgtacccaaaagagaaacagatgaagccgcggaaccgactggagagagcctcttatacgatttctgacctcccaagaactccctcaagataaagacgaagccgatttccaggcgcagtaggctttatattattcatgagaccgagctgtacaggaaaagtccatcaggaattctgcaacgctgtgtatccttagaagaagggagacaattgctgaaggacatacattctagtatctgtggcaaccatgttgctgcacgcaccattgtcggcaaggcttaccggcaatgtttgttctggcccactgctgcgtccgatgccaacaagatcgtgcggacatgtgaaggttgtcaatttttcgccagacaaactcatctgccagcccaagggttgcaaaccatcctgctgtcctagccgtttgcggcttggggccttgacatggtcgggccgttcagaaaggcagtcggcggttacacacatctctttgtggctatcgataaattctctaagtggattgaagctaaaccggtcatcacaatcacggcagataaagctagagattttttcatcaacattgtgcatcggtttggggtacctaatcggatcatcactgataatggtactcaattcactggtggagtatttaaagatttttgtgaagacttcggcattaagatttgttatgcctccgtagcgcatcctatgagcaatgggcaagtcgagcgagccaatggcatggtactccaaggaataaaggcacgagtttttgaccgactgaatccttatgccggcaaatgggtggaacaactgccatctgtactttggtccttgcgcaccacccctagtcgggctacgggccagtcgccattcttcctagtttatggagcagaagcaatgttgcctagtgaagtagaatttgaatcattgcgttttcgcaattttcgcgaagagcgctacagggaagaccgagtggatgacctacaccgactggaagaggcccgcgaagcagccttaattcagttggcccgatacttgcaagggttgcgtcgttatcacaatcgtaatgtccgatcgcgagctttcttagtcggcgacctggttttgaggaaaattcaaactacacgagatcggcacaagttatcccctttatgggaagggccatttataatctctgaagtcactcggccaggttcttatcgactcaagcgtgaggacggtacacctatcgacaactcttggaatatcgaacatcttcgtcgtttttatgcttaagtttgcttctgtatctccctgtcttgactgacaacatcaagcttccccttgaagttatcagtcgggggctattataataataatggagtgtgatttttatcaattcaatttgcttacttatttatcattgccttgcttgatttttcgacttagtccatgaggactgaaagttttttaatagcttttgcgggttttaggctcaataaggcttgacaaaggcttttaagaaatcagaagctaagtatgaaacaccaagcacagcataaatttatcaatattgtacaaattgtgcctccatcatcaaacatcaatcagtatcagtcctttcatcatcagagccatcaggactagtcggtcgaagatcggtgtcctggaatctctctactacatcaactgctattttgtcagcggctttctacgcatcgttgataagatcgagagcagcttcttcgctcgtcccgtccgcaaagccatcaacggcatcaatgtcgattttcgggtaaagggatttggtcatcgccaacgctagacttgctcccatacttccggcttctttgatgttcttgaaatatgtatccagagcaactcttagcttatcaaagatctcggaagcgtcgaatgtactcgggccgttgttattaaagaacattgcttgagtgagtggagtagcggcgttagcaacttcatcccgggccccttcaagccttttaattttgccgaccaggacgtcgaattgggcttgcaacttgatcttgcggtctgcatcaaagattcatattaacgagtcaggatacagaaggcaatggcttttggagtatcaattgatggtaccttcaacgtcctttaaagctgagtccctctgactcgccagctctgctttatcgctttccagagtttgaatccgtttctccaattgagatatcttggtggtttgcactacattgaccgattaattgaggttataaagatgatggcacaagttagtcagacagattttgtgtataccatttgacgagccactcagttcgaagttagactcctggagctagccaattcgatctcttagatcgtgctcggttttgttggcaagctcttttgcctcgtgcaattgatctctgacagcttcaagggttccaagatgaggaactagtttctctagggttacggtcttcgcctcattcctaaggtgaatcctctgcaaaacagttttatcagcgctcaagctagatggcaaacaagatggctgaggtcaggcgtcaaggaacttacgtttacaatacgagtcccttggccgagtgcctttttcagtaggcatacctcttcgtcttctttttgccggtttattacaattccttgaggttgcaagtcatcatcccaccacttgaccagaatgggagggcgcgagtcttcagctgcacgtatccggagaacttcctcttcatcaccaatcattggtcctaatgtatccatggataaaggacagaagatcaattaaagttggttggattaacacggtttcaggcaaggtgtttacccgtgatgattcccgggcgaggacgagtcggctcttgtgtcttagcaggagatccaggcctcgggtcgttgctggcatcatgtccgtgagggctatcagcctgagcttcaacttctggaatctcttggcttggccctaggtccgactggtttccagtcgggggctcctgattgactctggcttcagcttcggcaaactggtttccggtcgggggttgattgctggattctacattatcggttgccagctgattgtcactcggatgatcctcagcagtcggcccggtttctttggaagaacttgtttccatattagccggatcagagtcctttccagaaggatctatatcagatggtttcctacaagtttttgttatcagtattatttccatgctggctgcgtatcaatacaaggaagattgttatatgatttgtacttggaagacttcctgatctttggcgtaggatgactagatgttttcttctttggaatagcctgcttcggcagctttctggttgtttctctatctccaggctattagcgttgtcgccttcgtcgtcactcagcactaacttcctcttacgggaatctgactggctggctggattagaggtgttaggctgggcttcggaccggatctttggtcccccgctcccctgaccagtttgacggcgaggtgatcggcgctgagcgattgtgggatctgacttcattagagcaaattcctagacataatatcttccactgtcaattgatttaacaaaaagacaagatcatattttgaggaaggttgaagtgtttgagtacataccggtgggggaggattgaatgcattgtatggcacaactggaagcagatgtgaataactgacgacaatagcatttgagaagatcttgtacattctttccttcatgaccttaaagtcaagagagtctggatcttcatgatttggatcatgtttgccgtcaaactcaaaagccgtgcgggatctctctttgattggagctaatcgacttttgatgaagtgccgagtgatttgttctccatgcaaaccttgttccttcacctttagcatgcgttccatcaattccaccgcctgagcagcttcatctcccataggcaatgaattccatgtgtcctggtaaaccggaggaagacaggagtactcggggagtgcgggttcaggattttgaacgtaaaaccagtttgcgtgccaaccattgtttgaggtcttcaagggcatggagaaatacttttggcttagtgttcctctgagttggaagccagcgcccccaaccacgcatggtttgctcttgttcggttggggcttgaggaagaagattcggcggaataaggcgaaatgaggcctaatgaccaaaaaagcttcgcaggcatgaatgaaattggcaatgtgcactatggagtttggattcaggtgatgcaggctaattccatagaagctcagaattcctcggaaaaatcttgaagttggaagagaaaatccaccataaaagaactgagaaaaaaccacgacctcgtgtgtatcgagggttgggaatgcttcgccgaaggctggtcgccacccgatgatctccttcgccggaagaacgccgtgcgccaccatttccttcagattctcctccgtcacgtcggagggtgcccactgattctcgaaactttctctcttccgccatggatgcgagtcgaatgatctgattcggtctgagaaatagctgaaggggaatggggaatcggtgcggtggacgcgtggagaagattcgtggatttttgagaatggattggggcggattgatgaaccctagcttcgtcggcgtggctttgcactgtagcaaggagtggggaaatggcgagagttttggcgaggaagacaaagcgttgcttggactttggtgttttgttagggtatcgggagtgctaatgggcttggacctgtacagtacttcagcccaatattattagcagcgtggcccgttgtgatccctagggacttaggcgctttttgctttggcaatttgtactcacaatgatgtgacccgatgctgttaaaatcctttttaacgcagttagataattctttggaattaccacgatgcaaataaaaaggtgcccgacagaaaggtgttatactatttttgtaagctttattagcctgcaaaagctgtttgggttgattcgagatgactagtttattaagagtcattctcttagcatgttatatgcttattttgattatggtaagggttgtagcctaggctattaaatttcttaattaccatgatttttatcatatttggtggatcattttaagagtttcttactcagattcttgccaaatatgtctttttgtggaccttttgagtgtttatcactcgggccttttcatatttttattcttgatatattaaagctgaggagcagtcggctgggtattttactaaataccatgcgtgctttgctatatgatgtttggttgtaaaaccactcggttcttgactacatgtttagttttttaactaaccacatagtcgggggctacacctaattaggtgcatctacccgctgcaccatattttattttcgcccttcacagtctttgattttagtgctcggcaggacagagcaggaggaattgaagcactcggattattgctacttcgtcgactgcaaaggtctcaggggctactgtggagattgtggatatcccatatctacacggcagctatagtttagttgggtacagggtaccaaatatagatagaatacctttatgaggattcgggttagtttctaaacttgtatatcaaggaaatacccgggatcctagtcggttacgattgtattttatttgtaatcacatattccgttagggatatgtgttgtattttgtaatacggactccttcccctatataaggtgcggtccgggtccctctagggacacgatttttctcccatatcatacaatcaataatacactcggcggaatcatccctggagaggagtagggtattacttcttgaataagaaggcctgaacctatataaaattccttgtcttcaaacccatccacttttctaacttgatagccacccccttttagtattgccgaaatcttatttcgacaatgcgactactcgaagatgcatctttagaaaagatattgatgtgctccctagatcatgtgtttgggctctatttttttctttaaaaactaattcataatcacaaagtattcatggtattattaagaagttaagatttccttggacattcagtcatttgcttctgtgaacaagtttggtatttcgaggaagaaatacattttttttaatttctcttgtgaaatttatggagttcagtattttgacataattaatatcgtcaaagcagtgttgattctatgggattgatgcatgtgcaaactagtgacaacatatgctttaaggtaggataattaattagcatctaaatgcagggttttgtagcccactacttatacaaaagttaggttttcgttttcatggtccaatttgtcaaaactaacaaattgttcagaaagaattgcttgctataaacactaaattaaactggtcactatggcatgattagggttttgatcgtgttttatttgtcccaaatttgttagtaatggataaaaaatgtaaaactcatttttttacaaataacgattatgtccgaaatattgcttaagtcatccaattaaaggcagcacaaaatgtgcacatattaggggggggggaggaatccaaagccaatatttatggaatatatggcacattcctcccccttttttttaatcaatttatagatgtatagaatatttgccaaccagatcagcacataagaaaaagtatagctcgtatgttctagtacatatgctagaagggccatattatgttttctacagcagtaagcaaatgactaatcctagttatgttgagtggattgatggattcaaaacaaatttgggtagtcaacatgcactgtgtttcatgatctaaatatataaatggaagctacgatactaatatataaacaaaagcaacagttaaaccttgttttcctttcgctgttgaacatgaggaatggacggtgggtatattaatttgtagcatatcttattttttggtgaataggcttagcagtttgaaatttgaattcttcagtatgccttgttgtcagtttcagacaatttctcgctgcaacttgcaactccatacatgcacgcgttatctataactgataagttttttaggaaagcaaaaaactattctgataatcattaattaactcattttaaaaagagctattatactgaagtattctctaggaaaaaaggtaccacatcccatatccaaatttaacacagaatttcacttaaagaaccttggtacatgaactgaaatccatgtgaatcaatttagtttacccagtaggtttggtacatgaactgaaatccgtgtgaatcaatttagtttacccggtaggttttttctttactgaatctaacataacatggtgtcaatctagacatatatgaatatgtgataaacctgtagattacatttcatcaagaaaaacattaaacagtgattaccagtagtgctgaacttccatcccaccaatgtgcatgggaaaataaaactaaataaatctcaccaataatggtataccgagtatagatattattggtggaagaaactctttttcttttgcaactatgctacttgctaaacaaaacaaacctcgtaagcatgaagacatgataattgaacatctaatgtataaagataagagccaattcagatcaatgctaggccattttattggaaattaaatgaaaatgaatgattagttaatcaccaatgctcgacacaatacgatggagcgattgctagtggagctacccaggtatctatggccatcagctgaagtgtacaacaaagaacggagcttaacagtcatggagcacgcgattccggcggtattgggctgttcaccctagacgacagacgcctcatcctccgtttctggctccagcacgccgaggagtggacgcagcacaggaaagtgaagctgagggagctggatatagttggatgtgtctcctcgccttaggccttgtttgttttgtaggggatcggagagcattggaggggattaagagaaaataattcgaaatatgggacttaataggattaatcccgaaaagtgctaggagacgcatgcaactatgtaatcgttaatatgagtttgctctctcctaattgcatttttgtgtgcactcagcacaatatataatttccatggacaagtttaaactgtactgtactggatagtggttttgcagaaactgttggcggttgatgatgtgcttgccggtttaacaaaatatgtactccctccattcttaaaaaaaacctaaatttatctatgtatctgtacatatatgggacatattgcatttttggtagcggcaataaagaaagttgttttaggctgtatgcatgtattgtgtgaacacgtactatacataatatatttttggcagtagcaataaaaaaactgttttcttctactggataccacaccaagtataaagaggttccaactttatacatttgagatttggctctttcctaatagcacggaagtttacagcaaatatcactactgaagaactgatctttgtccgcatgataaaactcgcattagtctcgatttgaataggaactggaactaaagaatatctttaatcctaattgaaaagcccagcaatatttttttatgtttagtcccggctgataacaccaattgagactaaaagatcatttttaatcccggttaataacaccaattgggactaaagatcatatttttaatcccgattggtatcacgaaccgggactaaatatctttttcccacgtcattcgctctctcttccttatctcggcattggtagccgctcgcacgccctatccactcctcctcatcccctcttcatgccaattcttctcctcctccccctcccctctctcctctgatcccctcctccccttcccctctccctctctcatctccatggcgggcggcggtgccctcccctccgctggatccagcggaaggggatgcggcaggtggcggcaagcacacaaggcggcaggtgacgccaggctggtgcccggcggaagtggtggtggccgggtggtggcaggccagaagcagcggcggccgtgcgggccctcctgatttgtttttagattttttttatagatttttttatatttgtggatgatttgtagattgcagatgattttgtggatgggcatgtaatttgtgaatgatttgtggattgtggatgattttgtgtatggacctgtgaattgtggatgattttgttgtgtgtatgatttgtaaggattcggggtgatggcgttggtgatgcaagtagcaaaaaaacaacggaaaaaaagaaagaaaactaaagatggatatccttagttccggattctaggtcccggtttgtaacccaggattaaagataacttctccacagtgtatgcatatgttctaattaaagtttagagtaaattgcatcactggtaacgaacatgacaggtgggtgtaatctagtgcacgaatttatataatgctcgttgtgatgcatgaacttgttttgtgcgtgccgagaaaggcaaaaaggacactatatggctaatcttattgaatcaggggctgattaggatactatgtaaacatatatctaagaaggttgctattagacatacacctcatcaataaaaaatagtatgggatatagtgatcgtagaaaaatatttaaaaaaaatgagcactgatatcagggttaaaaatatatgaaatttatcatttccatgacgaaggataaactagagaccaaatttataaatattgcatgtattatgcatattcactacacatatgcacgtcacatcctaactaatcaacatcaacttcgtaaaattaacattgccaaactattttggtctcattcgcacaaactagacaagttcgtgtactgaaacgaatattttacaagtttatatactaaattacactcacctaacaagattatgtatcaccaatgcaatttactctttactttctaaagtttattgcagaagaacctgttcgctgctcaccgcagtaaaagttactccctccatcacaaaatttaagcattttagcatagtgacaagtcaagcatttttaaatttgaccattaataacaaaaaaaattaaaaaaatcaatcatgtaaaattgatggtactagatttatcattaaacaaactatcataacatataactctttttatttaaacatcttacttttataaatattgttggtcaaagtaacatctcggagaccgtgtcagagtaaaaaaatgcttatattttaggaaggagggagtagccattttcagccattcttcattctcatgaacgcaccttctgtcttcaccggccatggttgttgagataggtgaggtcctcatatctagctcattccacttgtcccattcttgttgtccgccaccacgctgtgttgtcgccacatagatgaccaggttatctgctgacatggccgccattgcattgtgatgtaagcgccacctacacattcatgtcctctatggcatcccatgtgtcctgtgcgatgggatgccatctcggccggccggtcggtttctatcaatgtagaccatcgtttaccatgtgccacctggttggacttggtccacactaaacctctctcttctgcagtcattggtgcatggctagtttacaactgttggcgccataaatcttcttgccactaaaaaatgcttgcagagacatttttctagtactgtagaggtatttttcaaatgcctttacaatattatagaggcattttagaaaatgtctaataagtatcgtatggtgaattgtctctacaaacgaagagacattttataaaatgtctataagatggtagaggcattttctagagacattaaattataccacaaatatatgaaactagtcaaaaaggagaataaaatagtttccttggttttaacaagtcttaaactcaagatctcttggacaaatcatttttatcttcagtgcactaaccaactcaactccatgtcattacttatatgtttgtgcctttagttacttatatttagtcctttagtacacattgtcattctaaaacgtgtctctacatagtttaaaatgtatcaagatgatttattttgggacaaagggagtatattcctctattatctactcccactactggggaaaggctcttcactcccggtttgtaaccctttctactctcgggtttcaaaccgggatacccaatccggaactaaagatgctcatctttagtctcggttaaaataactaggagtaaaaatggatctttagtcccggctgttattaccaaccgggtgtagccaggcgccaggttccttttttcctttttttattgtttttaacatcgaataatgatttcactccatctacaaatcaaccctaaatcaatcaacacatatcacagcacaaaaagatatctccaaatcctcaaatcaatcatcaccaaatacatcacaaattctaaaaaaattacatcataagttctacaaaaaaaatcatcgcaaataaatcacatattcacatcacacaaatacatctcagatccaatcagaaattcttaaaaaaagaaaaaaaaatcaaatatgtctcgatccgcgtcggccgccgccacctgccacgtggcctcgccgccagccgccgcccctccgcgcgaccggccaccgccagtcgccctccgcgcggcctcgccgctgaccgcaggccctctacccgaccgctcctcggtctgaaggggaagttgggagaagaagttgaagagaaggggaggatggataacatagagaagaaaatgaggagaaggagaggataagtataagagatagaagaagatgaggagttgggaggataagtcgtaaggattctatactgcatatggatttttagtcccggttggtaatacaatccgacaatccgggactaaagatataaataatcttttactcccgattgatattaccaaccggtactaaagtggtaatctttagtcccggttggtggcgccgcaaccgggactaaaaattctcggtcccctgacaagccactaacatagaatgaacagggactaaacatcatctttagttccggttggtaacaccaaccgggactaaagatcaagattttttttaaccgggactaaaaatggtttttatcccggtttttattacaactgggactattgtagtttttgatcgaccctgcaaatatcagttttctagtagttttctagtagtgtcctaagctccctcctactcccacggacgcatctgactgtgatgtgtattgcacgtgcacaataaccagcagtacctttaaccttcagtctttttgaagcaaaatgtgaatccacttattgatatattattctattatttgtttaattattttgggattgtcctctaaatttatcttttttagcctgacgccctctgtatagaaaaaaaatcgttgcatgtacacttgaatggaagcggtgtgtatggcacatatttataattttggagatgatttgaaattagtcaaagcatatcacataaaagtttatttggtgcccttcaagctaatgcatgcagaaatatctccatctcttctctcatactcaaattaatccatatgcctcaataggattaatctcccaaattaattagctaggagcctcacatgcaactatgtaaccgtactttgatatgagtttgctatctcctaattgcatttgctgtgcagtcagcacaatacataatttccaaggaaagtttaaattccattgttacggggtaggggttttggagaaaccattggaggttgatgatatcctcgccactggttttaacaaaatacatactccctgtgtccttaaaatgccaaattttatctaatcatcagaagtggtttttgttagatggagggtgtataattaaattaagtgctatatatgtagtattgtgtaaacaccatcccatattgcacggcaataaaaaaagctattttaagcagagtatattgtgtgtgaacgcgtcccaaaatacatttttggcagcaacagtaagaaatgtgttttcttgtgctggcaacattattattgtttggcatttagctcttttctagttagaacggtagtttacagctaatgtgcatatctcctaattaaagcttacagcctttctggagctacctgttttcagcacagatatgtatgaacatctacctcgtttctcctggatctacccctactccaatcctcttttcttctccaaatcctctcttctgtctctccttctcttcttgcaggtttcctacttctagacccagggcaccaccagaaggggtatgtagccatggtccatctggtcttccatcttctggtggtggcaaaggcaatggtgtagcaatagcaggagctaatccgtggtattcgggggatggctctgatggaagcaataccactagtaacagcgagagaacagtcacagctgaattcggaataatcgtgcatcctggtggttatggtgatcaggaggtggattctcgtacggctaatcaccatgaggcagattcagaaactgatagcgagagaactgaaggtgctagctttgggaagatcgtaaatagttttagtaattctcgccatttctcctatgtggactctgagttgctcccaggaaaaaggcagaagaatttagtgtttcaacctgacgttcatgaatttctatcatatcctgattgttcttgactccatgatctttttatggttcatcaaaaaatatacgagtgcaatcccttagttttgatgagaatatcacaaacggtgctttatctcagttatttttgaaatccagttcaatctgattgtcttgcgtgtaggtttcttgttcctgattacaataaataatgttgtaacataacaaattataacagatttttaagtactggaacacaatcacctggaaaaatagcaactgtaatctattaatttcaacctcaccttttctctgtaactaacacaacatgattgagctccatggggtttttttacttcctttcttatttttgttaaacagtccaacaatacaacatatatttcaacatcttttctgaaatgggtattctttattatagatgtaaatttgaataaagatacaataattcttgtagtttctagaaaattgtatgcaatc

SEQ ID NO: 32208 - DNA, 9963 bp, Oryza sativa
tgtgtgtgctgagtgtgtgtatttcctatcacatgaattagtttaaatcgttcacgagaccttgtattgttgtactgtttaagattctcaccatggttatatactttcagaggattctaagcggtgacaacagttatggagcgaatcttgtctagagtggtcaacgacaagatgcagactctggggtgtttctgtggtcctaagggaaaacacaaatgaaaaacattaaggatattcctgaatcatggaatgttcatccaagaaaagatcagtttgatccaactggatgagacatcgagatccatcttcgaaatgatcagaagaccaaggataaggtttgtgaattaatgttatatgttgatcaattatatttgttccataaattttcatgattgattgaaagagttacatgtgttctttctcaaatttatgagtgtatcacaaacaaagttttttttaaaaatgtttttgtcgagattatggataccccatatctacacgacagttatagtttggttgggtatatggtaccaaatatagatagaatatctttatgaggactcgggttagtttcgaacttgtatgacaatgaaatacccaagatcctagtcggttacgattgtattttatctataatcacatattccgttagggatatagactttattttgtaatacggaccccttcccctatataaggaggggtccgggttcctctcgggaggacttttttctcccagattatacaatcaataatatactcggcggaatcatccccggacaggagtagggtattacttcttgaataagaaggcctgaacctgtataaaattccttgtcttcaaacccatccacttttctagcttgatagccacccccttttattattgccgtaatcttgtttcgacagttgacgcgccaggtaggggtagcgtcagttcttcgccgattagtgcgatcagttccgtctccggcatcgatgacttcgtcttccctcccgggcaggcgtttcggttcggcggcctcgacttcatcaccaacgacttcggcaagatctctctcctcgactcggatccaaaccagtcgggaaagaaccaggtctcagccccattcggtattccgaactcggccaagatctactccaagcttatctcgatcaagtcggcttcaaaccactcagacgagatcccatctactccaacatcaccagatcaagatgatggggcctaccctccaatcctgatgaaactccccgacgatttggccgccgtcttcactacaagggcgtcttctccccgtaggcctaggcggaagtcggcttcaacaccgatcatgcctagctccagggaagtcggcgtcatactccagccactcggcacgatttcgacggatcaactggaaggctacctcagctcccccggcgtcgactcacgaccaaccgagatcgtggagtacgacgaattcggctaccgctatgacaaccgcgacctcgacgacttcgacgaaagctttgaagacaattacacccctctattcttcggcgtcttcatggccgacaacgagatggaagaacaacgccaagcccgagaagcagatgcacgacgcttacagcaggaagctgagcgatgccgactggaagaggagcgccaagcacaagagcaagaacggctgcggcgagaacaacaagatcgcgaacgggctgcaaaggaggccgaggaccgacaacaacgagccttggacgcaggacgacgagcgtgagatctcatcggacagcaagacgtcgaggggacagcagttttccgcacccctcaacagaacgctgtcgctgcgatcacccttctcgacaccctcctgaaggaagacgcacttaatcaagccgaccacgtcgtcaacatcttgaaccagaccaagaccatgatcgccgcttcggtcccggttaactccgacagtgttcgcacaccgactggcagccgggctccccatctccgatctcatgattatcaccagccaagcctcagcatcgtcggcacaggatccaatcgtaggagcagaggccaagacgagtgatctgttcactcgcctcctgaacgatacagggagcgccgagttgaacggcctcgttccctaccttgtcaacgtcccatcgatcttcgcgatacgatcaaccagtgccgtgcaacacgaggtcaccgccgtacgccagaccgctatgacgacgacgtggatggagtagctgcctttactaacgacatgcgtcgagtggattggccggccggcttcaagccgactggaatcgagaagtatgacggcaccaccaatccagagtcctggcttaccgtctacggtcttgcaatccgcgtagcaggaggagacagtaaggccatggcaaactacttacctgtggtcctagcggattctgcttggtcctggctccacggattaccccgtggcacgattggatcatgggcggaactgcacgacaactttatcgccaacttccagggcacctttgaacgccccggcacacagtttgatccctacaacgtcattcagaagtctagagaatcccttcgagattatatccgacacttctctgaacagcgcaacaagatttccgacattaccgacgacgttatcatcaccgctttcaccaaaggaatttgccacgaagaactagtcggcaagttcgggcgcaaacttcccaggacagtcaaacagatgtttgaaaaagccaatgagtatgccagagccgaagacgccattgccgcatccaagcagtcgggtcctacttggaagccaaagaaagatgtgccgactacgggagggggtggaagtaacaatcacaaggaccgcaaacgtaagcccaaggaacttgttgcgactactacacacttctcccgacaacgttcgcgtgtcaacacttttgacaagatcatgaactcccaatgtccgcatcatcccaactccaacacgcagctaaggattgcttcgtctacaagcagtttgcagagcaatatgctaagaatgcacagaagacctctgacggaggacaaagcacgtcaaaaaagatagatgatgatgatgatgccccgacaggttttcaagaccaccgcaaggagctcaaccacatctttggcggccctctagcttacgagtctaaaagaaagcaaaagttgactgaatgggagatcaatgttgtccagactgatacgccgcagtatctttggtggtcggagataacgatcaagttcgaccgttcggatcatcccgaccgagtggtccacccggggcggtaccccctggtactagacccagtaattcgaaacgtcaagcttcgcagatccctcatcgacggtggcagtgcactcaatatcctcttcgccaagaccctggacgacatgcagatccctcgcaccgagttaaagccgagtaacgcgcccttccatggagtcattccagggttatccgctacgccacttggctagatcactcttccggtcacttttggtactcgggagaacttccgcacagaaaacatttgcttcgaagtcgctgatttcgagacagcgtatcacgccatactcggacgcccggtgttagccaagttcatggccgtccctcactacacctacatgatgatgaagatgcctggtcctcgaggagtcatatccctacggagcgacatcaagcaagccgtcacatgtgacaaggagagttgcgagatggctcaaacccgcgagatcgcgattgctcgagaagacatccgactggctgcaaccacggcaagcgaaggagaagtgcctatggccaagatctcaaagagtggagaaagcgaagccaagaccaagaaaattcccctagatccttctgaccttactaaaactgctgtaataggcgccgagtaagattgtaaataggaaagcgcgctcatcacctttcttcgaaacaataaagatatctttgcgtggaaaccatccgatatgcctggtattcctagataggtgattgagcactctttgcatgttaaggaagatgcaaaacctatcaaacaacgactccgccgctttgcacaagacaggaaggacgcgatcaaggaggaattgaccaagctgttggcagcaggcttcatcaaagaagtccttcatcccgactggctggctaacccagtcctagttcggaagaagactgggcaatggcgcatgtgtgtcgattacaccgacctcaacaagtcttgccccaaagatcctttcgggctgcctcacattgaccaggtagtcgactcgaccgccggctgcgagctgctcaattttttggattgctactcgggatatcaccagatccgattgaaagaatccgactgcttgaagacttcgttcatcacgccctttggggcctactgctacatcaccatgactttcggattgaagaacgcgggagcaacttatcaacgcatgattcagagatgtttcacaactcaaattggtcgcaatgttgaagcctatgtggatgatgtagtcgtcaagaccaagcagaaggatgatttgattacggatttggaagaaacctttgcgagcatccgcgctttcaggatgaaattaaaccctgaaaaatgcaccttcggagtaccgtcagggaaactgcttggatttatggtgtctcacagaggcatacaggccaacccggagaaagtcaatgccatcctcaacatgaaaccgccgagctctcagaaagatgttcaaaagctgactggatgcatggcggcgctcagccggtttgtctcacgactcggcgagcgggggatgaccttcttcaaactgttaaagaaaacagacaatttccagtgcggacccgaagcacagaaagcctttgaagatttcaagaaacttctcacactccaccagttttggcctcgccacacccacaagagccactattactatacatatcggccacctctcaggttgtgagtgcggtcctggttgtcgagcgtgaagaagaaggccatgttcagaaggtccagcgaccgatctacttcgttagcgaggttttggccgactccaagacgagatatccttaggttcagaagctgttgtatggtgttctaatcaccgtcaagaaattatcccactatttccaaggccactcggtcacggtggttacatcgtttcctctcggtgatatactccgtagtcgcgaagcaaacgggcgaatcgcaaagtgggccttagaattgatgtctttggatatatctttcaagacgcgaacttcgattaaatcccaagcttttagccgactttgtcgccgagtggaccgagtgccaagaagacacgcccgaggaaaagatggagtattggactatgcactttgacgggtcaaagagactttcaggcactggggctagagttgttttaatttccccaactggagaaagactgagctatgtgctatggatacatttttccgcatctcacaacgtggcagaatacgaggcactccttcacggactacggatcgcgatctctttgggaatcaggcgtctgatagttcgtggagattcacagttagttgtaaatttgaaagagtggtcttgcctcgacggcaatatgatcgcttatcgacaagaggtatgaaagttggaggataagttcgatggactcgaactcactcacgttcttcggcacaataatgaagcagccgacagactagcgaatcttggatccaaacgcgaagcggccccttctgatgtgttcgtcgaacatctttatgagccaacagtgcccaagagagaaacgggtgaagacgcggacattgaagacatacctatggtcgaagccgactagagagagcctctcatacgatttctgacctgccaagaactccgtcaagataaagacgaagccgagcagatttccaggcgtagcaggctttatattattcatgagaccgagctgtacaggaaaagtccatcaggaattctgcaacgctgtgtatccttagaagaagggagacaattgctgaaggacatacattctggtatttgtggcaaccatgctgctgcacgcaccatagtcagcaaggcgtaccggcaaggttttttctggcccaccgctgtgtccgatgccgacaagattgtgcggacatatgagggttgtcaatttttcgccacacaaactcatctgctagcccaagagttgcaaaccatcctgctgtcctggccatttgcggtttgggggcttgacatggtcggcccgttcaaaaaggcagtcggcggttacacacatctctttgtggctatcaacaaattctccaagtagattgaagctaaaccggtcatcacgatcacggtagacaaagctagagattttttcatcaacattgtacatcggttcggggtacctcatcggattattactgataatggcactcaattcactggcggagtatttaaagatttttgtgaagacttcggcatcaaaatttgctatgcctccgtagcgcatcctatgagcaatgggcaagttgaacgagccaatggcatgcgactccaaggaataaaagcacgagtttttgatcgcctgaatccttatgccggcaaatgggtggaacagctgccatctgtactttggtccttgcgcaccacccccagtcgggctacgggtcagtcaccattcttcctggtttatggagcagaagcaatgttgcctagtgaagtagaatttgaatcattgcgttttcgcaacttttgcgaagagcgctacggagacgaccgagtggatgacctacaccgactggaagaggcccgtgaagcagccttaattcagtcggcccgatacctgcaaggtttgcatcattatcataatcgtaacgtccgatcgcgagctttcttagtcggcgacctggttttgaggaaaattcaaactacacgggatcggcataagctatcccctttatgggaagggccatttatcatctctgaagtcactcggccaggttcctatcgactcaagcgtgaagacggtacacctatcgacaactcttggaatatcgaacatcttcgtcgtttttatgcttaagtttgcttctgtgtttccctgtcttgactgacaacatcaagcttccccttgaagttatcagtcgggggctattataataataatggagtgctgggatttggtcatcgccaacgccagactttgatgttcttgaaatatgtatccggagcaactctcagcttgtcgaagatttcggaagcatcaagtgtactcgggccattgttattgaagaacatcgcttggacgtcctttaacgctgagtccctctgacttgccagctctactttatcgttctccagagtctgaattcgtttctccaattgagatatcttggctgcttgcactgcatttgactccaattaattgaagttacaaagatgacaacataagttagtcagacagattttgtgtataccttttgacgagccacttagttcgaagttagactcctggagctaggcaattcgatctcttagatcgtgctcggttttcttagctagttctttggcctcgtgcagttgatctctgacagcttccagggttccaagatgaggaactagtttctctagggttgcggtctttgcctcgttcctaaggtgaatcctctgcaaaatggttttatcggcgctcaagctagatggcaaacaagagggctgaggtcaggcgtcaaggaacttatgtttacaatacgagttgcttggctgagtgcctttttcagtaggcaaacctcttcgtcttctttttgcaggtttattacaattccttgaggttgcaagtcatcatcccaccacttgaccagaataggagggcgcgagtcttcagccgcgcgtatccggggaacttcctcttcctcaccaatcattggtcgtgatgtatccatggataaaggtcaaacgatcaattaaagttggctggattaatacggtttcaggcaaggtgtttacccgtgatgatttctagacgaggacgagtgggctcagatgcctttgaaggagatccagacctccggtcattgctagcatcatgaccgcgagggctatctgcttgggcttcaacttctggaatctcttggcttggccctgggtccgattggtttccagtcgagggctctcgactcactccggcttcagctttggccgactggcttctagtcggggtttgatcgccggattctacattgtcggttgccgactgattgtcactcggatgatcctcagcagtcggcccggcttctttggaagagcttgttttcatattagccggatcagagtcctttccggaaggatctatatcagatggtttcctgcatgtttttgttatcagtattacttccatgctgggtgcgcattaatacaaggaatatcgttatatgagttgtacctggaagacttcctgatcttcggcgcaggacaactagatgttttcttctttggaatagcttgttttggcaattttctggttgtttctctatctccaggcttttcaacgtcgtcgacttcgtcgtcactcagcactaatttcctcagcccggaatctgactggccggctggattagaggtgttgggctgggtttcaggccgtatctttggtcccccgctcccctgaccagtgtgacggcgaggtgatcggcgctgagcgattgggggatctgacttcatcagagcaaattcctagatataatatctcccactgtcaattgatttaacaaaaagacaagattatatttcgaggaagattgaagtgtttgagcacataccggtggaggggggttgaatgcattgaatggcacaactggcagcagatgtgaatagctgacgacaatcgcatttgagaagatcttgtacattctttccttcatgaccttgaagtcaaagggagtctggatcttcacgatttggatcatgtttgccgtcaaactcaaaagtcgtgcgggatctctctttgattggagctaatcgacttttgatgaagtgccgagtgatttgttctccctgcaagccttgttccttcagctttagcatacgttccatcaactccaccgcctgagcagcttcatctcccataggcaatgaattccatgtgtcctggtaaactggaggaagacaggagtactcggggagtgcaggttcaggattttaaacgtaaaaccagtttgcgtgactgcctttgtttgaagtcttgaaggcaaggagaaatacttttggcttagtgttcctctgagttagaagccagcgcccccaaccacgcatggtttgctcttgttcggttggggcttgaggaagaagattcggcggaataaggcgaaatgaggcctaatgcccagaaaagcttcgcaggcatgaatgaaattggcaatgtgcactatggagttttgattcagatgatgcagactaattccatagaagctcagaattcctcagaagaatcttgaagttgggagagaaaatccaccataaaagaagtgagaaaataccacgacctcgtgtgtatccggggttgggaatgcttcgccgaatgccggtcgccacccgatgatctctttcgccggaagaacgccgtgcgccaccatttccttcagattctcctccgtcacatcggagggcgcccactgactctcgaaactttctctctcttccgcgatggatgcaagtcgaatggtatgattcggtctgagaaatagctagagaggaatgggaaattggtgcggtgggcgcgtggagaagtttcgtggatttttgagattagattggggcggattgatgaacccttgcttcgtcggcgcggttttgaactgtagcaagaagtggggaaatggcgagagtttcaacggggaagacgaagcgtcgcttggacttcggtgttttgttagggtatcgggagtgctaatgggcttgggcctatacagtacttca

SEQ ID NO: 32209 - DNA, 5764 bp, Oryza sativa
tcttgtttcgacagttttgttttacttcgttagggtagatagttttggggaaagataacccgccctgtcaccaatataacaaataatatgtaggattttaaatcttagcaggttgaacgtttctgaaagtaccggtgattgtacacatgaaatagtaatcttagagattggctgaaaatgttaaatgcacaagtgttttttacataaagatgtgttatatgtttaccctaaaagaatggtgcatgatcgaaaaatcagctatatatatattatttatttctttgtgtaaacccaaacatgtgttactcttttaaaatttatactttgtataactacagtataaaaacctgacacatggaacaattgaaatccaacaaacatatttagtgtttaaacaatactgttggttgggagtattacccacatttagtcattcattaaatctgaatattaaatctcatatcgtctagcaaaaatacttctcatcctacaattaaataacggtaatcaaacaatttgcattcatagaatatatctggtggatatgatcatatctggccaatatgtaacacggaagcattaattggaatggatagttctttacctagtaatgacatctggcaggattggagtggtttgcaaagttacattcctttttaaaaaaacatattcttgtttatataacatgataatttgtgtgcagtcaaagtaatatgtacaaaaccaaattattttatgatagctacctttagtacaaatggcattcagaaaacatatttgacttttatttttcaaatataatcactatcagaacacagtatgttgcatatcaataatatatctcttgctaattcattaatctcacttataagttctaacattggaatgcgagaacataaaaaattaatttggatcaaaacctgtatactgtgaatccttgcacctttgggtggctagctagggtcatacatgtgatgcagtattgggatctattgagtttttccctcccatatccctttccaaccaaagaaaaaagaaaaaaaatgcatgttggttatttgtaaaatatacatatatatactaaatttattttgttgttcatatgttaaatgaaattatttttttgctcacattgcagtactaccgccacaaggattacaatcataaatttcgctcaaagcctgaagttcaatattttctagatactggaaaggttataattccgtaaagttccaggcattctacagaaggtgccatgctacaacagtgtttcgaacattgtattctgcataattttccccttccaaatttgatactgattcccacacgttctttttgtacagtgatcagttgatgcacgtgttcctagcaggggcaagatttcatcaaactgtactgcagcttggaatatttaactccagaggaatacggaataccttttcattatatatgggaatcatatgcacgtgttcgcggatacgaattatgtttttagatgaattatatatgggaagacctgcacaatgattaaaatatttgattaaactgaatcagtacaactgacagaaacaataaatagaaaaaatatataacaccattcatcattaatatatatgtatagatatatctaattttatagacaatggaatatcattgcggcattttctcatatatataatggaatatatatccatacaagacattttagattattttcatcttgctagcttgtatatattgtcaaacatttcttaactgctatagagacattatattactcactgaatcgaactgctatgacatgtgcacacaggtcacgggtgccacgcccatacaacgtactccctccatcccctaaaaaacaaatttagaactagatgtaacatattctagtacgatgaatctggacatatatatgtccagattcacagtactaggatatgtcacatccaatactaggttgattttttatgggacggagggagtaaatgctcttctcgtctactacatgacgctcgggtgtacgaggtgtacctgcttgacgtacggaaggccaagctggatcagcggccggtcagattcgaccactgccactactactactagtacgccaccaccaaggagtggcaggtggtgcagccgcgacaccaacgccaccaggtacatgctggtgacgtagtctacaccctgtcctcgcactacccgcagcctggtggcgctcgacacgaatatgatggaacgatccctcgtgatccctagttgagctaccgaggttggtatctgcgggtgtcagaggtgtacaacaaagaacggagcttcaaagccatggagatggccggcgtgatcgggctgttcgccatagacgacagacgcctcatcctccgtgtctagctccggcacagctctggaaggtgacgctatgggagctggcaaggcaaatccctccctttgcctcccgccactgcccccgccgctccttccctccatgagctgccactgctccctccctccacgagttagcgaagccacaagagagagagaggcgggatacaagagatgaatggatagagttaatatgaacggataggattagatgaggatagggttgcttcgaggctattctggtcattatgaaaagttattatatttcttttctttttgaaaagtaaggtcaaaaaaagcaaactaaaaaagtaggataaattagtagttaggcttcgaaacagagtcaattaaggaattgtcccatatatctggtatctttccataaaaggcggcaagatacaactcaaaacaacacatgcatgcttttcatatcatgtttgaattgcatactttattaacagtgcaaaccctcctgtaccaccaactgttagtaaaaaaaaaatatcacacaagtacttgtaccagtactagtactacttcactatgccacccactccactcacttttcttcaccctggagtcgaattttcccccaatcttttccccaagaaacagagaagccgcagcagcgatgagctcatggtggtcttggctcatcctcttctcctccttgggcaacagagggggcagcaatgccgacgctttctccggatccagcacctcgtcctccccctccccccccatcccttttccccaacaagcagtagcaggggcgcctcgctggcgaagcactcgcacgatgaagcctcgggacgacgggccgaccgatgcctaagccaaaccctctcaatcgcagccgcagcctgtgccccacaagaatcgtccttcaccccgaaaggccacgcccaaggcatccaaggcaaaggcgcagctgcacctcggcgacggtgagccaaagaaaagctagccccgaccccgtcttagaagcacaacaacaagaggaagcgggtggcgagatttgagcgctcgtggtccagggccgatgagctcaggattctggaggacatgtccaaccacgccaaaacccatcgcggcgctctgccggataccagcgatctctttgccgcccttgccaacagcctcgacagaggagatgccgaccaggccaagctcgctaacaaagtccacatgttcaagagatgatatggcactgcacgcctgcagcaatgctgctcgactgaccatgatgatatgcgtcgattgttagatcatggaacagcaccagctgcatctgatcggcacgaaggtggttgcgcagcgtgctgcacttgagcctggaggcagcgtcgccgccgggggtggcagtggagcttctccaacgtgcatcaagttatttctctacaccatgccatggcgatgggagccaccttttcttcctccttcggaacacgagggaaatgcagtttaactagcaatcttatataatccaccatctcccagcattgcaacaatcgcatgaagaaataatctagttttctttttgaatgtactatatagccattggaagggtgtttttactatacctcccactaacgggtgtactagtgtagtaagaataaataccaccgttgattttggtattaaggtggaagaataattaagtaattatacttctatgataggctgatgcttgccagctgcctagcctaaaagcgttcagcccttagctcacgaagcagaaggatggtcactgtaacgctcctggccagcgtccgccatcgatcgttgcacttcccttcttcgcgtaaacacggggatgggcacacggcggctcccccctcccaactgcgctgccaacaactggcacccgtccttgcgtagagtgactattataaaaccagccccgcaatcaacatcggtagttaaacatggaagaaacattataggagatccaaacacgatgacatcaccgaggcacgatatttgataacggagttcagccgaggcctacatctccggggtactgattacaggcgctcctccaccatccagcatattacagtgtatcagagttacaatgagacgccgccgccgtcactagtcgagagagagagagacgagatacgagagatgaatggatagggttaatctgaatggataggattagatgtggatagggtttcttggaggatattctgatcattaggaaaagttattatattttatttcattttttaaagcagggtcaaataagcaaactaaaaaagtagggtcagattagtagttagattaggcttcgaaccagatcaaataagaaattctcccatatatatggtatctttccacaaagggcggcaagatacagaacatgcatgtttttcaaatcatgtttgaatttcatacttttattaatagtgcaaactttactgtgccaccaactctcacgtgggagctcgagagcacggtaaaaaaaatcagacaagtactactactatttcactgtcccacccactccactcacttttcttcaccctaaagacgaatttcccccaacattttccacaagaagctgagaagccccagcggtaatgagctcatggtggtcttggcacagcgtcttctcctccttgggcaacggaggaggcagcaatgccgacgcttcctccggatccggcacctcctcctcccctcccgtccctcaagctcaacaagcagtagcaggggcacctcgccgttgaagcgctcaccgaagaagccttgggagggctagccggccgaagccaaatcccaagccaaaccattgcaattgcagccacagcccacgccccgcaagaatcatccttcaccccaaaaggccacgcccaaggcgtccaacgcgaacgagaagctgtagcttggtgacggtgagcctaagaagaagccagcctcaaccccatctcagaagcgcaataacaagagaaagtgggtggcggcattcgagcgttcgtggtgttatgaaaatagatgcacaacggagacacgaatttttacgtggaaaacccttgcgggaaaaaaccacgggcgccgaccggcaatgatcactatagaggagatgattacaaacgtaggggaatcacaatgggaacgtcaacccttcccgtacggcttacaagagtatatataggggataatagaaagacacctaataggactcctactaggaaactaatccgaatatattgtgggcccaaaattcggatcacatatttaacaatctctaccttgagacgaatttcctcttgtagcataaaaacatcaatcaccaaaaatacctcatgtaggtaaaatcaccgcgcgccaaatagtctctaggactatactgtaacacccaccaagcttg

SEQ ID NO: 32210 - DNA, 1815 bp, Oryza sativa
tctgaaaatccattgaacagctttccaatgctctttgccaggattagccatgtatctactgacaacacttaatgcattcgataagtcaggacgagaacataccatggcatacataaatgaaccaactgcacttgaataaggaactctagacatgtactcaatatcataatctgactgtggacataaatctgaagataatctgaaatgtgcagctaaaggagtactcactggttttgcatcatgcatattgaaacgacgaagaactttttcaatataacctttctaactaagatataacttgccagaacgtctttctctagtaatttccataccgagaattttcttcgctgcacccaaatccttcatctcaaattcactactcaattgtgccttcaactttgctatctctaatttgtcttttgcagcaatcaacatatcatcgacataaagaagcaaatatatagctgaaccatcaacaactttaagataaacacagctatcataattggatcttctaaacttctgagaaagcatgaaagagtcaaatctcttataccactgtctaggtgactgcttcaacccataaagagatttcttcaacctacagactaggttctcttttctaggaacaacaaaaccttcaagttgctccatataaatgtcctcttctaactccccatgtaaaaatgcagtcttaacatccatttgctctagttcataatcatgcattgcaacaatactgagtaaagtgcaaattgaactatgcttcacaacaggggaaaagacatcattgaaatcaatacctggaatctggctataacatttagcaactaaccttgctttgtatcttgcctcatcacttggagacataccttccttttttctcctttggcaacttcaccaattcccaagtatgattcttttcaagcgactccatctcatcatgcatagcagttatccatctattgcaatcatcagaaacaatagccttagaatttcttctgccacactcaaagcataagcaactatgttcgcttcttcaatatatcttcgaggaggtttcatatttcttttgggcttatcttttgcaatagaacgttttgaagactgatgaacaatagaagaatctgaatcttcaataacaggtgcatcttggttaatagcaacaacttcgttttctggtgcatgtcctgaactgatcaaatgctccacctgcacacttgctttctcctgactctcaacaggaacattagtagaaggtttgtcatgtaacataactgattcatggaagacaacatttatactaatcacaacctttttagtttcaggacaccataacttatagcctttcacaccagacggataaccaagaaaaatgcacttaatagctctaggctccaatttaccattatcaatatgagcataagcagtacaaccaaatactcttaagtctgaataatttgctggggaaccagaccatacctcaattggagtcttcttatcaatggcataactgcgtgatcgattgataagataacaagcagtgaaaacggcttccgcccaaaactgtttaggcaaacctgcattagacaacatacaacgggcctttgatataattgtcctgttcatacgctcagctatgccgttttgttgaggtgtgtgaggaatggtgtagtgacgcacaatgccttcaaacttgcaatatgatttaaatatcttagaacagaactccatcccattgtcagtacgaaggattttcaccttcctttcagtttgtctttccaccatagttttccactctttaaacacattaaa

SEQ ID NO: 32211 - DNA, 521 bp, Oryza sativa
ccggcggtgaagtcgtagacgcccaacagcggcggcataataggccagccgtgtaggcggaaacaccagtcgacggcagcgaaggtgagccaacggtgaggatgtagacgcccaacagcggcggcataataggccagccgtgtaggcggaggcaccactcggcggcgacggaggcaggccggcggtgaagtcgtagacacccaacagcggcggcataataggccagccgtgtaggcggaggcaccactcggcggcgacggaggcgggccggcggtgaagtcatagacgcccaacagcggcggcataataggccagccgtgtaggcggaggcaccactcggcggcgacggaggcaggccggcggtgaagtcgtacccgcccaacagcggcggcataataggccagccgtgtaggcggaaacaccagtcggcggcgacggaggcaggccggcggtgaagtcgtagacgcccaacagcggcggcataataggccagccgtgtaggcggaaacaccagtcgacgg

SEQ ID NO: 32212 - DNA, 910 bp, Oryza sativa
tggtgtatcatcacccatcaaaacagtaccaccttgaacagcttcgtaggtggcaaaccaatccctattcgggcacatgtgataggtgcatgcagtatcaaaaatccactggtcactagtttgtgcacaaccagcataagcaacaagcaattctgcatcagacttctcatcagtaaaaactgcggctttaccttcctcttctttcttaccttttggtacatttttccggttctcttgtctttgtcctgtagcttccaacactcagatatatcatgtccatctctcttgcagtatttgcatgacttatacctgcccctggactttgatctcccacggtagctacttgaacttttatctcttaatttgttgttggtgttcttctcctgttgcctgccccgaacaaccaagccttctgcttgtgaatttgaaccttcagaggtaccatcttcttcatcttttctttggcatgcaaagcatcataaacttctttcaaagttagagtatcacgactataaagaatagtatccctgaagtttgcatatgagctaggcaatgaacacaatagaataaggcctaaatcctcttcatcatactttacctccatagactcaaggtcagcaacaatttccttaaaagcggagagatggtccattacagacccatcatcttgcaacttgtgcaaaaataatttttgcttcaggtgcatcttactggtcagatccttagtcatgcatatctgttccagcttcaaccacagcctagcagctatctcctccttaagcacctcctgcagaatattgttagatagatgaagatgaatatatgacatagccttacgatcccttttcttctcatcggtggaccaatcttgagtcctcttggcaaatccagaaagcgcatcatcgaggtc

SEQ ID NO: 32213 - DNA, 663 bp, Oryza sativa
aatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagaca

SEQ ID NO: 32214 - DNA, 8188 bp, Oryza sativa
  unsure (1)..(8188): unsure at all n locations
ttcgttgctagataattttttggaggagcttcaagtaagaaaggatgatgtttcggacaccaggattgcgttcaacaaagacccattccttgatgatgctgtcttgtcaaatccaagcaccagtaatggcaacaagtaaatgaggtggcaagtcttattcatccccttttgtaacaatgaagttgtaacattccttcttgtttaatatactgtcttttgttttgagagaaataagagaattagagaatttattatatgttacaatggaaatttgaaaagcatatgcacatgtatggtgatcctgaagatgcgatttcaggaaacaacaacgatgacactagtcggtgacgtagttgttccccacatatgagctatttctacaagggagctcctatcactgtagctatagtcatgcacccccatggtgcgcatgctgttgctgttgtcgatgttgacctcatgcacctctgccttagaccccacttccaactcattctcttgtgactccaaaggcagcatgctgttgtctttctctatcgtctgtgccacgctactgctcactcccgggcatgggcctagattgggataactgtcattgccaataagagatggagctcgattaaggcaatttcatctattaattagaatgttgagtcggtttgttagagatttggtaagagaccgccgtatatggtcttatttgtattaactttaaaaataatagactgagtttgtactcggcatataaatatgaaccccatagcattgaaataagggagccaatccaatataacttcggcgcatcgccatccttttacttttctcgtttttagtgagttcttcgcaagaggaaacccgtctcaatggcctgcgctatcggggctaacatgttaggctcgatatcacgagtcattgctatcatatctcttagttaatctattcttagcttctcaatttagctctatcggctgctgctcgctttagggtttatgctggtttcggttaaattgtcttggtagattagattagctaaggcatctaccatcctgaaaagtgcctaattgcttgattgtttagattgtatgtttcttttcatactttgagatgcatcatttctagtcgtgcttagaaccatgcaaactagtctgcaattagacataataaggatagtatcggggtttcagccgatcttacctaatatgcatgttcactatctgtttcatgtatattcaccacttatatagatagatcattttatataagcatatcaagctttagtcggtatcggctagattcttgcaccttcatgcttgatttctgtttgatatgtttttatggatcaatttgtttatataagtttgtactagagtattagctagtgcattatcttttctgctctaaatattgtcacataagctactttcataatattgtcttaaatcaatctattaaactcgatagatagtattatagccgattaggtgtgtttagggtttattattctttgatatatccagtccatagccgatttggtccaactccatcggctaagaccatcaacgatatgctatcggcctatcggccgattggctatcggtcgactaattctgcttttattcttttttgctgattgcatgatcaaatcaactagcacgcccttgacacacttgaggttagccttggacctgcacaggagttaagcagatatcccaggccgccgtgctttcacatcaaaacaagcgcaccgataagtagtacctctcatcgctcatgaccagcatttccctttttttttataagagatcagttttttctccatcggcaacccttgattcacccacgttacataggaagttaggtgatgggagatttgctcgagatcttgtgatcaacgacatcgtcttccaggctgacgtccctcgttgtcctcaacttggtcagcctcgtccaccataacctccctggcatcctccccgtggccagtcagatacagcctcaatgactgacgtcttgaccagtttgcttgtcttagtagtagggtccataggggtcgatgtttgtattccatcctcacaattcagcatgggaatctttctccgcgtcatgtatagatgctatgccacttgtgcttctcgtatgttgatcatgttattgcctatgggcttttgcacaacttgggtaccatatagatacatatggggcactttatagtagatattatggttttgatgatcaaaatcctaaaccaagcgacatcacacgacttggttttggtttttcatgcgaatttggtgaacattttgctatctcaatctgtaatttttatatatccccttaaactgaaccgttgagttagggtgcggcacctcttaattctcttgcaaccaattgcaaagctaaagacatacattaacttacagtcatatagtggacaaaagctgcatttttctaatataagtgtttgctatttgttgtagctttgtgaaacatctagctaaaagttgtaaaaacaataattttaacaatatgtttgtagttttatgaaatttactctttatttgactcatttatgctctaaatctaaagtttctaccaacatgcacattacttctaagtactaacatcacatcattcgattggtttctgtataaaccaatgattgcgtactactcttaggccctcttaaacttattggcttgaacttttaagctaaagttttagcttataagatttactagatgttatccagtgtgttgctgcaggatagctacacatataaaaaattgaaaattttccgctacagaaaagaataaagcaaagcgcaattttgtcgacgtttgcgatcgcgactacggtatttggatggtatggggatcgttggtactagggtatatgcaagattgaggtaaaagagatagagatagagatttttatacaagttcgggccccttatctgataggtaatagccctacatcctgttggcagaagccgatgttgctctttattcatctggatcacacaaatacaatatttgggacaacctatttagctgtcgtcgacttggcggctagataaccaactcatagttgatgacaaggtagtcttcctcctcgaatctgtactcggcgagatcagagatagtactaaatccctcttgccggtttccgtaggcaccggatggggtatagctaggctaatctccgatgtcgagatctaacggcttgtgttggcttgtggctttgtggcttcgtagattgtggtgggtgtatcccctctccacctaggggggcttgtatttatacccataggtgcccccttgtccaagtaaaactagggaaaccaatatggatataatctgattagtccgtcgtttccatatagaactctactcgtccttccttatccagaactccttctatatacgaggtttgtttccatataagacatggtatgtggtgggccctaccgagcttagtcgattactattgggtatgtggtatccataatcctgacaaatttgtagttaaaaatttgaattaagattttaatgtgttagcctatcaattttctatataccaaaatcaataaacagtgccaactacataggcttgcaagagaaacaacaaattccacataaccaagcagacaacaaaggtcaaatacactaaggatctagtcaaaaaataaaataaaataaaataagcatcatatgaaaacgatgaaagtgcatacatataattattagtgccatgcatattaatccctggagaaatatatactgccataacaaatttaaggtattacattaaacataaaattaattaaagactaatgtacatgagtaaatggctctttgttgatggatgaaatggttgactccttcaaccttgttgcaattatcattgaaccatataattctctacagaataatcgatgaaacatgaataatttcttttaacagaaaataatgtttcaagacgtgtgagcaagcaagctaacctgttaattaatggcaatccataacggggaaacgctgaccatggcagggacctagctagtacacagtaagcaaatgtttggacacaaaaggaaatcaactgaagcatggcaatgcaaaacaatctatatattctacgcatgtctgtgaagttaattgaagattcaaggcaatatatggagtcaggcgactgacttgagtttatatggtgttgttgaggttaagtaatacatgtttaaatgccgtgaataatttcagaagaagattaatgggaagaaaacaataaagagaatacaaatcaccggatggactgtacaattgtactaaaaagatgatccatgcatgaagatatatttaagttgaagtgccataattgttcatcaaaacgtaccaaaaattagagagcaaagggacgcagcttgtctgctccccccgtgtgctcccatccgtactcccgtatatgtggcaacatctccatcgttttggcccatgtacccgattacaaacataaatatttttctattataatataattatgtaagattttgttgtaaagatttaattgcaacgaacacaatggtataattggattgtagatcagataaataatttgaaagaaaattttataagaagagaaaaaagcatgcatacttaacgctcttatgcttctcaagtaaatcggatggctggcagatcgagagacctctcgttttagattttacgttaacaaataatgatacagtcttcttattttgtctcttttcttttactttcggaaatttcggcagcagtttttaaatttgaattcaaaatttatttgaaaatttcgtccaaaatatttttgttgcccccggattaaaaaaaggcaaaccaatagttgaaaccctaattgacactacccttaaatttaagaactaatcatgtatatttcactctcttggaaaagtttgagatgaagacggggagtagtttgtaatccgtacatgactactctgcttttccacctcttctgcctcctatcatgcattcatgcgagcacgccacctttctctctctctctctctctccctccctccctccctctcccctcttcttccccttccattcccgcaaacttcgccaatctgcaacccagccaggctccacacgatttcgcgaagaaaccgaaatccactcggttttcctgcggtagcattggaatatggaagagggattcgtggaatcaggatccttctcccgctcctcctccttcgtaagtgcgtccgaaatgatatctcagaacagggaaaccatctctttgcttggtcttgtttgattgttcttgggaggtttcgttaccctcgatctcggtttcttgcagggtgggttcgaggaatggatggcgctggtgaggaaacgcaatgggagtgggacgccctcctcgtcgtctccgcagcagcccaggtctggtggatttgctgcccaatcttcagtcaggtatatatcatttgtctcccgttgatgtattaacgatgaaagatttgcatctccgttgtactttcgttttccatgtctgacccttacatggatatagattgtactattagattagcatgattcgtattgtgatattttttttttgtaattgtgtttagattatcaccaattcaccatatcagagaaaatgaacaagatacttgtttatagatgtactaaagcatgatttctgctcattcattgtagaaggatacagtgacatgatttcaactgtggcattatgggcacgatgttcttagattgcctcattggatgaggttcttgataaagctcatatcattcagtatctgctaattaatatggtttctgtgcactatatttttcagttcagaaggactagaacttggtcacccttatagcgatgcgattgactatagcttatcataccaactaccaacaacaagcttatgggataggcttgggagggttactatgatggacatcgagtcaagtgacttcaactggagctctctctcttcactgcaccatacaaaacatactgatactagtacagaaccctacgaggatgacaccagcagaagttttgaggtctattgttttcacttgtatcttttacagattatgttttgcattgttggaaaatgttgtcaatactagttataatatcattttttttagaaaacaacagcaggagctctgccggaatttgattagagatataaaaacatagttatactgtcatttcccaacaaaattttattaccatatacttttatctgttttcgaattccattacaaagtgtacatctttgcaactgcatcgtagatatgtatctatcagcataagcctaaaggccagtgcattatcctgcgagagacttcatgtccattagcattccccttcatatgaatgttcaaaataaatataaattttgtttatttgtcatgtctctagctcattttctacatgtatctttcttcataggttacagtaaattctggaggagttgttttcattgcattattcaaaacatctgaatatgatgaccttccgtccaaggagactgcagcggtcattaaaatagcgccttcaaggatggccactcaatcagaacgctttggctatgaacttgcgaaatggcttggagtgaggactcctcaggtgaacacccactttgcttgctggaattctggttaaccataaaaatattacattgcactactctgttggccaatgcagggcagagtgattcacaacttctcatctgaatggcatcaaatgaaggatgcagttgagaacgctcgggatgcagcgatatcttcttgtgatgaactcgaggaaatgatttgcactgagatgctagaggcgctcgaattgagccgatgcttattcctaatgaagtatacacatcaagctaccagtaatgtacatgacggaaatggtccttccttaacatgaaagaatttttgtgctgttttgcagttatgtacatggctcccctctgctagagaacacaatgccatttgattcacatgattctgctgaaaaaactgctgaagctttaggaagggtcttgatactggaccttgtactgagaaatgaagacaggttgcgatgccgcccccttggttggcggggaaattacgcaaatttacttgttgccgacaggaatgcttatgcaaacctcgattcattagatgatgtttatgattctgcaatcattcgttacaagccagagatcatcagaagccctcagaatcggaagccgagaagagcagtttcaataagtggcagtattggctcagatacatctgatctcatgtggccggacaatcctagtcagcctgagatttccagctttcacatcatagccattgattcaggtgttccacgcagaccgcctgcttgcaaacgggcgaaagatcaagagagctatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32215 - DNA, 8478 bp, Oryza sativa
agttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttatgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctatatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttagtgaattaaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgctgggcccgtcacaggtgggcttacctgtgacggctccccggttggcgcccgtcacaggtgaggccacctgtgaccgccacctagttggagcccgccacaggtgagtgccactagggccgacctaaggttggacatcttctagatcgatccagatccggcgcccactctgactcactcactctctcgaccgccgcctcgcctctctcgacctctctgccgccctctacgcgccctcctctccaccgccgccctcgccgccgccaaatccgccgccctctccgccctctccgccaccctctccgccgcctcctcctctcgacctcgacctcgacctctccgccaccatctctgccgccgccctctacaccgccctccccaccgccgccgcctcactcactctctcgaccgccgccgtccttctccatcgacctctccgccgccctctctaccgccatctccgccctctacgccgccctccccaccgccgcctcgacctctccaccgctgccgcctcactcactctctcgacggccgccgggacctcctctcagtcgccacgccaggaccgtcgtcgccgccaccgggatctcctctccgccgcctcctcctctcgaccgggacctccacggtgagcccactccccccgcctcccctcgtttactattggtcgccgattaaccccctcttctcctcctcagcgccgccgtgccaagaagccgccgccgcgccgccgtgctgagaagccgtgcgccgtgcgcctgccgggactcgtcgtcgccgtgtgccgcctcctctgctcgtcgtctcctctccaggtacccctctctctctgatgcccatgaatggaatggtgcagtggatggatgaataaatgatgcaatggaatggatgaatgaatgatgaactttggatgaatgatgaactttggatgaatgatgcaatggaatggatgaatgaatgatttaagtgccattttgacatgtaaccattcatggagtgtgtactgctttatatgttgttttgttcccttttgctagaactattgaattttggggataatgtttacatttagctgaaaaaggatggattgatagattggcaacagtgttaggggttatgttcccttttcctataaataaagcatatacagggtttgaaatttagttcaaatggaaaatacaaaatgcatggggagttttggtggattggttagtgtagtccatggacggaaccgacctagtcaccaaaatttttcatgcattttgttttctataattctttgataattaaggacctttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggatttgcagattatataaacttgttgatttatataccctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtagttatatacctctacacttgttctttttttatgcataagaacagattttgtgcacttgctctttttttatgcataagaacagattttctgcacttgctcttttcttctggattgataaatggccagtgatgaattgctcaataaaaacagattatctacacttgttcatttttttatctattcttctttttgcccctgttgtggctcaatcagtaatgaattgctcaataagaatagtttatctgtacccttattgtgggctgttttttaaatttgcatgattgactcagtggataagaacagagtatctacacttgttctttttttatgcataagaacagatttgctcttttgatgttatgatttcctctttttatcccttcatgcaaatgaatataattgatgcatatttctgagcaaaactgaggccatatctttcagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgttctattttattttctatttcctcttttttctgcacttgctcttttcttctagattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatcattgattcagtggttatatacctctacacttgttctttttttatgcataagaacagatttcctgcacttgctcttttccttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaccaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattacaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcggacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgcttgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatcccgatccatatctaataaaagacatttacacattccaatattaattccaactttcaccttatgtagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgttgcccgtgcccccaaatgatgaaatcatgactttgggcgatgcgggcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcgcaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacatgaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctccttttttttcccttattgacaggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtgtttcagagggcatggctagcaattcctgaggctagccaatatttagcatttattttttttctggaattaactcatcagtgacggttcggaagaaacatccgtcgcaggtaacttcacctgtgacggactcgcaaacgtcggaccgtcacaggtgacccacctgtgacgggcttttactttcgggcccgtcacaggtgggtcaccctgtgacggctactatataccggagatcatcacctctgacgggcctttatttaggggctcgt

SEQ ID NO: 32216 - DNA, 9448 bp, Oryza sativa
atgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccattgtattgagcgaaggatcgtgctatggagaaccaaaagccgtatcctggtttttatgacgctgtcccatatcctcctaattataaaattcctgaatttaccaagtttagtggtgaggatagtaggactacatatgagcatgtagatcaattcttagcgcaatgtggtaggctagtagtatggatacatgtaagttgcgcttgttttctttatctttgtccggtactgttttgatatggtttacttctttaccggcatattctattggtacttgggctcaattagaacaaaaatttcatgattattttcacactaatgaaactaagcttaagttgtctgatttaacatcggttaggcataaatacaacgaatctgttgctgattatattgaaaggtttagagatattaaaagccgatgttttagtttgagaataactgacaaagatttggccaacattgcatatgatggattgcttgattctattaaagagaaattaaatggccaaatatttcttgatgttgatcatgtgttgcatgaagctctggctcagaaaagccaagtggatgataatagtttaaatgctagtttagatgatagtgcaatatcatgtatagctgagccaagagatggttcggattgtggtaataatttgtgcaatgatgccgtgacaagtatagccgaatcaaatgttggtccggattgtcttactaacttggatgataatgttacaaccattatagccgaaccaagtgttggttcggattgtgttactaatttagacaatgatggaatagccgaaccaaataatggtttagattgtgttgctagcttagagaataacatcattgaaaatatagccgaactaagtgacggttcggattgtatcacaagcgaaagtgaaatagcattgtcacctaagatcgaatcacaaatcggtcatgtggatgttagaaaagatgatgacaatgtcttgcgggatagtggtgcaatagaatccaaagtagttatgcatacatatcaaaggccgtatcctgaatatgtagattcggtcccatacccgcaaggatttgaggtgcccaacttcacgaaattcacaggtgagaatgctaggactacaatggagcatatcggccactttattgatcaatgtggtaaggccggtagcgatgatttgcttaagttgaagttgtttcccctttctttattaaactttgcatctacatggtatagtttgcttgctcctagttcaatttctacatggtcacaaatggagcatgagtttcatgattatttcaaagatgcaagtttgatggagcaaagaccgattgatacttcatcggtcacttgtgaaactatttcggttacatctatgcctaaaaccggaattgttagtgatcctctccctattagttctattaatgttgacaaaaagaaagggaaaagtgttattattggggatcctcggcccaagaataggatcaataatgcaaaggccggagatcataaaattgccaaggatgagtcatctagttcccaaaagaccaaaaagccgaagctcacttttgagatgcttatggctaagtacaagaaaggattagccggtcagcgatttgataatcaaacttgtgattcaaaaagaccaagatcatctcgtagaaagagatttggtcaaacatcaaagcaatcggagccatcaaccataccaactccatataaacctccgattgtgatgccatggtatccatatccaatgtcactatatggttatccttttatgtattatatgccatggatgcctcaaccacctatgccgtgtcatcaaggatggaagcaatcacctaggacggtaccaagtcattctaactcaagacaagaccgtttcccacgaaagaatcggtccggtggatcaaaggtgaaaaaggtgaagaaggtgtgggtgagaaaagaagccaaagctccagaggtcgttgctatcaaagaggagtctcaagatgttcatgtacctactggagatgcggtggaaaccacgcaagcaaaggagatcgaagccgacgccgtgactatcaacattggtggtctaaccgagacagctggccggtctaaccgccaatctacggccggtctgaccgaccttactggccggtctgaccgacggcttgtggccggtctgaccgggctcagtggccggtctgaccggggggcaatggagaagagtgggaaaattgagagcaacataggagcttccacttcgaccaaaaatataaagaatcattgtttagctcctggaaaataaccacagccgaagtggataccttccggcttatctcgctctcaaaagaggaggctacaacgtcttcgagtcataggtcaaaaagaagaagaggccgaagatgtggagaacaagacatgcaataatttggagcctcgaaaggcacctaggcaaatgtggagatccaaagaggtaaaagttaagagaccagtgatttcccatagtagagataaatccaatttgatgatagaaaaatcaacggtcgttagagataagtctcctacacatgatgctatgggtgttagtgcggtatccgtcttgccttcgaaatcgcgcaatctagaaaagccgattttgcttggggggcaagacattaatatgctcatcagggaaccaagagaagatgaacggcgatggatacaacatcacatctttgagccgccgtttgttggatgctaaggcaaggtatgagtttattgtgtttaccattatattatatgcctatgccatgttattagaacattgcttgttatctagcacatgtgtgtttttgcttatcaaattgatattatacatacatgttgcaaatgccagttctaggtagtagaattggtaggttggcatataatttgtttgaagtatgatttggctcatgactctttgatatttatttaaaaccaaatcatatgtgtttttatggatcaccatataagatatagatttcatatttattgcgccatgaaagttttgcttattagtaattcggctaatgtcaatggtcaatatgatgatttgctttagagtgattttctttaggaacattggcattgttaatattttacatacatgctcaagccgattacttacatttgtagtttattggaatctatgcatgtgacacatatgactttggtgattcattattgatcatacttcaattggctaagtgttttgatgccatgatgattattgtttcaaaagccatttgaattaatattcatctagacatgttagttggatgttataatttttcatatgtctagagaggagggattttggtccaatagtttgatacactaagcatttggttataatacgaagaaaggagtattttttactagaaaagccggtgcttgatttttatgtctttggatgaaattggccaaatcatagaccaggggcggtctgactggaattacacggccggtctgaccagtgatgaccagtggtctgaccggctctgcatggccggtctgatcggcattccgtggccggtctgaccgatctcgggcaaagagctggggggcacgttacaattgattaaaaggccgaattaattgtgaattcggacatttgtgcccatgagttagaaatagcttggagaattcctttgattagatatttgaaagatcctacacttaaggttgatcgaaagattcggtggcaagtgttcaaatattatatcgccgaaaaatagatggagtattacttagataatgatcaatctaaagttgctaggagagtagtacatgaagggattcgtggaattcatcaatcggccgtaagatgaattggttgcttagaagagtggaattctattggccgaaagtaattgatgattatttcaagtgctacagagggagtgaagcttgtcaatggatcggcaatgttcatttggcgtatgtcgctatattgaatcctatcattataccatggccgttccaaggtagggctttggatttcattggtcagatttatccttcgttatcaaaagggcattggctcgtgctagttgcaatgggttacttcactaagtgggccgaagccgtgccactcgacaatgttacttgtacgaaggctaatggataagccgagtcgagtaataaaacattgttgaaattgccgttttgccagttgaggtaaatcttggctctcttcggtatttcaagcaagacgacatgtcggttgaagattacaagaccttgatgggaagcaattttgaagacgtcattgacaagcgtttgaagacttcgaaggagatgaagacacttcaagacggtgttttcagagagcaattaatgggagatagcttgaagaaatacttcccgagcatttggtaagatgcttaggaagtcctatggccggtaattggattatcgccctgagataacatgttctatgcttttaggttcacgtatgttcaccaaaaaggcaggggggcatgtgtttacacccaaatttggcacctatggacgaaatagggaaaaattgccaaagtttggaaagtgccgggtttccttcacagggccggtcagaccgcaggtatatgggcggtctgaccagctatagggccggtctgaccgcaggtatgtaggcggtcagaccgtcagggtccgagtccgagtctgttttcgtcggatctcgggtttccttgctcgggaaggcatgtttcgtgtttcctttggtttctatcccgagttggacatggagaagggcctgtagagggcaagaccaacccctatttaagggacaaggtccggttcattgtaaaacccctgaatacaatctacttgaatcgttattttactatgttttctattttaccctagtttagtccatctttgtcggtttgcgccgtaaaccgtccgccgccgctgcgagagtgcgacacctctttgtaggtttgtcctgaaaaccttccgttttgcccacgagacgggtagctatcctcatatcgatctaaatcggcctagaggctgattttgatctctaaatcggctccgctagccggtttagcttttccttttgcaaaacccatcttgatttggccctttggctagatcgtggtggttggcgactccatatcaccgcaaggcgtttaggtgttgcgatcgtgcttgtcgacttgtcaaaaaagttgccaacacataccacatagtttgcacggtttatatggagttggtatggttgatggctctgattgctttgatgtttgaccaaatctctttctacgagataatcttggtctttttgaatcactagtttgattatcaaatagttgaccggctaatcctttcttgtacttagctataagcatctcaaaagtgagcttcggctttttggtcttttgggaactagatgactcatcctttgcaactttatgatctccggcctttgccgaggatccccaataattacacttttccctttctttttgccaacatcaatagaactaatagggagaggatcactaacaattccggtcttaggcatagatgtaaccgaaatagtttcacaagtgaccgatgaagtatcaattggcctttgctccatcaaacttgcatctttgaaataatcatgaaactcatgctccatttgtgaccatgtagaaattgaactaggagcaagcaaactataccatgtagatgcaaagttcgacaaagaaagggaaaacaacttcaacttaagcaaatcatcgctaccggccttaccacattgatcaataaagcggccgatatgctccattgtagtcatagcattctcacctgtgaatttcgtgaagttgggcacctcaaatccttgcgggtataggaccgaatctacatattcaggatacggcctttgatatgtatgcataactactttggattctattgcaccactatcccgcaagacattgtcatcatcttttccaacatccacatgaccgatttgtgattcggtcttaggtgacaatgctatttcactttcgcttgtgatacaatccgaaccgtcacttagttcggctatattttcaatgatgttattctctaagctagctacacaatctaaaccatttcttggttcggctattccatcgttgtctaaactagtaacacaatccgaatcatcgcttgattcggctataatggttattgcattattatccacgctagcatttaagctattgttatccactcggctttcctgagccagagcttcatgcaacacatgatcagtatcaagaaatatctggccattcaatttctctttaatagaatcaagcaatccatcatatgcaatgttggcctgtcgcgaccgagaaaattgccttttcccgaacgctagtgtattaatccccgtcccaggaaaagccggggtacaccaaacaaacatgatacaaaaggaacatctttattatatcgataatatttacattattacaaaggcacttcaggcctgacaaacaaaaataaacagcagcggactagcgggcctacggctccatcttcacaggcgctcaactggggtataagtcaggactccacctaaaacttcttctccaaagcttctcttactgaggggggggggaagatagagcaagaatgagtacaaccaccgtactcagcaagccacaccgggagatgcacgattaatacaaggggggtacaaggggtaataataatagggttgggttttgcagtaaacagcatttaaaagtcacttagttgcccaaagctattttgtaaacacgatcctagagctacacaatattattaatcaaggccgtgaaccctcacgaacctgccttaacccaaggcctacgatgattcgaaccaaactggcaacccgacctgggtcccagctcgtcccaagccaacccaggccaaccattccatattttagttgttaagcaaattttaagaattaaaccactaacttgggtacattgctaggcttgcccatatccgagggcacggctattcgaataggtttactctgatcagaggtgtacatctttacccacaagacacatctttactccgtattccatggccttggaacccgtcgtaaacatgtgacataacccttcacccatcctagccgtgaacaaaagtaccgacccaaccctgcctacggccggtatcccgggacaggcaggccaggattgagcccctagcaacaagatctagaccgggtgcgccacacacataggggtgagaccacccgcgtactagtccagtgccatggcatctcgactaacgggcactgacccgtgtagtcttcatttgcctagacatctcaattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgaagaccggtccttatagtggccgagttgctactagcaaaaccatgcacctcgaacgtagcctaaaaccattttgggagttttgaatagagggggggggtgtgtgttcaattccatcacaagccaatcattccacagtgtccaaatgatatgagcattcccaaagtctaaagttaataaaaccacctaatgttgcctaattaatcagcgaagcatctacctaaattcatactagtggaaccgttaatagagtacccactagttggggttttgtttatcctagggtgaacaaggtaataataaacaatagcaataataataaggtcataacaaaggtaaataggcatggctaaataaaatagtgataacgtgggaatttaaataaagcgataatgcattaatttaaatcaaaataattttataaactaggattcaatatgctcaaggatgatggactttgccttgctcagagagaacggccttccgaactttcggcgaaggccgcgaaccacgcttcgggaacctccggaacgacagaagctacgcgaaacacacaagcaaagctacaagcctataaagaagcaataccaatacataaaaagaaagcacacggttctttaggttataacaaacattaggagacttgaatgggtcgattcagagttcgtatgaccaagatatgatcatccgaagtttaatgctattatatggagatttacggattattataattaggttttgcaactataaaacatgtggaagcgctagcctggaagagacaggaaggctgcgccgttgacatgcggaccccacatgtcaacctaaaggaccgcagtagaccgagtacacagagacggtccacgggtagacggaagcagaccccgtgtgtcaaccgaggtgagtggccgacaaacggactcactagacaccacgcgggctgcacagtggaaacaacgcggctaccgagcgggcacactaacacggacactacacggtcaccacccgcacacgtgaacgactaccgacacaggtacacgggtaccggggtcgacagccgcacaacgggtacggggtgacaccaaaaggacgaggacaagggcgacgagggagagatccttaccaccacgcgacgaggcgtgggaacgacaacgacgaaggagcgcggcggagacggctcggggacgacggaggcgaacggcgagggaacgacttcggcggcgatccttggacgaaggtgagacgcggccggcgcagggcttgacgacacggagacgaggacgaagatgacgacggggctgcagcggctcgcttgatgaaccacggatggcgaaacacgatcgggaggacgacgaccggaacgggcgaggaggcgacgagggcagccggcagcagctgcacggaggtgaggacgacgtggaacacgccgctgcgatgcccacgacggtggcggcgcagcgagacgacgagccggcgaggaggaacgactgactggaggagtcgtcgacgaggacgaacggagacgacgataacgaacaccggcggggttcgggtggaggggaggcgaggccgaggacgacctttccgctgcgatgccggaggtggtggtggcgcggccgacggcgcacgggtggaggaagggccgaccggggaaattccggcgaggcggatggagaggccggcgcggcacggcggtgttccggcgaaacagaggagcagccggaggagagga

SEQ ID NO: 32217 - DNA, 2466 bp, Oryza sativa
ggagccgatctagagatcaaaatcagcctctaggccgatttagatcgatttgaggataactaacctgtctcgtgggcaaaacggaaggttttcaggacaaacctacaaagagatgtcgcactctcgcagcggcggcggacggtttacggcgcaaactgacaaagatggactaaactagggtaaaatagaaaaacatggtaaaagaacgattcaagtaaattgtattcagggggttttacaatgaaccggccttgttccttaaataggggttggtcttgccctctacaggcccttctccacgtccaactcgggatagaaaccaaaggaaacacgaaacatgccttcctgagcaaggaaacccgagatccgacgaaaacagactcggacttggaccctgacggtctgaccgcccacataccagcggttagaccggccctactagccggtcagaccgcccatatacctgcggtctgaccggccctgtgaaggaaacccggcactttccaaactttggcagtttttccctatttcgtccataggtgccaaatttgggtgtaaacaccaggtagtgggtgaatcctgatctgccatctaattttatgaaaaacccaaagtcagctaagagtaaaacttgttttgtgaagaaaatagttcagagtaaaaatcgtatagagtttggtaaacatagcatttttatttttttgaaagtattactaaatgggaatttctcccttggccaacttacaaaagggggggggtagggcacttttggtcttttcctacagtcgtatggctctgataccaggtctgtggacccccatttttataacaggaatcaatcgtgtaacagtaccatttccctggatcaagtagtctggtacacacgagttcatagctgaaataccaaatgcacatacacgagagtctagtgcgatttattacatcaaaagcccgcaggcatagtcttagatcatcgaaccgagcggtccggaatacatcccaaaagcagagatagataaggcagcggaattaaggcagcggcatgccattgccacaggcaacgaccgtaactaagacctactgagcgccatcgtcttcatcaccctcctggtaataggcatagggatcctccgaagcttcatctccggcctctgattaagtttatatattgcaagggtgagtaccaactgtactcagcaagccaccacagcaacaatgcacatgattggaatatttcaaggaatggctatggttcttttgcgcaaagcaagttttgcaactcttttcacaagcctaagacctagcatagactgaccaaattttagtactagttcatattaagcaatgacggttctgtccaccatccattgtgatcccaaggatggcttcccgccattgagtcgtcatgtttttctaaggacgtccatcttccctcctctcggaaagtggctccaacaacataaaatcatcatgcaatgacccatcccacacaagttaagaatttagagtctagccaagtgtaatacatgtcctggtgctcaataaccgcgagcacggctattcgaatagatttggtttagtcacactgcagtggatgtacactttacctgcactccgcaactacccaacacatgagcctcgtcccaacacatgagacgcgtcacggcaaagcttttcgataacctcgcattggcagtacccgctccatgaacttttcatcctcatgcactctaggcgtacacagtttctagcagtgagaggagttctggcgcaccgtagagcccctgcctcacacatcaagaaaccactatgcatggatactgcctctgctcagctatttacgctgctaggtctatccccatacgagaagtgcggttgtacgggggtcgtttcatgcttaacttcatggctcggtccttaattgaccagggacggtactagcctttcccagataccacccacatcctccgtccgccccagtctaaaacaagtgtttaatttcattcctactttcacaaatcatgtcatcattatcatggcaatgtggcactcatgtctccacatgccgcatctcaattacgttcccaaaggtaattgcccaagcatatagcatttgataaaatatgagcatacataaatctagagtagcatttctaagcatgggtcatagttgactaaggactcatacgtaattatggttacaaggatttgaaggtaagcaataatcaaggcatggcataattcacaagtaggatgtttatcattgcatgcgatcttatttgtaaacaaaataaattttgcaattgggatcaacatgttcaaagaatagtgatgacttgccttgctcgaagtcctgcgggtcttgaccctcgctcggatccgcaactccctcaggctctacaagtgcgtgcgaagaattgatttgaattccatttgaattcaaataaaatccaataagcaccaaat

SEQ ID NO: 32218 - DNA, 2814 bp, Oryza sativa
caatgtttgagttattctaatcggagggttcacccgagattaatattatccctatttatttttatataatttgcttgaatttaattagagtaaattcttatcccatcgcacctaaatttaattgttaccaatatggtcgcgataatattttatttatttccaaccttacctaatctttattttaaattatattttaatcagttattttgccaatctaattttagggtttattcctaatgaattattccttatttgcgatcggtaaactttgaaaccaaattccaataaaataggcaaataaaaatcggcatgatgcaatttattaaaaagtttttgaaggcccatatttttagagttttgattttcgttggtcgaattttcagggtgttacagagagagaggctctgcctccgggatttggacgcacgcggcttggagcgaccgagcatgggcggctgcggggcacaggcgcggcggggccgacgtggcggcgaccgggtggtcggccacgcgcgagcgcgcgcgcgcggctgcgagggcgcggccggattcaaacggcaacggcgggaaaccggcgctggtgggagagctcaatgagagagagagaaagagagagagagatagagagagagagcgaggaagagaagagagggaatggctctctcgcgtgcgcagcgcacgagcaagcacgtgaggggaggagcagcagaggggagagaaccaggctgagaggagatgggccgaaggagggaattggcccacaaaaatccgagggacgcaaaatagactttgacagagagattgaatttggagagaattggaggttagaaatggaatttggatatctttagagtcagacgaatatttggcaaggttttgagatttggaatttgaattccgaatttgattacttggactcagggaaacaaggaggagtcaacaacgggattcaaaaggggaatttgatatttttaggattgggacaatttatttggcggggattcaaaggatgcgattgacctttggaataattgaattggaattgggatcttgaggtggaggattttgttgccgacgagaggaaataacgatggatttgaattgagatccacggcacgacttagactcagcactcaaagaacgaaaattttcgcatataggattttggcgaattagtttttaacgtcccacgaaaagcggagcgttacatgttccttcacttacgcattgattttgtcttatagttgttctttgtatttgtctctcttcttataacttgatgcgtcttgtggaaaccctatcttccaactcgtctttgaggacaaaccccttacacgtccagagtgttcggcagtccccaacgccgcagtaagctggtctcgctccctccgtgggacgaactgtcctgctctttctttctcgactatctgctgcaaattagtagtcacttgttctatgtctggagtctcgaatagtatgtctccctcatccgagacttgacctgtgttgtgcgcccaaacccagttcttgctacgttccaccatggggtctaccagcagaggtttgccggccgctgcaaatctctgcttggtctcccgccattgatcgacgtgcccagcgtatccgattgacccctatctatgggtatatttgttcttcttcgcgaggtctgacattttttttcctcaaagccaatgcttcaactgttgtatgatctttaacaaacgtattccagtcagcctgcaatatatgtccaaattccgtgaacggtggcagattcttctgatcataatcccgatttagatcggatccaggagggtacacaaaatacttctgcaactcattccagagaagtgtcttgatgttgtcgtccaccgtttcccataacttgacattaatgggacaacgcgtcctgattagagtgccacaggtgttgctaaacttggaccgcactatcggtggctcgacgggcttcccatcctgatcgagagcaatcatgttgtaaatttccttgggtaatttattcttgcttctctcaccacgtctttttttcccactcccgcctgcacttatggatgtatccgtacgttcaggtgcagacgtagcagtgtccatctcaacttcttcctctctcctggtcctcgcgactttacgtttcgagcagcatcagacttccatctgcatagtataggtaactctctacaccattaggttcatgtcacatcatagttagtaaataatatatggctaacgatgttcagcacttatggcctgttccataggtatgtagtctggatcatcatcgcgaggggcgacttgtgttatttccattggaaacgggtcacttggtttgcgccacgtttctttactaaaagtgtcatgctgcttgttgctaccggattttttaggagcggtaccttcttgaggcgctattggtgcgttcgatggaaccttatcgttcgacatcttccaacttgacgtaaaaaaaaattggcataagtcccaatttaacataatttgacatatgtcccaatttgacttaagtcccaatttgacataattccaattttaacatatgtcccaatttaacataagtcccaatttaacataaatcacaattttaacataagtctcatttcaacataagtcccaatttaacataagtcttaattttacataagtctgagattgacacaagtcgcaatttaacataattccgagattgacatcagacccaatatatgtaacataagtgccaatataacattcatcccaatttaacataagtcccaatttaacattagtcccatttta

SEQ ID NO: 32219 - DNA, 15577 bp, Oryza sativa
  unsure (1)..(15577): unsure at all n locations
ggcagcgacgacgagggggccagggagaggtcccgccggcggcaacggggagggcaagggggacgacttcgggaaggagccggcggtggcggggaggacgtggcggcagcgacggcgagggggccggggagaggtcctggcgacggcgacggtgagggggacgacttcgaggaggagccggcagaggacttggcggcagcgacggcgagggggccaaggagaggtcctggcggcggcggcggtgacggcgagggggacgacttcggggaggagccggtagaggacttggcagcgagggggaggtcttggggagtagccggcggtggcggggaggacttggcggcggcgacgcggcgaggggggaaattttggcagcctggcggctagggttcgcgggtgccaggacttagaaaattttcgctccccgcgctccctataagaactaaacaattagatgaattcttaggatgtaatttcaaatcacaaaatgatttaggttaaaatgacccaacaattcgaattaagcgattccgcgaactttgttgtcaatttagaaagagtgtttcgcgttcaacgtttgtgtgaattatttggatttcatttgaattctaactgaattcaaattgttccttcgtacgtaattatagagcctgagggagttgcggatcaaagtgaaggtcaagacccgcaagactttgagcaaggcaagtcatcgctattctttgaacatgttgatcccaattgcgaaattattttgtttacaaataagtttgcatgcaatgataaacatcctacttgtgattatgccatgccttgattattgtttacctttaaatctttgtaaccataaatacgtattagtccttagtcaattatgacacttgcttagaactgctattctagacttatgcacactcatattttatcaaatgctatatgtttggggcaattatctttgggaagataattgagatgcggcatgtggagacgtgagcgccacattgccatgataacaatggcatgatttgagaaagtaggaatgaaattaaatacatgttttagactggggtggacggtgaatttgggtggtatccgggaaaggctagtaccgtccccagtcaattaaggaccgagccatgaagttaagcatgaaacgaccccgtacaaccacacttctcgtatggggatagacctagcagagtaaatagctgagcagaggcagtacccaagcatagtggtttcttgatgtgtgaggcaggggctctacagtggcattgccattggtaggactgccatatgataatttaaaacatgattataacttaatgtgtgtatgaaaagctttccttcccgggtgcgccagaactcctctcactgctagaaactgtgtacgcctagagtgcatgaggatgaaaagttcatggagcgggtactgccaatgcgaggttatcgaaaagctttgccgtgacacgtttcatgtgttgagacgaggctcatgtgttgggcagtcgcggagtgtgggtaaagtgtacatccactgtagtgtgagtaaaccaaatctattcgaatagccgtgctcgcggttattgagcaccgggacatgtattacacttggctagactctaaattcttaactggtgtgggatgggttattgcatgatgaattttatgctgttggagccacttcctgagaaaggggaaggtggacgtcctcagaaaatcatgacgattcaatggcgggaagctatccttaggatcacaatggatggtggacagacccgtcgttgtttaaatataaacactggtactaaaatttgatcagtcaatgctagggcttaggcttgtgaaaagaattacaaaacttgctttgcgcaaaagaaccatagccatcctttgaaatacccctatcatgtgtattgttgatgtggtggcttgctgagtatggttggtactcacccttgcaaatataaacttaatcagaggccggagatgaagcttcggaggacccctatgcctattaccaggagggtgatgaagacgatggagctcaataggtcttagtgacggtcgttgcctgtggcaatggcatgccgctgccttaattccgctgcctcatctatttctgcttttaggatatattccggactgctcggtccgatgatttaagactacgcctgcgggtttatgttgtaataattcgcactagactctcgtgtatgtgcatttggtatttcagctatgaactcgtgtgtaccagactacttgatccagggaaatggtactgtttacacgattgactcttgttataaaaacgggggtccacacttttactcttaaattcaaggatatatactggttgtaaattttttttactgacaagatttaacatttgtaatatttttatactctcaaaatcaacaaagagtaaaatctttactcctgattttagatatttgttccggtctatcaaaaagtatctcgtggtaatggtacctcatgataccaaatcgttttcgatcgttggatctaacaatgaccatcctgcccagttagatccaacgatcggaaacgatttagtaccgtgaggtaccggtacctcgaggtaccttttgttggaccgaaacaaatatcctaattttatgcatgtgtagggatgacgtaaagagagagaggggaagaggagcccatcgactaaagcagaaaaggacaatgagagacaagaggtttttatttttacaaaaaaaaacttgttaaaacctcgcgcgttgcagcgggatattttgttgtgattgttggtttcatttggtaaactgtagtgttataaaaacggtaataagttcattttaggtccctcaatttgtcgtctagtccgaaattcgtccctaaaccgcgataccagatatggcacgtccgttaattctcaaaaccagtgcaaataaggtcccaaggtggtttatacaatggttttggctgatatggcacttacgtggcattgataaaatcagaaaaaacaatgggaaccacatgtcatcaattgttcagttaaaaataaaaaaatacagtgggaccaatgttatctcctctctttcacctcttctctccctcctctctctccctctttgtgttcagaggagagtggcatggcgagtggaaacattgttgagttgtgatccaaattcatttgcacttaataaaggccagcttctgccgtagctcagaggcacagctgatgcttgcttgaagtttggcaggactgataaggggcttgttggatatgtggattcagattttgctgcagatttagataagagaaggtcactcacaggttatgtgtttaccattggtagttgtgctgtgagttggaaggcaacattgcagcctgttgttgcccagtctaccactgaagcagaatacatggctattgctgaagcatgtaaagaatcagtttggctgaaaggattgtttgctgagctttgtggagttgattcttgcattaacttgttttgtgacagtcaaagtgctatatgcctcaccaaagatcagatgtttcatgagaggacaaagcacattgatatcaagtaccattatgttcgcgatgtagtccacaaggtaagctaaaggtatgcaagataagtactcatgataatcctgctgatatgatgacgaaacatgttcctgttgctaagtttgagctttgctcaagcttagttagtatagtgatttagcccgagaggctattttggcgccgaaagtgtttttttgtctttgttgtgttcagggtgaaggattgattcatgctacaagaaggaatttgtctcgaggtggagtttgttgagttgtgatccaaattcatttgcacttaataaatgccagcttaggccagcacctggggacgcctgggggatgcgggggcggagcccccgcggtttggatcgtcatcctttttagggttccaccttntttatacctattgtaagccttttttttttgatgtaacctcacctcttttttagtggagatattttgctggctggcgcccgtggtttttttctctcctattttgggaggggtttccacgttaaatctcttgtcttctgtgaatgatatattgttcttttatcgtttgttcgcctatcgtttcctaacaagcatgagctcattgcggcagtgttctagtaggattttggccgccgctcgtgctcgcgccagcgccagaaccctaagacgtcgctggagccccggcgcactttattcacggcgcagagtgatgccaccatcgacgacctaggctgggccacctcaccccgtcaaacgagctccggcggatgcttgtcctggcggtcgatgtctataactcgatatatatgtgaactgacatgtctccttccaaatcaagagcagcagcatcagcttacccactctttgctctccctcactgctatacacttaatggaaaaatggtcatttcccacaagttcaaattatcaatacaaagctagttgcagtgtccagttcttcgatcaccatctaagctctagctgcagcatataattcagagctagtggccatagcacgtactactagcttgatccgtggctacggtggcgtcgctagcgagagacccgaagtggcgggtgatggggccggatggcgcgatggtgagggtggagcacaagaacggcttttgggccaccatggcgggtttggaagatcggcaccgacgaccatcggagggcggtgcacggagtcaaggtcggcctcacgctcgccctcgtctccatgttctaccacactaggcccctctacgatgatgccagcgccgccgctatatatgtgggtcgtcatgaccgttgtcatcgtcttcgagtacaccgttggtaattgtgtgaccgatcgttgactgtcagcatcacacgtatgtcgcaacgacgtagatggaatgtggcacgtgcatgcgttgcaggtggctgtgtgtacaagggattcaaccaggacaccatgacggtgaatgcagggacagagagggagtggcctcgacgaggtggaggccagcgggcacggaggcagtggagggggtagcggcacgggagaaggaagagggtcttcatcatggcggaggtggtggaggtcgcacgagtggcggccagaatcccacaggagtgccgcctcaacgagctctgccgcctcgtgcttctcctcgctcgccgttcggcgcgctctcctctgaacccaagagagagaggacggaggaggaagggagagaagagataggaaagaaagggatgacgtgggtcccactgtaattttttatatttaatcaaacaatcattgacatgtgggtcccgtggttctttttaacttaatttgtcaacgcaagtaggcaccatgtcaaccgaaatagtcatccaaactgcttgggacattatttacattggttttgggagtagggggacgtgtcatatctggtattgtggtttagggccaaatttcggactctgtgacaaattgacggacataaagttaacttgtttcataaaaatccctcactgttgaattgggccacgatcaacttagatgggcctccagtggtggaaaatatacatgggctcatgtggtggctgtgtgtgactgggttgggttgtgtttaatttgaccatatgctatgttttttcatccaacggttcaaaggcaatcaaatctactgatccaacgactgagaattgacgatgacgtgaaaattgaggtttgagtttaggatcttaattgcagttagtgggttataattttacagtaagaagtgatgtgcggtggggttgaggtgttcgatctggaccattcttcaattgatacattaaggacgttgtatatttgcactgagaccggggtttgcacctgatacttcccgtgtataattgacacatatattgactcactaatataacctcagcaccatacaagctttaaaaggtcacaatatatttatctcaaaatggacttggtttcaccaatatacgcctacaaatgtggaaatttttagcacgaacgataaacagcagtaatatttcctagttcttacaagcatggttgacttataaatagtactacagcatacttaaagtagacaaacagtgcataaaaaaaacatattgctcccttaaacaacattgtcatgttctggcctcctgatgatcccagcatgagtgagaagtgcccagaggattgttatcagctcgcctcccctggcaatggcctttgcatgtgcctttgtattgtcggaaggagcaacatatagcatcatctctgaccaaaactcagcaagcatattccaccccttgttttcattctgaattccatcaaccagctgcttgccgagttgtacacctttgcacaccacctcattgctctttgatttttcactcagtaattgcatcatgcggtcaaattcgaaacacctcatatcagtgctgcccaaaacagagtcggtgatcttcttggcagatttatacaattcttttgaccatggagtgtcatctggcagtagctctgggcacgatgctagcaaatatgcacagtactttgacaagtgaatggcagtgatcatatcatcattctcatcaggagagctatgacgttctgaaggatcatgcatgtgcctgatctcaaagatgcaagttgcaatgtgccaaacaagaataatgtcagatgtcccttcaccattgcaagcccaacgaatatcgtcacgcagatggcacttctgcaaagatgctatgccattgctcagctgcccattgctacctttaagtgagttgatgagagcagccttcaccggctttggtatcttggtaggcttcattgctttagacagcctgaataggtgcctaatatgacctttcctcttgcaaggatctaatagagaggtcatgcccattttgtcaccccagtaattcatgagcttgcatctgcaccacagaaaacaagcaatcaatcgtctcatgattcgagacttttgccatgatggctttgctgtgtaggcgcaaaccagggtaactttggtccagttagagcaaacgtaagatatgatctcccatacctcaccaagcaaaactaccagaagaagggagatcgttggcaccaacacgaacaagatgcttccaatatcatgaaatctatcattatcttgttcaccgcatgttaattcgcaggacattaccctgtagtccttatactctggaagaattttccaagccagtgtaatcacgatgaagatgcaaaatgccatggtaaagagtgaggtcatgatgctcataatgggcaaccacttacccaaatgggagatcgggtgggacgagtaatagaaatcccaagcgaatgatagctcatctgtgataaccctgaacacagcttcaggatctgcgtctgccccatccgtgagcaatataccacgaacaaagtgaaaggccttctcagaacctgcctcaaccagtgggtacctagcaaatcgccttcgcagaagcttaaacaatgagaatgacatgcagagatgtttcagtgctggtcttggccccaaaagagcatcattcatttctgccaaatgccaaactttgtcaatggttaccaagttaccattgcttgtcatcgcacttgtcccgttctggctaaaagtgctacgtttgaagtgataaccatgaggtcctttctcaatctgttgtttgtcttctcccattaccacgagtgctaaaagcctttgtattgtcacctctgcaacttctgatacctgtagtctgtacaattcttccatatatccagcaataagactaggattttgtcccatagcgaaggagcgccgtgccctcccgtatgcaacaaattttagaataatcttgatgaaaccaaggcccagtaatgttgatatgatgatatctggcaattcttcggtttttttttgtgtagtagtacaacacaaggaagaaggtccaaatctgtcgagcaagcatcgctattgattcaaaattcccaccttcatttccattatgaacggcagtcaatattgaacttgtattcatcccaaccattggcagcagcgctgcccatagtagcagacagaatgcgcggttgtcaacgcattccaaaccgtgaaacaagttgtagtacttgtctctgccgacgtaggagacaacataggagaggattggtaggactagagtggatgctcccagaaaaagatagcggttcaaagcaatatgccggtaacgacggccataagagccagctcccacaaggatcaccaccaagaatgcattggcgacgaagagcgcattcgtcgtcagtacatctttgtttatgcgctctatcaagtcgtttgagcggaagccacatgtggtagacgacattatagcttttatagatcttgcaaccttgttgtgacaatctggtttacatatattgcacattcattagggttagactggaaaaagagttagcttataattaagaaattaaccacaaagttatattttttgtgtccctatttattctcacatgtttgaagctcttacctgacctatatggaacaaatcactaaaataaacaaaaaagaaaaggaaaaaagaagaatgtcccaaaaataccaccttgaatttcaatgttagaaatattccactctaaaacatgttctccttgatttatgccatcatagacttgacattaggtcaaaaatattttttgtagctctcccaacgttaaatttaactggacagtgtaattaaatgaaagaaatcaggtttggggtggcatatatatttttagctatgatattctgggtgacatatatcaaatctatgtattatataccaaaagtccactaaacttcctataaacgctccaaagttgtcacgtagcgcttcaacaagcattcctaggcccgccatgtggcattctacaatcccaccatcgattttatgtcgcgtcccaaatcgaccctaaaatagatcctctaaattatgcctagaataattaaaatacttatgaaatccttcaaaaattaaaatgtgcaaagttaaaagtcaaataaggcttggaggatttttgtatatttcctaaaagcctaaaatgtgtaaataaattttagtggaattttcagagcacaaataataattattaagaaataaacaaagttaaaatgattttataaaagaaaaaccttaaaatcccccccctccccctcttgggccggctcggcccatctcccttcccctctccctcctcctccccgcggcccactcggcctctccgagcgcgcgcgccgctgacgggcgggcccgcccgccaccctcactgacgggtggggcccacccgtcatccccgacctcccgccgctcccgccgctccgcctgcgccaagcgccgccgccgccgtcgaatccgccgcatcccgccgtccccgcgtgcatttaagtggggggaatcactccccgtgatcccctctccctttccccccaattttccctccctctctcccttggattcgtttggaaacccctcccctaatcccaccggcgccattgatggagcccgagaacgccgcgccggtttccttcctctgtcggccgccctctctctcccctgccctatttaaaccctccccgcgcttctcccgtccgtttccgcctctcgccgcccttcctcctcgccggattcgagctcgcgccgtcgctctctctctccgccgtcgccgccgagctccggtccgccaccgtcgtcgccccggaccgcctcccacctcggcgccgcctccttcagcttcgccgcatccttgccgacctcgtccacccctccgtttcgctcgccgaccaccggagcaccaccgaccccgtcgacccgagccgcgccaccgcctccctccgctccggccgcctcctccgccgccgccgtcgccccggggtgagccgtggaccgtcgcctcctttcccccttccctcccctctctcggccgccgctccgccgcgccagtggtcgccggcggcgaccatcggggcgcgggcgccgcctcccgccggccgcgtcgacgtggccaccttcgggcgcgccgcgcggttgccgcgtggggcccagccgtcagccgcccgcgccctcggctgcggctgacgcgtggggcccacggcgccggccggagtgagcccgggtgcacccggtccaccgtggaccgtgaggctgccgcgtggttcccacccccgtggacctggtccgcgcgcccctctctcccggctgacacaataaatcccttttaaattaaaatttaaatgaagaaattcgtaaatattcatttaaagagcatataaacttcaaatggccataacttggctatttgaactcggaattggaccgttcaagtctctaatttttccttaagaagtcaagaacccatttttgtgctttgttcctgcttgttatatggagtttattagagtaaaagcccttttcttttccgttgctcgtgtagacgctgcagcttcggaagatccgctcttcgtggaggttgaagccgacgtttgggaaagcgagcaaggcaagtcacatcatctttgaacatattggatcccagtttgtgaaattattttgatttaaattaatgcattatcgctttatttaaattcccgcgttatcactgttttatttagccatgcctgtttacctttgttatgaccttattattattgctattgttattattaccttgttcaccctagaataaacaaaaccccaactagtgggtactctattcatggtgccactagtatgaatttaggtagatgcttcgctgattaattaggcaacattaggtggttttataactctagactttgggaatattcatatcacttgaacattatggaatggttggattattgcgaaattggatgcacacctccccctctattcaaaaccctcaaaatggttttaggctgggctcggggtgcatggttttgatagtagcacctcggccacgtaaggaccggtcttcgggcctctgttgcaaagcactcccgtacttccacatgtctagtgggtaaggcttagtttgtggctcagtatggttataaacaaaagtacacggatggagagggacgaagtcgggggtcgatggacatctctaggacaaatgaatgctacacgagctgcggcccggtagtcaagaagtcatggcacaggcctggtgtcctgctgctaggggctcagtcctgcctacctgtcccggaggttccggccgtaggtggggttgggtcggtactcttgtctatggctaggatgggttggaaactatgtcatgtcttccgtccatatgccatggtggtatgtggcacgtggttgcacgtgaggaagacgtgtcttgtgggtaaagatgtacacctctgatcaaagtaaaacctattcgaatagccgcgccctcggttatgggcaagcctagcaatgtacccaagttagtgttttcaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacagccttgtttaataatattaaatagttctaggatcgtgttttaaatttagcttcgagcaactaagtgtcttttaaatgctgtttactgcaaaacctaacccctatactataactccattgtactccctcgcatttatgttgcacttgtgggtgtgtcttgttgagtacggtggttgtactcagtcttgcttaatttttcccaaacccagaagaggagcccctggatgatgaaggctttggtgtttagctcgtgcttgccgtcaaacgcctgtggtcgtcgccctagtcttccgctgtttcccgtttgtctttgtgtgagctgggccttcgccgcccatgtaataattaactatttacgcttccgcttgttaaactctgaattgtatcaacttttggtgtaccttgcctcctgggacaaggaataatacacgcacgtaaggaacgcccgttgggttatttccggtcgtgacattttagaaggactggatctatgtcaaaatcgcgtgcacaagggcgtctcgggaccaatcagacatgcgaaaaattgtgcgcaaggacgttgtgggcccaatcgtggaagcgcgcaaaggcgcgtatgaaaaatgggcttaatcgctggcctgatcgctgcatgtggcaaggggcacatggaaacgtgcaagcccaaataattcacgcacgtctcagataagagggacactttggcgtaagaaaaaagaaaaaggttttgacagaaacataaaattaaaaacaaaacataaaaataaaaacgattcaaacacgatgacgtgccgaaattccggtgaaaacatcttcaatttttataatagtagattgaagttttaaaatttttataaaatatctataagatggtaatatgaaaccattgtaaaaaaagagaataaaatattttctctcactattaccaatccttgaactcaggatctcttggacaaatcatttttgtcttcaataaactaaccaacttaacccgtgtcattaattgtatatttgtgccttgagtattgtttaacaaacttaccaaattattttgcaaaaaatgtattatttaacagtttgaaaagcgtgctaatgaaaaacaaggaagttgatgtttggtgttgaagaaaagaacagagcctcagaaatatctctacagagttttaaatatttgattaaaatgcctttacatattgttgacggtcgttatcgatcagtttcgatcgtcaatattaccaaaatagaagagaactagtgatgcttgcaatgcataaatatgttagaataataatattccactagtattaggtatactaaccttttgcagagaatgacactaaagtggaggagaatcgacatcaacatggaagataaatcagtctgacgatgtcgagaatcagacttatgcatgaatgggccaagaactcagaattaacacgtcaaactgggccaaaattcataagtctacaaaaaggagcaacagaggtggccgccagccgaaaggtgggctggttgggccggcccctagttcgaccgaacctccctcgcctccgttggatccaggttttggctggacggttgagatgaagccccaatgacggttggagggtattaccgaccattccaaccgtcacaaccgtcatagttcagctataaaaggagctccccttctcacttcactcacacaccttaagcaatagctctctcatttctctcaagtttagtatagtagtatctagctggtaaatagaattagaataggaatcaggagtccggaagtcttcggaagagtttgggtatggctctagtagcttttctcttctcttttgtaagctttgtacttttattagaatactcttctaaatacatttatggtattgaaatactttccgagtatatgagtacctactttacattatgttcatgttatgctgaatatacggctagcttatctgggagatgctttggtgcgggtacaatgtttgcttatgcaattactctatgttatgatgatgatattagagtagtatctggtagtttagacgtggtgtctagattacgggatatcattatttagggttatatattgcggatgagaggtgggccgctgatggtgacagttcagtacgggtattcctctgcgctggtatataatcctaagttaattccctggggagggtatttctccgtatttagctccggttgtatggtcatgacaggctgtcgtaaggaactcggcagtcaggggtggcttctcgaagtaccaggagggcattggatcgaaagtattagctagtatatcagttaactagaatgtatgtatactatgtatattagaagtataggaatagattatctttctcttttctaaccacttagcttagataatatattatgagaatgagtagttaatgcttgtgtgtcactctacctttaaattatcttaacccttgcttagaatatgattataacaagtaatatataaattgttagtcaagttctctctacatgattttcccacgtgataaaataaatacgatacccttggaatattctcgggtgaaatgctacaatggtatatctgtgcgcttgcggatgaactctgtaaccatactataccaggagtatttctgcgccattgttgggaattatatttctagtaatgtcgttaagaaataccaacacttattaggcgcattttaaagtgtaaaaaaaatgcctctataaaatgtgttgaaaatatctctacaatgtctctagagtacacattttctaggcaatttttaatgtgtctataaaatgtttggggtaattgtgttcttgcccttgctttccgattcaattgtacttttacctttttagggattgtgtttttacctttttttcaaaatgaagtagctgtttgaccttgatcatgacgaaaaatttgataatttaacactttttttatttcccaattgttttagttagcacttgtgaggataacatgtggtaccatttgaacgattaaaagtaggccaggatgtcaaataatcgaaaccaattttaaaaactgttaaattatcaaatctctagagtgtggccagaattttcgagtaaaacaaatgggggagaaaataaaaaatgattttgtaatttgtgaatgactgttatacctctcgtgagtaaataaatcactcaagtagctgtgtgaatcaggctccgcatcccaaaaccctagaggatttggcggcggcggcggcacgaacaaagcggcggtgacacgaacaggtgacggggaggcacggcgacgacgcgacgtagggatgaagtatcaggcggcggcgaccgtggggcggcacgaaggggaggcgcgtgcgccgcggaccgtcgccaggactacgggcggacacaaaggggaggcgcgacggggacaacgggacgcaggggaggcgcacgcgcggccgaccatcgtcgggactgcgccgcggaacagcgctgctggaggcaagtaggcgcagaggtggcgggcgggtacggtatcgacacttcgacagcgaccaagtcggccacaacattttgccgctgggtgcatcggcggaagaggaaggtgtcgaccgcatcgtctcatgcgaatcctggacctcctccttgttggatcccagctttgctcaaagctagctaccgctgccaccgaggaactgggagggtttaatcagtggcagatgtaggaggggataataggggtctgaataaactatataaagctacaaccacccttcctatttacatatagcaaaaaaaaaaaaattagcggggctgaggagactgaaatttactccatatttctatatttttcatggattatttgaggagactgagaagagtgggttttgggggcagacctataacattttatacttgttgggtatttgaaatttgttctttggaaaaaagcttgagtattct

SEQ ID NO: 32220 - DNA, 902 bp, Oryza sativa
ccatcgtgaactatcattaagccatcattaaataatagtgaattataagttatcccaatagtgtgctaatgtttctaagcatggctaagcaatcgtatctaatatctagctgaaccaatatataaagcccaactagtcaagttataataacccaaggtatcaaggaataaagtaatcaagaacaaaagggctataacaaacaataggttaattccacccaatgacattcgaaaataaatacaatagttgaatagaaacaatagctttaaacgggatcaacatgctcaaagggttgtttgggatctgtgtgacttgccttgctggccttggaactcttcaaattcttctcctgcgaaaacgaactctccggaaacatcggaatctaaacagaaaagagcaaaaacaccaaaacagcacataaacaagcatgaacattacatgtggatatttttaacatgtagatctcaattttagaaaaatttagagacttgaaccaactaaatccgagctaagatggattagttatgaattttcaaagattaaatcggattaaatcatttatttagattttaattgaattatgacgcaataatgaattatttttgaaaaggaaaagggaattattgcgtcagcggctagggttcgcggtggaccgggtgcacggcggcggctcacggaaacgaacggccgagatcgattcatccaaaacggacgaccgagatcgaccggtccacggccggaccacgggagacgacgacgatgacgtcagcggtgacgtcaccaccggcggcggctcgggcgtgcatgctcgccggcatacgacggcacgacagcgcgaacggagggcacctacgggtagcggacggcacggcgaactcaccggtgaccaaagtagcggcgga

SEQ ID NO: 32221 - DNA, 640 bp, Oryza sativa
atccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatcctctcacctgtgacgggccagaaatgaaagccgtcacaggtggcggcccatcacctctgacggcttctaatttatcggcccgtcacaggtgaggggataccagtgacgggttggaagaaaaactcgtcactggtatacctctgacgggttttcctttcggcccgtcacaggtgaggggatacctgtgacgggcc

SEQ ID NO: 32222 - DNA, 11077 bp, Oryza sativa
aattttgtttttcatgtagtatgagaaaagaagataaaactgattgcctcaccgcatcataacagacaacgactcccagttcattagtgccgacttccaggactactgcatcggattgggagttaagatttagatttgcttcgccacggtttctcaccctcggagcaatggacaagtcgaaagggcagacaacatagtactacaagggatcaagacccgcgtccacgacagactcatgtcacatgacaagaagtgggtcgaagaactcccctctgttctatgggccatgcgtaccacaccgacaacatccaataaggagaaacccttcttcctcgtgtatggctcagaggctatgctccccacggagctacgacatcagagcacacgagttcagaagtattccaacgaggagcaggaggagcagcgaagcgacgatgtgaatctacttgaggaacatcgagaaagagttgccatcagatcagccagctaccagcaggcccttcgccgataccatgagaagcgcatcagagcacacacactttcgatcggcgattacgtcctccaacgggttcaaagccaagcagggtgcaacaagctctcacccaagtgggaaggaccatacacgatcacgcaagtcttgcggccgggcgcattcaagattgcagacagcgatggtcacgagttagcaaattcctggaacatggatcaattacgtaaactttatgtataaatcaatagtatccatatttgtcagataccttgcgatttcaataaagttgatttcaggtaaagaatattgtcaaagtgttccttcccaatgatcccttaccacgacgacacctagagttgaaacctatcctcatgtccctttacgctgtcctggcaaggcctccgaggaacctaagggaacttcggctggggacgcccagagcggataaggcattttcgaattatgcagagacaaacgaccatgtaagatctggtcatgtaagagttctcaccgtgcgtattaaccaagtcgtgtgatcagaaattgagtttttcaactttacggctaggggctagggtcagtgctttttcaaccaaggcaggtcaagggtctaggagccttatcctccgagaacgattctccgacaaggctggggctagggagagtgaatggctcaagtgactaaccgtagttgcaatgtgagaaaaacactcatacacaacatacccagagatacaaaagctaccaggacggccaacgcccatccatggagcagaaaaccttctcggcaagcagcgccattgactgcgcaagaccatcgatctccgcaggtgtcctccgagaacgcgaaaaccctttgcgaaggaaatcgaggtgcagctgcgggcgacgatctcggatataggccagcacatgtccaccggcgtagcggctcgctcgacgacactcctacttcagggtctcgtcgatgtgcttgccaatcccttcgagctgtgcgcaggccccgttcaaccacgagatataaccagcggccgactcctcgggatctccgcggggaactcggagctccttgcaaacctccgccaccgccgtgcagcaactcttgaggtatgagttgaaccacacctcgcgacctcggagggcttccacggcctggtctttcttcacctcaaccatggctctctcgagttctcggccacctcgagtttcgtcttccaatactggattcgacgatctcggtcagctaacgcgttctcaaaatctgcccaacacggaaaggactaagtcaagctactcttctctttcgagaacacggctaattaagtcaattcgagcacgaggagcgaaggaaataaaggcacaaacctaaggacgtcatcgccatgttcgtctccacgaacgggctcttattgacttccaccagcggcgcgtgcggctcaagtgtgagcgccagaacaaccgctggtacatcaggctgcccacgctgctggacatcctcgacagcaacacatctacaatgataaaggtactcagaatcacatgctaagaagacaagggaaacaactgaaagcagttcgagcccacataaagttttacagcatgaagattaaggagtacaagggaaaacaaatatcctactcttcaaaaaggaggaggacagactcccccaagtcaacgacttcctccattgtagccttgcgcgcgtcatcggtggccccccgatccaaggccttcttaaggtctaaatcaggatacgccagcctcatacacacaaggacatggcacgccccagtgtagatgtcgtttgacgtctcctcgccgatcctggcctcatgcttggaggggatctcctccatcgccatagccagttccacgagcgacgacgtcagcgagaactcatcagggtgtgtcgggattgtagtcgtgacaccacactccccggcgagctggtgcaggttagtgaacgacgtccgtagcgaaccccggatgtcggtcatatggccctcgagctctgacatccggtgctcaagcccgcgccgctgcattttgttgccggccaccagctccctcatcttttagaggtcctcgcggcctccaccagatcgcgcgccagctgatcggcacgttcgtttgccgacaacgccgccgccttggcctcctcgatctcgcggcctacaccgcgaacgccagcccggaggatgcgcaacatctccgcttggagctcctcccaggtgagggaatcggcggatagacgatgggtaggcgcgaggccgacgacggggctactcggtgccgtctcctagtccttagaagcaaccacgacttctgtcgaggtcgccgcaggggacgcgttggaagcagcatcagtcccgccttgcgccgcctttgcccacgccgccctgccaagattttttctcttccccatgaggcgaggtaatcgaaactttgagaacgaaaaaacctcaaagacattgacttacttctccccaatcatcaccaacctctgccttcgctgaggcggtggagacgcgcccgagtcctgagtaagataacatgatgtgaggctaagtcgccctgattacacactcaaaggcgaaacagaagcttaccaccgggctcgttgccttccggtgggtcccgatcacggaggagaacttccttcctttcttaggaacattgctgccgcttgtggtggtagcagcagcgtcagatgcctccttggtgacgcgcttcttcagtgacgtcgctgcctagtgatccacgaggggtccgatgacgtccgtcagaaggagagcctgcacaacgtgaagtcatgacgcgatctcgagcagaaaatgtaaaggaattatcgagtacactcacattaatcgtcgtggcgcgctcggccgagtccttgtcgctaagtgggacggggatgtcgcccgcccccgagggtgcgctgatcattatttggccaacgcagcgccccacggtgtcactgtccagacctataaatcgagaacgggaactcgataagtcaggagaaatagatgcactcggaacaatattaaaaatgcaagaaaaataccccgaggagagacccgggtcttgtcctctggcccggagtaatcaaaggccggatgggcacgggcctacagcggttgaatccgccgacctatgaagtcggcagcgacttcgtatcccgacaaccgccgtcttcggagatcatcaatgatatcccgacaaccgccgtcttcggagtcagggcgggtttggcgggccactctgggatttttttctggctggtccttagggaccacgaggacgggatctgagttttctatctggagatagaaccatctcgtctgccatttgctgcgagaagaggggcactggaaggggatgtaacgcgacttcaggtcatcccgaagtcggaatccgacgcatacagacaccctgttggattccatccagcgcagctcataataaaagcggaagagatcaaggaagggcactaccccaatgtaggcctcgcaaatatgagagaagatgctcagaaaggcgatggagttggggtttaggtgaagcaaagaaaggccatagaagttcaaggcgagaagaagaaactcggaaggcggaggaagaaaaccgcaagaaatataatcttcgactacatccatgcggcccaagatggtttcaggttctgtacctccagcctccctttgcatggtcccgcgaccggggagggcaccgtcgtcctacagcttcttcatggacgcggtggtcgaagttgacttctcaagatccatcgctgccagaggatcgccggataactggatgaaggaaatgagctagggttttctttacggggaacggagaagacgaagagcgctagagggcaggagagctttctggcaaacggacttcaaatggattcccaaatttcctttaaataagcgcactcccgatggtgcgtattccaaggaaaggagagagattgctgccagaaaattatgggtacgttgcggacggtggtttttcagacttcaatttaaattcgctcatgaccgttgaacttcgcgcggcgttgtcgatgactctttgtctctacggttttcacaccgggatcgaccagatgataacgacaacaattccgacatcagaagtcgcgattgataacatgagctcatttaagcagaagtcgggggctactgtttgggttacggataaggtataccctctatccttggatgtacagtgggtaccgatacggcatacccacgcgtatacggatagtttccgtatacgataaggaaatctgtcacgtgatagaaacaaaatatacggatgggaggagtcctactcggacgagactgagtctttaccatatcgtgaggggtcctatatctccgagtcctacttggagatcaactgacccgcggtatataagggaccccctgggcaggacctaagacatcgaatattactgccaacacaccccccacactctacagagccggagcgcgtaggagccaagtcgctgggagatctagtcagaccaacttgactacgctcttgtcggtatcatcgagttctgttattccctttgtaccctatggtttccatcatataatcccgtaccaactggattagtgctattaccttccaaggggcctgaaccagtatagtataatccttgtcttctgtttgcttgatgtcgtattacgtagatcctcgtaccaacggaccccaataccctctatattcggtctatgggtatcccccatcgacaaaaacctttgatggattgtaaaaaacattgatggagtaactaatgacaattaatcatgtataagatgtaaaaattacttcctgataacatggaagttacttcataacatgtaataatttacttttcaattaataaaatatttgaatatattcaatatggatcttgttttgtcacatattttgagtggagtacaatgatgcaaatagatcttaaaaacaatatgtgatttaaaagatataagttattaaaaaggttaaaaaaacacactctattgtatcttttaagttgaagggggatttatactggatggagtggtagctggataagacaaaccagtgaccggtagctgtttagtcacgcccttataaataacctaagattcatagtatactatagcgtataacgatcggaaatcctaatcggcgattgatcgcctgggacggggggtagcgatcaatccccctcccctccctccctccacctagtttccttttttggcaccgcattactttcctattttagtaaatttatgcacctaaagtttatatacaccttaagtttacacatctaaagtttatacaccttaagtttacacatctaaagtttagagaccaaaagtttataagtcaaaagtttttatatccgattcaaatttgaatttgaattcaatttttttatatatagtatttctatacatctaaagtttacacacctaaagtttatagacccaaagtttataagtcaaaaatttacatacccgattcaaatttgaatttaaattatatctgattcaaatttaaatttgaattcaaatattttttatatatagtatttttatgcatctaaagtttatagacctaatgtttataagtcaaaagtttacatagccgattcaaatttaaatttgaatttgaattcaaatattatctatatatagtatttctatacatctaaagtttatacacctaaagtttataagtctaaagtttacatacccgattcaaattttaatttgaattcaaattttttatatatagtatttttatacataaatttttctaactttttgtttttttaaaaaaaattgtgtggtgtactgtagtaggaagagaagaaagggaggagggagaggggagaggagggaggagtgtatggagtataggggaggggggctgatcgcttgggcgatcgcctggcgatcgatcacccattaggccccccctataatgacgattagaaaatttggccatcagaagttcagaactaccagaatagttcgaagataattgcagatgaaaaagaaaactacttcaataaatattgcaacatttgtacaattttcatcaaatgaaataactacttcctccgtccaaaaaaaattggggtcttaaggttgacagccaaaattagcttcaaggtaaaatgaccaaattgtccccaggatttgattcgacgctgagcccccatcaccatgccgcctgcgtcctcctcgccttcctcgtctcgcctacgctgagtggaggtctgcttccgccacacttcgcattcgtccggcccttctggtcagtcgtgccatgacctccactgccactacagacgccaattgtgcccgccacgcgacaacaggcgaatcagcgcatgcccacaacctccggagccatgacgaccggcgactcggcgcgtgcccaccaccggtgaatcggcgcacgcctctcacgtatggcctccacagccactacggccggcgaatcaacgagcgccgcgacaactggcgactcaacgcgtgcccgcctcgccattgtcaatgctggtagtggagaggagaggcgtggagaaggattgggatcggggtgaggagcgatggagtaggcgagataacacgtgaggataaggtttttgcggtgttagagcatctttaacagttcccctattttattcccaaaactaattttgagggatttcgtcaaaaaaaaaacagctccaacagatcccctaatctcgtgcccaatttttggaatccccttatcccgaaaactcgctcggtcaatatgaggaggagcgtcgtctcgcctctcccacccccaatctgttgctcccgcgcctctactccctttcccgcacgagaggcaaaatgttcacgctcggtgattttgcatgcccacgccatccagcggcggtggtgtcttctagtttaacagaaaggtctacttctagtttttggaattaaatttaggtgttctcttatagagatcaatttttctacttcctattttcaatttaagaaaccgaaaaacaacttttctagaggaaattataggtatctgttggtgatgctcttatgtgaggaatctatcgacccaaaaaaattagaaacatgtgagccccactttcgctgattaaatatctaaacgaaatttcaggacatcagcccggcggtagagtgtccaatttttttggatggaggtagtagcttgtttaggatgcctgccatctttgaacaattcataagtttcgtgcattacagttcctgagtctaaaccaacctcagaagtgcggtgcacataaagttcggaattcccagcaattacagtgggatatttgcacacagtggttgcagccaatttatatttgggagagacattgtacatttccattacaaaatggataaaacctaccagcatgagggggttttctctcagccttagatgaatggtcttgggcggcgaggcggtgcttaagccacagggatggatccagctgtgggcatggtcggaggtggggccgagggtaacaagagtaattacaaggtgggggcagtggtggcgagggaagacgagaggagcatggcgacggcacggtggctgcacaaatctgctcaagcgcgtcaatctaagccagaagagggagaggtagacaataaggtggatgcattgtgatagtatataggcagccccttttctgtttattgggttaattatgtattttggttcttagttcttacctaggttaaaatattccttttcatagtattaagtaagatgtacacaaaattacttgcattcaaagaatttagaacattatttgttcacccctggatatgcaagttataaatatatctatcattgtatttgactgtttatctgttgatgggcactacaaagtattacatatcacttatttctataaagttaatgcccactataaatatataaaactcaacatgcaagtacagtatttattagcactcataaaacttatatgcaagcataccacgtcaacctattaatcacacaatactcaacgtgcaagaatagtatttattagcactcataaaacctacatgcaagcatgtcacatcaacccattaagcatataaagctcaacatgcaaacatacagtaattatatctataatttatttcattctaaaactaaacatacatatgctaaatcatcatgtacaaatcatttttataatatttcaattcaaatcatttcatcatttcttcaataactaacatatatctggcaataaagcgcgggacatcatctagtaattagaattgcttaaacccgttgcaacactcatatattttggtactcacatagataatatatagcaaaatattatcttgactcaacatgacatcaggcctgttcactttgatgccattttcaaccttatcaaattttggtaaagttacaaaaaaaaagtggctacatttagtttgctgctaaattttggtaactatataagaaatcctaccaaaattttggcaagttgccaaaatttcggcaactatgccaaaatttggtaatgttttttttggcatcaaagtgaacaggtccatcatctgaaactagaccgattaggattcaacatgccatcacctgtctataaattttagattgagatgttaatccatgaaagagagaaatttgcatacaccaatgatacaaatgtggaaaacattttttgcaatttggaactgaagtagtcattatattgtaaattatatgcaatgttccgagtgctacatttttatgatttattacattaataatgataactgatagagtttttaaattctcaacataattaaatagtttgtgtcattaaaaaaccaattgttcgattggcagtcatgtaaaatacatttgaagcaaaaataaaaattaagaaatattttcaacaatacgtacgaataatattcctttcaaatatttacataataatagccaatacaatgcacaggccaggttggcaactagttgacttaatttgcaattcccaatttcctgtcaataaagtctccaaaagactcaaaggcaggtgcaaaaaaacccccggacggccgagattctttcgaaaatctttgcgaggatggattttgatcgtcctgcccaaacctgctggcagcgttcttcctagtcctacaaacattacgaggctcaggcttacgacccatggttacgaaaagcgcaaaccccaccaacgctgaaacaatagctatggaaccggctattagattacgaacccatccaccgatcgacatcaaagccagcacaagtgttgcgctcaagcaaattttcctgcaaaacctgaacagctttagcagctcttccaagtgaaatgttctttccggccagtgctgaagcatccacaagttgacgtgtgaaagagcagaggaggagctaaccatgcacaagctccacctgcaccgggatttcacaagttccctctcgtacgcagcatatgagccagtcaggtatgcgagaagccctacggtagagctgagaatggtgacggcttgcgatctgtaagacaacacattgtcgatgctaactgcagttgcattcctcgcgtcatggtcgaaatgtacggtgaaccacacgagcactgcaacgagtcctggaatgcaggctactatgacatcttccccaatccattctgcagccatcgtgtgaactgttatcagcagcagaacaatgcaggtcttttgcaggactggaagaacctgagctgcaccggggctgacacctgcgggtaatttggcaaccatcactgcaagcgcaccgagtgcggagctgaagaacaggaggaactgcgagaacacaatggtatcgtcttgctgttcattatctggattcagtattgtgctggacaaaagctgcaaccagcacggcagcgttgccaacttcagaagccactcagtgttggggacatgtagtaaggaaactctgctgattctgtaatcctgctgaatgtaaggactagacttgtcccacaatttggtgcagagtgctgcgatgaagacaagcaggatcactggaatgatgaatactccgatatatctagtgttgatcagaagtaggactgcataatctgccatcactagggaagcagcggtgatgtaagtctccaagccaagaaacttgctcatggtagagtgcatcatccttatgtacacgccagtaacaaataaaagcatgctgaaatcggcaaggcccgtagaagttgtactcgctgcagttttatcagaacgctttgttaacttcggagctgcttgcgaaattatacagttaacgccgattgcagatatcaaaagttgctggtagtcatgtaaaggtttcaccgaactgtcgatcgacgggtgatggtatgaaccgctgttggaccaaaagaaactgaattacatatatagttaaaaatctcaattgcgaactttctagcttgcaaaatatacagttaatcaaatcaaaggatagttgccgagacaaaaattattttgggagagaaattagggctgcaggaat

SEQ ID NO: 32223 - DNA, 1224 bp, Oryza sativa
tcctgcagcctttttcctttttctttttttcttctcttttttccccttcctctgtgacccgtgcagaggaaagggaaaaaagaagaatgagaagaaaacgaaaaagaaaaagaaaaaaagaaaaaaagagaaaaggacatgtcacgtccatgtggcattgccacatcagcgccacgtaggattctagagtggatgtgtcaatttgagacctagatgatacactttgacaagttatagaacatggatatgcattctgagagtttagggatctatatgacacaactctacaagtttaaggaccgccgatgcactttactcaaaaaatttcacagaggtcacgcgtaagatctcgatactagccaactaaatcatagttgaatgcaagttttatataagttattttacaattataatgtggttataatttagttacagtatagttacaatgtggttatactttaattatagtcaattacactatacttacatccaaaacttttttttcactcaaaaaacatgatgaagttttttttagatactcccttttgtcacaccctaaaaatcctaaatatataaattgttgtttaattggaattattagaatttattttaaaagcctagaagagaagatctaattttaattaataaattccaatataaaatggggccagataaaatttcattaaatactttgcttaactctataattcctagatttttctgggatttatttgagctaaggaagtatttttaataaatggaattgcatttcatgaataatttaaattgaaaaggtttttaaaatcctcttttggctttgggccgaaagtcggcccaaaaccttctctctctcctggcccaatccggcccgcagccgagccgcctgctcgcgcgcgcgcatccgcccgctgacaggtggggcccacctgtcagggccgtcgtcttccttcggccggccgccgcccgaaccctagcgccgcgccgccgtcgtctccttccaaatcctaccgcccctttccgtttccggtgaaatcaatagaggggaaatgatccccgggatcccctctaccttttctcttttggaatcgtcggctaaaatcgtttgaaatccgtggattcgagttcgattcggatcgatctctctcctccgaaccctaatctttccttctcgtcgccggtcgccgtgggccttcgccgccgccttccaacccctatacaaggacc

SEQ ID NO: 32224 - DNA, 10169 bp, Oryza sativa
attcctgcagccctaattaattacttgccaactaaaacttgataatggtgggttgtgagcacatggttttaagagtcgtgctcatgacaattaaggaccggttcacgagtttcggttgtgaaacattaaccgtgccaatcacaagccagcgtgggcaacggctttaccttttgtatagcatggttcattgcggggcaccagactgagaagtggcggagataagcccacgggggtcgctggggagtccatgccttgtttataagggggtgattatgatccaggaacggtgcgctgtggtggattgtgttgtgcgaggggtactgtcacagctcctttccgaggtaccatggtggtattgagacgcatggtgacatgttgtggggctgtgtcttgtgggtacagtggtacacctctggccagagtaaaactattcgaatagccgtgcccgcggttatgggcgggtctaacaatgtctttcgtgattagtttcacacttcttaccataataaaagatgctataactgtaataatttgtttagctcctggtttggaatggtatattcctggtttggagatagatctgcacagccgggtatggttgttcaggatggttgggcctgagcagcatgggtgtgctgtttagtgttgattaaaattgatgattaattactctactgttttataattctcaaatgtttgctaaatgctgcttttgcaaatgaaccctatattatgccattctttggtatccttgtgcacttgcatatttgctgcgtggcttgctgagtatgtcatatgctcaccttgcaatcattcatcagaggaggagttctacagtgatgctgatggtgtggatgattaggcgtagccctggtcaagctgcctgtggagaggagtcgcctgcgctgtttctttttttttccgctgcttaaatcttattgattgagagggactatctacctctgtaatgacattttattcgcttattaattagagtactaattgtactctattatcaatttgttattgtgtgcctcagctgattcctggacgagggttcacacacatgtaagcgtttggaattttggatagaaattccgggcgtgacacctttcacgaaattggtgtaattttgctactttatctcttttgtgcctccaccacatctgtcaccgccgagaccgaaggaaggggaaaaatatattattccactaacatgtgggacccatgtggatgttaatttttaattttttcttttagtgccatgtcagcaaaaaagcactctcaatactaccttgggacccaatgtgtctcagttttgttatatcagggatgcgttatatcttgtactagttgaaaccccatgcagtgttgcaggaatttactatgataacaataagtaaacaatgcaagcttacataaacataagtttacataagttgatgtgatttaaatttaaatagcttgtaaaatgatgatttaaatgtaaaagtaagatgatgtatctttttgagagaagaaaagaaggaagataatttagatcatacttcttttaagggctaacaaaaattgagatgatatagcttaataagagaagcaaagaagatagataatttgaaccatagattaattatctaaggactaaaaacaattgacgtgatacgaattaatgagagaaaagaaaaatagtatgaactaagtgatgataaattatataggtatataggatattataaaaaatgatggagaactgtataggtatataggatattataaaaaatgatggagaggtacattgaaatatgatttaaaatgcttatattttacatctctaatatttaaattataagagaatctgttctaaaccactgagtttgttcgagctcaatgatttgcacttacattgggtctatctaggcttgtccctcatgttggtctggttggcatgtctcggtgtgttgttggtatttcttaacgacattattagaaatataattttcagcaatggcgcagaaatacttctggtatattatggttacagagttcatctgcaagcgcacggatataccattgtagcatttcacccaagagtattccaagggtatcgtatttgtttaatcccgtgggaagactataatagagagaatcgtctaataatttatatattacttgtatgaaccaaagtctaagcaggggttaatataattcatagggtagagtgacactaagcagaaacattcatactctcattcatgatttatctaagctaagtggaaagaatatagaaagatcatattcctatacttctagtatacatatatattatacatacatcctagttatattattacttagctaataccctttttccgatgccctcttggtgcttcgagaagccacccctgattgtcgagttccttacaacaatctgtcatgaccatccaaccggggctaaatacggaggagtaccctctccaggaaattaacttaggactatatacatgcacggaggaatactcgcactgagctgtctccatcagcggcccacctcgcttctgcagcatataacaccgaataatgatatccagtaatctaaacaccacgcttaaattaccaaatactactctaatatcattgtcatgacatagagtcatcgtaaatacaatcattatacccacaatattgcatgtcccagataagctagcattataataaatataactcggacatataataaagttggtattcatatactcggaaagtaatacaataccaaagtagtataaagaaaatattctaataaaagtgcaagtcttacaaaagaaggaaaagctactagagccatactcggattcttctgaagaatccgaggactaaagattctattctatttctattccactatactctagaaactatactaaactttaaacttgagagatgtatgaagcttcttgttttgggtgagtggagaaagtgagaaggtgaaatctttttatagccgaactatgacggttatgacggttggaatggtcggaattaccctctaaccaccatagggccttcatctcagccgtccagctaaaaccgggatccaatggtggccaggagggttcggtcgaacccactggttcggccgaaccaggggtcggcccatccagcccacaatttggctggtggcctgctcgttctcttctcttcccagacttgtgaattttggcccagttgatcatgtcatttctaagttcttggcccattcattaataagtgtgattctcgacatcgtccgattgattgatcgcttgttttgatgtcgattctcctctattttatgttcattctctgcaagaggttagtagtcctagtactagtggaatctttattattaaaacataaatatgcattgcaagcataactagttctgctttatttttgcagaattgacgggcgaagctgatcgttaacgaccgtcaacaaaaccccccaagcttgaacctttgctccttccgagtaaaggacaaaaggaaacaaagatttggttgttgatcaggagttgttattatgttgtatgtctcaaatgtacaggtgcaaagtatgtgtactctttctcaaatcaaataatctttggcacggtggcttacccttactcctgattctcacgagacactacctctccttgtcctgagcagttgagagacagaacaacaattagagcactaatcacccaatctttattaaacttttactccataagttttcaaatgattttgcaaaagaaatccaagttcctcaaatgattcactcaatctctcaatgtgtatcaaaataaattcctcaccaattttgcctttttgattcctactctaaggtttgatatgtggagcgtgatagggattaaacatggcatacttgcattcatatttattactaagtcaaaaacttagactaaaatagataagtaaacatactctagatcaagatcgtgcaaagtgtgtatgtgtgatatacggtggaaataaaatgtggaaaaataaagaaaatgcttttcctttgtgcttacttccttctccaaaatccttcttttataaataaaggagagggcatggctacacattattccccttttttttcaatatcatgctcatgcttaagagagcacaactttattattttcataaccatgcctttccctcccttttttttcagaaaggattttctttttcaggagaagaaagcacataaaaacatagagaatttattttgacggtggtatgggaatggaatggataattgctagctcccagtgtaggagttgaacatgtgcaaatatgtgggtatatgatcttgatcatagagcatgaaaaatatctacacaagtcacaagaatttgacaaagttcaatgaaattgcaagtaaccaaaatatatatatatggcttaatcaatatggatatttttggctttggtaggaatttatatcaaatgagaaacttcatcagtttatcattttaaaaagaaaaacatccggaattcaagtcaaacttagactaggattatagcaactcttatttactatctcatatctcgcaacaacttagactcagattagcaaatgcagctcatttaccttaggttcctggataattgttggctgctcatattcaatctttgagagagcacttacccttaacccatatgagagatataaaatagagcaactattcatcatttcaataaagagaactaagttgtcttacctagcataataaaatttaacctatcttttttgatattttctattttgtaattttttatgttgttttttttagtttataagatgcaattggaaaaacaaacacgcaatagaaaagggaaacatgcaatgtgatacaagttaccttggtggggggagagacatctccccccaagcttggcttttgcttagggtccttgataaggattgaatccctaaatgcggaagtaagtttgaaggtcatcgtgctgttgctgcatcaaattgttgatgttggtgaactgagcgtcagcattctgttgccattcttgcgtctgtgctatgtgttcctcaaggttgtgttgaatctctcccgtctgcatatcaagggtatccattctcctagtgatttcacccaagttctaacaagaagaacttgagcgccattcaccgggagatggaggcataccgcttgatctgggggactaattgttcaagcctccccattgtatgtcatgaggcgcccgccatcggctctcactggcactttcccagcctgagcctccaatgctatggcatggagcttgggtccatccgggcgcatccccagttggctcccaaccagcctcatacatttgcacgggtgttgaggacgttgaaccttcgcattcatttcttgccatgttgcgtatctccctgtatgttccacctgctcgagtttcttctatggtctgcaggggaatggttagctcatgatagttgtacaaatgatatcccacattaggcaacgggatttcatttgtacaaccagggaaaaagtatatcaaagatccatctagtccatgtttaagaatatgcccttgcactagataattctcatcaacacagggacgaggggttgaaatataagcgatttggtcattagtaataacccatagtcctcttgctctgcaagtaatcagagaagtgcactcaacaggagcagtaaatcttatactctctaaccattatcttatcatacattttacaggagtaactttaatggttcggccgaaccccccgcagcgccgtttgatccaggtttctcctggacggctgagatgactgtaggatcgagatgtcgactagaggggggtgaataggcgatttaaaactaaatgacacctaatcaaaactaacctaagttgctaggcttggtgagggtgaactctaactaagcaactaagttatgttttgcaaacctagggtgatagtagctcaattatatctctaagaaagtaaataacactcctagtcaatgtttagcaatcctagggtgatatgatctcttcctccaagtcctcattgacttcattcaccttgcccttgcccttatcttcaacttcggcttggagagcaatgcacttcttggaaggtgaggcttcctccatctccttcttcttcaacttgtacatgtcattggtgttgatcttacccaagaggcttgcgggtgtcatgtcacgtcctgataaattcatcccaaaataaaaatcatcttctaaaaggaataatagaattaattaaaattcgaaaagaaattggcaaacactaaaatacgtacaagaaaaattcaaatgtgacccggagaatttttgttaaattctccttggtctaaaaggagccctcaaattttagtggaattttcagagcacaaataataattgagaagaaataaacaaagttaaaaaggtttataaaaagaaaatcttaaaagaagttctttttcccccccccttccctcttgggccggctcggcccacttctccctctccctctctctctctcctctcccgcggcccatcggctccccgcgcgcgcgcgcgccgctgaaaggcgggcccgcccgccactctcgctgacgggtggggcccacctgtcatcgccttcctcccgccgcgcccgccgccgcgcccgtgccctagcgccgccgccgccgcggattgcgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggattcgtgctcgcgccgtgctcctctctctccgccgtcgccgtcgaccttcggttcgccgccgacgtcgctccggacgtccttccgactcggcgccacctccatcggcttcgccgagtggttgccgaccccgtccgccgctccgcttcgcccgccgaccgccggagcaccgtcgccctcggcatcccgaaccgcgccgtcgccttcctccgctccggttcgccgccgccgtcgctccggtcttcctcccggctcggcgccacctccctcggcatcgccgcatcgccgtcgacctcgtccgcgcctccgtttcgctcgccgaccgtcggagcgccgccgtcatcgtcatcccgagccgcgccgccgtcttcctccgctccgtccgccgtttccgccgccttcgctgcctcggggtgagccgtggaccgtccccttcgtttcccccttccctcctctctctcgggcgccgctccgccgcgccgatggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgtgggacccacggcgccgaccgccgccagccgcgtgcgcccggtccaccgtggaccgtggggctgacgcgtgggccccacttcccgtggacccggtccgcgcgccccgctccctcggctgacgcaataaacatgatttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtttggagtttattagagtaaaagccttttcttttccgttggtcgtgtagacgctgcagcttcggaagatccgctcttcgtggaagttgaagccgtcgtttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgacattattattgctattgttattattaccttgttcaccctagaataaacaaaaccccaactagtggacactctatttatggttccactagtatgaatttaggtagatgcttcgctgattaataggacaacattaggtggttttacaactttagactttgggaattctcatatcatttggacactatggaattgttggtttatggtggaattggacaaacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggcaggattgggtcggtactcttgtctatggctaggatgggttggaaactatgtcacgtcttccgtctgtataccgtggtggtatgtggcacgtgtttgcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaagcaggttcgtgagggttcacggccttgattaataatattgtatagctctaggatcgtctttacaaaatagctttgggcaactaagtgacttttaaatgccgtttactgcaaaacttaacccctatattattatctccttgtaccccccttgcattaattatgcatctccggtgtggcttgttgagtacggtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatgtcatccttgacatgtcggagttgatgagcatggtgacaagggtctcatacttctccggtagagccctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatatactcgcttgtgccctcatggatctccgccaacttgttccaaatctcatatgcggtctcaagtttgctcactctatcgaactcctcttggctcaaagagttgaacaaagcattcatggcttgggcattgagttggaggttgcggtgatcaatctccgtcaagggcgtgccggtgatagcaaagcctacatccacaatactccaaatattgtggtgataggaagaactacccaagcctcggtcactagggtagttgttccttcactccgaaggtggtgaactccaaaccactcacaaaccggcgtcgggcctcgtccacaatcttctcggagaggtcaccagacaactcctccacaagccgtctaggaggcggca

SEQ ID NO: 32225 - DNA, 4564 bp, Oryza sativa
gtggagatgatcaatcaagtgccacactagctctacaaatggaagcaatgcacttgaatcttggctaattaaccctctaacacactagatggatgaacacaaagctcaagtggatgtgaggcaggtgcaagaggtgtatgcaattgaattgggtgccaagagagtccccttgctgctggcgggggagtatttatactcccacccaccaaaactagccgttgggggcgaaatcccccaatcattgtgctctgccggtcagaccggaggtatgaggccggtcagaccgtgctactctgcaacggctagaaaactagccgttgtagtgctgtcagagggccccatcggctcggccggtcagaccggcgttgagtgggcggttagactggcctcggctcggtttgaccgaatacggctccgtcggctctgtatcgaccaccccgagtagcaccatcccggcctccagggggccggtctgaccgcgcatgagccgccggtcagaccggccttatgggccagtcagaccgccgttgtgaggacggtcataccggccagggcacgccggtcagaccggccacatagtggccggtctgaccgcccctggtcaggccgagctcagtgaaagcaaaggtgagtgtgtgtgtgatgaaaaagtgagcacaagtgaaaatgcaatgacctaatgtggcaatttaatcatctctttgctaggtcataacccctcttaatagtacggcgaaactagaaaataaagtagcaaatttgatcgccctacacctcgatcaattctaaattaaagcactagttttaccgtcttctttctctttgctttgcaccgtcaattttaatccatcgatagtcattgtcacgcccagaaattcactagtaatttccgaacttatttgtgcataaaatcctcgtccaggaatcagccgaggtacacaaactgacaatttaatatacaaatccattataataataacgttacacacttacaaaagaaaagaaaacaacagcgaaataacggtctagcgatggcttcagctccactcccacaggcagctcaactggggtataagccaaacgtcttctacttctggatcctttttcttcaactgaggttgattgattattgcaagaatgagcatatgacatactcaacaagccatacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcctaaccatcctgaacaaccatactcggctgtacagatctaactccaaaccaggagctaaacaaattattaccagttatagcatcaataattattgtgagaggtgtgagactaatcacgaaaaacattgctcaacccgcccataaccgcgggcacggttattcgaatagttttactctggccagaggtgttccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactcccaagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattagccaatcacgattgaccatcgtgaactatcattaagccatcattaaataatagtgagtcataagttatcccaatagagtgctaatgtttctaagcatggctaagcaatcatatctaatatctagctgaaccaatatataaaactcaactagtcaagttataataacccaaggtatcaaggaataaagtaatcaatgcaaacaggccataacaaaggaatagattcacaccacccagtgacattcgaaaataaatgcacagttaaaataaatagagaatttaaatataggatcaacatactcaaaggattgtgtttaggatctgtgtgacttgccttgcaataatcggtcttcaattaatcttcttgaatacttccggcgcactcacgaaccttcgcaacgacggaaacgacaagctaacacgcaaaacgaagaaaaagactaataaaaaccaaataaacagtacaaaaacaagcataaacagtacataaggatatttttaacatgtagatctcgattttagatgaatttagcaacttgaaccagtcgaaaccgagttacgatgatttagttatgaatttccgaagattgaatctattagaaaaacaggaaaaagaaaaacgatgatgacgtcatgatgacctcatcaatggccggaccaagatggcgacctcgccggagattggatggtcggttgcgactttggaggacatgtacacgtagaggacgacgagatgaacccaacggtactcaccctcgaaccaaacgacgaacgacgacggccggcgacgaggtctagcggcggcgcggcttcggtcgacggcggcgacggggctctggtgaccggcgacagcggggagagagcggccgggcttctccaccctcccgcgcacctaacggtggtgacggcgaccggcggcgacgacggaggcggcggcgcgacgcggatggagctcggccggcggcggcggcgaacttggcggcggtggcggagaggctacggggcacgggagaggggcaaacgaaagaggaggactagggggtcctatttatagccatggaaggccgggatcgagcccacaacgacgggaaaaactcgggaaagtttagatcttcgccggaaaaaggaaaggttgaaccgtgaaattggaaaggatttccatataaacttttggggatttcttggggaaaaggaagaggagattgagaggattccattcccacaactaatttggagaaaggagcacgatgtggctggattggtgggaggaggcggcggcactgtgcacgggctggagagctcgggctctgcctgagctggaaaatgaacagtagctcagggaggaaaagtagacttttccggctgggctgagaggagaggaggcagctcaggttgggccggcggaagagagaggaaggaaaggaaggaatgggccgaaaatggcccaagctgaggaggaggatttttatttacttttccaaataaattaaccaatgagatgatctttcaattgttaaaaatacttccaatgctcaaataattccaagaaaaatcttgaacatacttggacactcaaagtatttaatataataatatccagatcatttaatgattaatttattatgtgggtaattactgaaatgctctttgtaagattaaaattaggaattgagctccgaaaaatccgagaatattccagagagtataattaaccatggagaatttaataaaaattaaatccatccatgctttatatttaggaaattttatttcccacatttaacttcacttgaaaattaatgaacatttaatataaattctaataataatttattaaataatttataaatcctgaaacaaaaatcaggatgtgacagtcatccatgcgcacacatgacgtggacctaacttaaaatattatctcaatagcaacggttagtccacaattagcacttgtcattaattaccaaaattaacaacgggggcctagatgcttcaatctcccccttttttttaattgatgacaaacaccacaaatatatatataatcaaacatagaacacatggacatatattgcaatgacaaccaaaagctcccccctaaacatgtgcatatcaatcatagacaataaatatggagccaatgcacatttcaatatcacattccaaaaagcacaaaacacattagcaatatatcaatgtgaacttcaatccataggaataagatggtcacatatatcaatatcacatacaccatccatcatcacacaagttcacatcttaaccatccaaaacacataactcacaaatcatcctaaaagggttcacaaataaacataggctattacaagactacgaggggtccaaatgacatagagtttaataaaacgacaaagaacacacaatatagagaaatagctcatacccatacaaaatatagcccaaactaccttaacctattagatatgagggcactatcctcactactactagtcccaacccacaaaagatagatgtcacgaccggaaatcacccaacaggcgttcccgacgtgcgtgtattattccttgtcccaggaggcaaggtacaccaaaagttgatacaatacagagtttaacaagcggaagcgtatatagaattattacatgggcaacgaa

SEQ ID NO: 32226 - DNA, 16451 bp, Oryza sativa
cgtattttaaggtttgccaatttcttttcgaattttaattaattctattattccttttagaagatgatttttatttcgggatgaatttatcaggacgtgacaaatccaccccccttacaagaatctcgtccccgagattcgaggaggctagcaagaagataggttgggcggtcttctcttcttgtctgacttcttccgtcgcgtcttgacaaacttccagcaaaacttcaccactcggaactgcttggcttgacctcctgttgcggatggaatcttctcttcacctgacttggaccagggtgcaccttttggctgactcagactaggttgcggtagtgcagtgatgcttccgttccagaacttctcatgcttcatatcttcggagtcaacctcagacaagttaccacttcacgtcatgcgtcaacactagcttgtcattactaggatactatgtttgtcatcataagaatatcatgcttgttattcacttctaacttgccatcaactgtctcatattagctttcctggtctccggtgctaggtacttcggctattcgatgcaagggtcaaccactctaactataagttatgcttcccaagagaaccaatttatcccacttgacatactttgacgtcttcccaaatagttttactgctggacttcttattgtctgatcgtgatcctgccagatctgaagcttcgttgttagaggtgatcttaatctgacctctgtagactatcttcgaacatatcacttggttcataactgggaatagctcccacgaacaagcaactcagattcactttctttatgttcagtttactttccgctattctcttcctgttgtcatcagttagcactcaacgtattcctttacacctttaaccttgatgagttctttcccgttggatcatctcccaggacatggcgttgcctggtaaccggtgcttgcatttttcactccgtgtagcatctgataccgagttgaagatttcactctttgccttcatagaaacacttttacctaggtcatcttgcttacttaatgacaaggtgactgttgcgggcaattacaatcaggggtcttccgtgagcgatgcagagcatgtttctgtttatcaatcacctttcggcctacttctttcatgctagagaacatctttgccaatctcttttatcaatcttctttcggcttatctctaacagggggtattctttaatgtggattgcggacgcttctggggatgatgaggtcctttggcttgttgcctttcagtgaaaccttgaagtggtgcgtcaaaagctgcactgactaccttcagggaaatacattgcctgctatccgtatctataccactagggtttaattgccgatggtcatctttagtgcttcctcgagatggggagcatccaaattgttcttctgccacatcaccgttgacctttttctgataccagataaactaattaccaaccatcgactattatgttctcaaatattgatgtctcctggatctccttatctgttggcaggtatatccgatcttatcaatgtagaggtatggcaggtacccttcggggtttcctccaacaatccttatcttgatctgtaaaaggcgtatccgaactcctatcctcaactactgtctcgttggctttttaacccaacacagtttaattgtttttcttttccatccacaggttggctattaactcgaggttagaatatagttcctctgacacgagaccctaggtctcctttgtcagtaaacaattatacacatgatcacatatccgcatctttcaaacgaatcctcatggaacttgtctgtattacacatttctccctcattacatgaatacgaggcactgctttaaacaaaaagggacggtgcttaacatcggtacattgtattctcaatatgaatcatccataagcatagcaagctcactgtttatagacatgaatatatttatgtattacatgattgctgcaaactttcgattacaccacgataagtagcggactgaaaaccacaaacatggctgctcattttgattctggagagatatagctggcattgttccagtgactgcatcctcgattggttctgtgatgatgtgataggactgcataatgctatcattcacaggagaagcttccttctgattgctggttgaagcggatgacggtcttctgcttggtatcgccctccggaggtcgattgccctttgcttggcctggagtaggtcggggagagacacaacttcttccatcgacgacaattctttgctggggctgaaagtgagcattgacaccttgtggtaatgcactcgctggagttggagctgttgcaacgcgggccataggactgctttgggatgcatggatgacaattcgctgaggagcaagcttctgattgcagggagctgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagtgaggctgaaactgtaatcttggcggggatttgtgttgccttgatgcttctctccgttggaactggcgggttggttggccatcttcttcgtcagcagaaaactgaattgacaatcttttggtacatgatcagttccttcacaaaagaaacaagtgatcctgctcatggggcattcaccgggtggatggtcttcctcacaatgaaagcaggtagtggcacacgagctggcaacatgaccgacttctccacaacgagagcatgccttacgttccatttcatcttcatcatctgaggagacttgatctgaatcttcactatcagacactctacctccattagctaaaagatgctctgtcaactgttgtgcacctcggaaggaatttcttctctgatgttttgtcattcctggtggaggccattctgtgctggtaatgatcatcttacggacttcatcttcggttcgcattggtgcttttcttttctgctgaggacagttccttgcatagtgcccttgctcatcacacataaaacagatgatactggcttcttttgggtcaacatgtggcatggcatgaggggccttctgggatgttggcgatgcgctgacttgtggtgtgagtgcttggactgcctccaactgcacttgaggttgcatctgactcgggttcaaaattggcatccgatgctgctgtagtatctctataagcaattggttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattggaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttctccaagatcttcactccttcacagctggcttcactgcttcctttgcttcgctagcggatccaacagtcttccggagcttcggcaaacaactgacgacatcttcttcttcgcaaagctgaccatctagtactagttgaaatttgaagaaggaagaaaagagtaaaccttttgcaaataacattaggggaaggagaaaaagaggaactttcgcaaatagttttatttataaaatatgtccttaggttttatccacttggcttatcctacagtcgagatggctctgataccaacttgtcacgaccggaaatcacccaacaggcgttcccgacgtgcgtgtattattccttgtcccaggaggcaaggtacaccaaaagttgatacaatacagagtttaacaagcggaagcgtatatagaattattacatgggcaacgaaggcccagcacactcaaagacaacaaaaaaaaaacagcggaagactagggcgacgaccacaggcacttgacggcaggcacgagctagacaccaaagccttcatcttcaaggagctcctcttctggacttgggaaaaattgagcaagactgagtacaaccaccgtactcaacaagacacacccacaaatgcagaataaatgcaagggagtacaagggaataataatatagggattaagttttgcagtaaacagcatttaaaagtcacttagttgcccaaagctattttgtaaagacgatcctagagctatacaatattattaatcaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagattatactctgatcagaggtgtacatctttacccacaagacacatcttcctcacgtgttgccacgtgccacataccaccacggtatacggacggaagacgtgacatagtttccaacacatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttctgtttatgactagactgagccacaaactaagccttacccattagacatgtggaagtacggtagtgctttgcaacagaggcccgagcttaatccttatagtggtcggggtgctacttcccacaactggcatgcacccaaaccccaccgaaaacaggttttaggggttttgaaaggggaagagaggtgtatgtccaattccaccataaaccaacaattccatagtgtccaggtgatatgaatatttcccaaagtctatagttgtaaaaccacctaaggttacctaattagattgcgaagcatctacctaaaattatactagggataccatgagtagagtgtccactagttgaggttttgtttgtctaaggtgaacaaggtagtaataacaatgacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgctttcccaaacgccggcttcaacttccacgaagggcggatcttccgaagctgcagcgtctacacgaccaacggaaaagaaaaggcttttactctaataaactccaaacaacaagcaggaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaattaaaaaaacccatttattgcgtcagccgagggaggggacgcgcggaccgggtccacggggggtgggggcccacgcgtcagccgctcggtccacggtggaccgggcgcacgcggctggcggcggtcggcgccgtgggtcccacgcgtcagccgcacccgcgggcgcgggcggctgacggccgggcccacttggcagccgcgagggcgcgcccgaaggcggcctcgccggcacggccgacgggagcggcgcgcccgcgccccgatggtcaccgccggcgaccatcggcgcggcggagcggcgcccgagagagcggagagaagggggaaagcgaacggcggtcttcggctcaccccgggacaacgacgacgacgagaacggcggccggagcggaggaaagcggcggcgcggctcgggatgacgatgacggcggcgctccgacggtcggcgagcgaaacggaggcgcggacgaggtcgacggcgatgcggcgaagccgaaggaggtggcgccgagtcgggcggaggaccggagcgacgtcggcggcgaaccgaaggtcggcggcgacggcggagagagaggagcacggcgcgggcacgaaaccgacggcgagagcgagcggcgagcggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgcggggagtaattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagggcggcgggcgggcccgcctgtcagcggcgcgcgcgcgcgcggggagccgatgggccggggggagagagagagagagagggagggaatgggccgagccggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttatttcgggatgaatttatcaggacgtgacaatagagcacacttttctcccccctttggcatcaagcacaaaaaaggtcttcactcttgtggaggagaaggaggacgcgctgaagtggatacacaaatacttgggagctctccaacatttggactcgagaatccaatgttacccactctagtgtgcaatctccccacggaagcattcaagtctccaacatccgtacgcaagccacgaacatcctcatgtaatgcttcatgcccggtagacaagtgttgaatgctttcacttagggtgttaatagccccaagtaccaggttgaagtattcgttgggttgcattccaaaataagcatactgtggatagaagaaagcatttggatcatacccaggaggaggaggaggtgctgagcttgagctagctccaggatgagaggagggcgccgccctaggagcacggggagctccaagctgaaggctgggcttgtactgcttgtgcttcttcaaattttgcccagcagccccaagcttgtcttgaatcaacctcatgatgtaaggggcataatagattccctaagtaaaggtccaattggagatggcaatctcttgcatcatgagagacacaatgtcgaactgacggccctaaatgatggcatcgatgacgtgccaagccgcccccctaatatgatcattgttaccaaggcgagagaggatggtagctctcacaatcctgttaaccacactggggatagtcgtcaggccagcaaccttcccatgtgtgtactgcactccatcttcataaaactgagagaaatagtctatagagagcggattatgggtgtgctcctcatgcaagtcatctccaaagtccaagcgaatattgaggagtcgccggaattacctcctggagatagaacattgaagggtgttggacatccacttcatctcaccatagtctccagccacccacactgtagcatagaactgccggatcaaatcttcattgtagtcttgtttgagagtcacaatctggtcaatgccaacagtcttgaagagatcctgcaagccctcaaactctggagtctcattgtgtctctccaagaaatccacttatgctctacaaaagctttccctgcataaacctgctcatacacactcttctggaaagcggtgtgaaaacggggatccggggtgtcccgaggcctcaaaaactgatcatggtgcctcaagatggtatattgcgatggagggatcaatatgcatatcatcacttccttcatcctcatcctctccacttccactgtcatcatctccactagcctcctcactagccccttcaacattgacctcaacctcttcatcactttgagcgtactcattgccgcacgattcctcaggctcactcacgggatccggagtgggtgcacgacgaccatggcgagtgcggggaggcatcactatcaaagagcaaaggatgatagatattagtaataattctagaaacaatttggagaggtgaaaatttgcctatatcctatggaggggtggtcagaccacagccagtagggcggtcagaccgatggcatcaggccggtcagaccgcccatagggtcggtcagaccgacggcatcaggccggtcagaccgcccgctggtggccagtcagaccgacggctgccggccggtcagaccgggcgcacacgccggtcagaccggcgactgacccatggtcagaccgcctgtggctctgggcagatctcctcctacaagttcaagcattcaaaaattttcacatcttcacatttgagtctaaaaattgctagaacaatatagcttaagattggaactagaacatcaaagaatatggcctaattcatcaggattggaataactacccatagccctagggtgaaatagattaatttgagagaatgcacaagagagatagtgatttaccggttgaaggggatgaatcacaccaagaaactaccctctactggtgcaaatcgaagaacacctcgttcttcacctagggttccatgccatggataaaaactcaacaaaaacacgaacgaatccatggaatagagagaggaagcggaggagaatcacttacggtgtaaccagagagaaatccacggtcaaaccgaggggatttggtggagaaaagagttagggtttgagggaaggtgagagagagagtttttcgagttggggatgaatcgggatgagatgggagagggtaggtgcaggatggagaagaaaaggggcaaaactgcctgggcccacctcggccggtcagatcggccctattcggccggtcagaccgccgcatgtcacgaccggaaataacccaacgggcgttccttacgtgcgtgcattattccttgtcccaggaggcaaggtacaccaaaagttgacacagttcagagtttaacaagcggaagcgtaaatagttaatttattacatgggcggcggaggcccagcacacacaaagacaaacgggaaacagcggaagactagggcgacgaccacaggcgcttgacggcaggcacgagctagacaccaaagccttcatcttccaggaactccacttctgggtttgggaaaaattgagcaagactgagtacaaccaccgtactcaacaagacacacccacaagtgcaggataaatgcaagggagtagaagggggttataatataaagggttaggatttgcagtaaacagcattaaaagacacttagttgctcaaagctattttgtaaacacgattctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggctgcagctcgtgtagccttcatttgccctagagatgtccatcgacccctgacttcgtctatctccttccgtgtacttttgtttataaccagactgagccacaaaataagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccaaccattccatagtgtccaggtgatatgaatatcccaaagtttagagttgtaaaaccacctaatgttgcctaattaaccagcgaagcatctacctaaaataatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaatggaaaagaaaaggcttttactctaataaactccatgtaacaagtaggaacaaagtacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggtttattgtgtcagccgaggggagggggcgtgcggaccgggtccacgggagtggggcccacgcggcagcctcacggtccacggtggaccgggcgcacccgggctcgcaccggccggcgccgtgggtcccacgcgtcagccgcacccgaggtcgcgggcggctgacggccgggccccacgcggcggccactcggcgcggccagcgggaggcggcgcccgcgcccctatgatcgccggcggccataggcacggcggagcgacggccgagagaggggaagggaagggggaaaagaggcggcggtcctcggctcaccctaggtcgacggcgacgacgaaaaaggcggccggagcggaggaaggcggcggcgcggctcgggtcgacgaggtcgacggcgttccggcggtcggcgaccgaaacggaggggtggacgaggtcggcgaggatgcggcgaagccgaaggaggcggcgccgaggtgggaggtggtccggggcgacgacggcggcggaccggagctcgacggcgacggcggagagagagagcgacggcgcgagctcgatttcggcgaggaggaagggcagcgagaggcggaaacggacggaggaggtgcggggagggtttaaatagagccgggtcgagagagggtggccggggaagggaggaaaccggcgcgggaggtccggccgccatcaatggcaccggcgagatttgcgggggcaaatccgcccgtttgaacgcgagagagagagggaaaaatggggggaaagggagagggaatcacggggaatgattctccccactttattgcacacggggacggcgggatgcggcggaatccgcggcggcggcggcgctagggcgcgggggtggcggcgggagcggcgggaggaaggggatggcgggtgggccccacccatcagcgagggtggcgggcgggcccgcccgtcagcggcgcgcgcgcggggataggccggatgggccgcggggagaggagagggagagggagggagatgggccgagccggcccaagagggagagggagggaaaggggactttttagagtttttctttttataaaaccttttcaactttgtttatttcttaataattattatttgtgctctgaaaattccactaaaatttatttacgtattttaggcttttaggaaatatacaaaagtcccccaagccttatttgacttttaactttgcaccttttaattgttggaggctttcacacggattttaattattctagacataatttagagaatgtattttagagtcgttttgggacgtgacactgcacctggccagtcagaccgcacatatagtgccggtcagaccgccaagccccctgccggctgtgcacagcccttgcacaagtcagcaacccccacacaataaaattcaataaaaaaatgacttttggagcaaattttgaaatgtgtgagtttaaatattgccaaccattcataacatttgaaaattatgaagatttgcaacaaaactcacttaagtgctaggaggtgaccttttatggtctataggggtttttgggcaaatttgattttcaaataacttttgaatgatttgttttttgaaataggtttgaataccaaaaacatttcaaatcttcttctctaccaactttgttttgaaacttttctcaaattccttctcaatctcattttggggaaaaatctcattttggccaaaactaagaatctagtttctttaaaagagggccaaaatggcattttcattcaaaaatcatttttcttgcaatgtgaggcttggaaaacatataggaaaccttttgaaacattttccaagagatagttttcaaattacattgattttgcaaaagttttgacttatgttaacttgggcattttggaaatactactagcaccactagttgatttgatcacatataaagggaagtagagcacatgcaagagtgcaaatctcccccttaaagtgagatgctccattttcgcaatgaagaaccaaatggcaacaaatccaaaatataagagcaaatgagagcaaatatacataatgcaaaaagaagcaaccatgtgcaccatctcaagccacattagagaaatctatgacatttaactcattcctcaatttgcaaaagcgggattcatcaagaggcttggtaaagatgtcggctagttgatcctcgattcttatgtggctaatgactatgtcacacttggctacatggtctcttaggaagtgatggcgtatgtcaatatgcttggttctagaatgttggaccgggttattggctatctttatggcactatcattgtcacataggagtggggttttggtgaaggatatgccatagtccaacaatgtttgtttcatccaaagcaattgggcacaacaactacccgccgaaacatattccgcctcggcggtagagagggctacggagttttgtttcttggatgaccatgacacaagggatttaccaatcatttggcaactaccggatgtgctctttctatccactttgcaaccggcataatccgaatcggaatagccaacaagcttgaacttagcaccttttgggtagcacaagccaatagtagaggattgttttaaatatcttataatccttttcacggccactaagtgacaccccttaggagcggcttgaaaccgtgcacacatgcaaacactaaacatgatatccggcctagatgcggtaaggtaaagcaagctaccaatcatagaacgataaagctttaaatctaccggtttacctccctcatcaaggtcgagatgtctgttggttgccataggagtcttgatgggcttcgcatcctccaagccaaacctcttgagtagatccttgatgtacttggtttggctcacgaacgtcccatccttgagttgcttgatttgaagtccaaggaagaagctcgactctccaatcatggacatctcaaattccctagacatcatatcaccaaattccttgcaaaatacctcattagtagaactgaatatgatgtcatcaacataaatttgacacacaaagaaatcatcaccaatgatttttgtgaaaagggtggtgtcaacttttccaattttgaaatcctttgacaaaataaaatctctcaatctttcataccaagccctaggagcttgttttaaaccataaagagcttttgagagtttataaacatggttagaatttttaggatcttcaaaaccgggaggttgttcaacaaagacaagttcggcaatttcaccatttagaaaagcacttttcacatccatttgaaatagttttatatcaaagcatgatgcaaatgcaagaaggatgcgaatagcctcaagtcttaccacgggggcaaaagtttcaccaaagtccaaactttcaacttgtgtgaaaccttgtgccaccaaccttgccttgtttctcaccaccaatccgttctcatcttgtttgttcctaaagacccactttgtccctatgacattgtggtctctaggtctttcaaccaaagtccacaccttgtttcttgcaaagttgttgagctcttcatgcatagcattcatccaatccagatcacaaagagcttcatctacatgttttggctcaagacaagaaacaaataggtaatgttcacaaatcgaagcgacacgagatcgagtttgaacatccttactaatgtcacccaacacttggtcaattgggtgatccttggaaagaggggtgtgtatccttggtggcataggtggatcttgtgccttctcctccttcacttcaacttgagcttgacttggcgtagcggaagtagatggctcatcttgagtggaggtggatgacttgtcttgcacttcaataggcttgacatatccaattgacatgttcttcatagctctcatcaagccttcatcacctacatcatccaaattctcgtgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaataccctttcgataaatataacacttgcaacaaaaaactcgaaaatatgcaacatttggcttcctcccaacaattagctcataggaagtctttttcaagagacaatgcaaataaagcctatcggttgcatggaaagcggtgtttatggcttccgcccaaaaggaatcggaaacaccatattcatcaagcatagtccttgccatctcaatcaatgtacgatttttcctctccactacaccattttgttgaggtgagtaggtagcggaaagttcgtgtttgataccaagatcatcgcaatagtcctcgatattggtattcttaaactcggaaccattgtcacttctaattttcacaacagtgcaattaaattcattttgggccctttttgcaaactttttgaaaagctcggcaacaatagacttatcatgcaaaaataacacccaagtatagcaagaataatcatcaacaatcacaagacaatgactattaccaccaatgctcttataggttgttgggccaaacaaatctatatgcaagagctccaatagtctagatgtggacatgatactcttagtaggatgagaacatgcaacttgcttgccagcttgacaagcactacaaagcttatctttctcaaacttcacatctttcaagcccacaactagatcacattttgaaagtttgctcaattgattcatgcaaacatgggctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagccaagatcacaaatttaagcaaccgaaagcaaattgaaatttagagatttaacaagagagacattatcaattgacaaatcattggagatagcaattttacctaacccaattatctttcctttgctattgtctccaaatgtcactttctcttgttctttccctcctacttcaaatgtggtgaacatagccctatcaccgg

SEQ ID NO: 32227 - DNA, 14624 bp, Oryza sativa
ccaccggggcaatcattcaccaaatgcccaacctcatggcacttggagcaatacttaccattgcttttgacaaaatgagtggcacggtgagaaggtttcttacccttctttggaatgaatccaagtccctccttgttaaggatgcaccgttgttcactcaaaatcttgtcaagagtgttcttacccttgaagcacctctccaaactcttgttgagcttggccacttgctccttaagctcattattctcaacaacaagtgaggcattacaaatggaaatacgagagctagagctagagctaggcatatccacaagatcatcacaagaggtagaaatgctagatgatgcaatatgagcaatatggcaagtagcactatcatcaagaaaattacaagatatgccaacatcaatgagagctccatgttgagtggtggaaaggaggttgtcatgagcttccttaaacttctcatgagaaatggtgagtctctcatgagaggtctttagctcctcatacaagacctccaaagaagcatgatccttctttagggccttgaacttgacaatctccttctcactataagcatggagctcctcaaacatactcacaagctcatcataggaaacatcatcacaatcatcatcactctcactatcaataagagatgttaccttagaggagccctttgccatgagacaaagtggagcgaagagtgatggagcctccttgatggcaacaacggccatctttttcttcttggagcttgcatcatcaccacattcttcctcggacctggatgaggcggagctctcctcatttgagtcccattccccgatgaatgcctcaatcttcttgccttcctgcttgagcttcttcatgagcttgtagcctccactcttcttcttagatgacttgtctccatcatcatccttggaagggcacttggaagcaaagtgtcccttctccccacactcaaagaccctcaagttggagagagtcttgttgggtcttctatttcttctcctatttgagttgtagccccttcctctctcctttctccttcccaagagatcattgaaccttctagcaagaagggcaatctcttcctccaagtcctcattgacttcatttacctcgcccttacccatattttcaacttcggcttggagagccatgcacttcttggaaggtgaggcttcttccatctccttcttcttcaacttgtacatgtcattggtgttgatcttccccaagaggcttgcgggtgtcatccttggcatgtcggagttgatgagcatggtgacaagggtctcatacttctccggtagagccctaaccatcttttgggcaacctcaacatcggtgtagtttgccccaagccccttgagatcattcacagtggcattgagcctcccatacatgtcttccacactctcatgaggcaacatggagaatgtctcatattggatcttgaggaaatgaagcttggcatccttgtactcgcttgtgccctcatggatctccgccaacttgttccaaatctcatatgcggtctcaaggttgctcactctatcgaactcctcttggctcaaagagttgaacaaaacattcatggcttgggcattgagttggaggttgcggtgatcaatctccgtcaagggcgtgccggtgatagcaaagcctacatccacaatactccaaatattgtggtgataggaagaactacccaagcctcggtcactagggtagttcttccttcactccgaaggtggtgaactccaaaccactcacaaagcggcatcgggcctcctccataatcttctcggagaggtcaccgggcaactcctccacaagccgtctaggaggcggcaaccttcaagagtaacaagcaatgacccggcgtggagatgatcaatcaagtgccacactagctctacaaatggaagcaatgcacttgaatcttggcgaattaaccctctaacacactagatggatgaacataaagcacaagtgggtgtgagagaggtgcaaggggtgtatgcaattgaattaggtgccaagagagtccccttgccgctggtgggggagtatttatactcccacccaccaaaactagccgttggtggcgaaatctgccaatcattgtgctctgccggtctgaccggaggtatgaggccagtcagaccgtgctactctgcaacggctagaaaactagccgttgtagtgctgtcagagggccccttcggcccggccggtcagaccggcgttgagtgggcggtcagaccggcctcggctcggtcagaccgccatcggctcggtctgaccgaatacggctccgtctgctctgtatcagccaccccgagtagcaccatcccggcctccagggggccggtctgaccacgcatgagccaccggtcagaccggccttatgggccggtcagatcgccgttgtgaggccggtcagaccggctagggcacgccggtcagaccgccactatgtggctggtctgaccgcccctggtcaggccgagcttagtgaaagcaaaggtgagtgtgtgtgtgtgtctgatgaaaaagtgagcacaagtgaaaatgcaatgacctaatgtggcaatttaatcatctctttgctaggtcataagccctcttaatagtacggcgaaactagaaaataaactagcaaatttgatcgccctacacctcgatcaattctaaattaaagcactagttttaccgtcttctttctctttgctttgcgccgtcaattttaatcaatcgatagtcatccatgcgcacacatgacatggacctaacttaaaatattatctcaatagcaacggttagtccacaattagcgcttgtcattaattaccaaaattaacaacgggggcctagatgcttcaatgactccccaatgacggttggtgagtattaccgacgtttccaaccgtcacaaccgtcattctcaacctataaaaggagctctcatcttcacttaactcacacacctcaagaaagagctctctcatattctctcaaattagtttagtattattaagttagtggaataggaatagagtagaaatcgggtgttcggatgtctttggaagagttcggatatagttctagtagctttccttttctctttcgtaagctttgtactttatttagaatactcttctatatacatttatggtattgaaatactttccgagtatatgaatacctactttacattatgttcatgttatactgaatatactgctagcttatctgggagatgctttcgtgccggtataatgttttcttatgcaattactctatgtcatgacgatgatattagagtagtatctagtagtttagatgtggtgtttagattacaggatatcattatttggggttatatgctgcggatgagaggtgggccgctgatggtgacagctcagtacgggtattcttccgcgcgtgtatatagtcctaatttaatttcctggggagggtactccgtatttagccccggttgtatggtcatgacgggctgtcgtaaggaactcggcaattaggagtggcttctcgaagtaccaggagggcatcagatagagtgtattagctagtatatcagatgactagaatatatgtaagtataggaatagattttctctctttattttccttttagcttagataatttagtatgagaatgagtagcttaatacttgtgtgtcactctaccttgaattatcttaacccctacttaggctatgattatcacaagtaatatataaattattagtcaacttctctctaccatgatcttcccacggggattaaataaatatgatacccttggaatactctccggtgaaatgctacaatggtatatctgtgctcttgcggattaactctgtaaccataatataccaggagtatttctgcgccattactgggaattatatttctagtaacgtcgttaagaaataccaacagtaagcaaatgggaatcaggctcatctaccacagcaaacctctgccaaccaacagctttccaaatagcacgaaaattaatatccatacctatctttttcagtagctccggagagtactctcgcgtgtgagcatactcccggtctctcagcatttagtaggcttgtcttttccgatcactgacaaggtcgagatcagcatcatttaggagacgtcgcggagcgtcggcatcctccatcgagagattagtggatgaacgagcgctagactcattatgatgacttgatgaagagccggacccattgaacagataagacaatcgcctcctcattctgcacaatggagcaaaacggactaactcagcgggggttagaatagcaagagtttcacccgcaggctagtttcaccaaagcaacttgtatatatgaaactaagtatttaaatttgagggaaactatcaaagcttgaatgaacttgagagcaaactttggagagggaatgaaaatgtgttgaaatggggtggaattccccctctcggccggctggcttttatagggtacccacaacggcaagaaatgacatgtgggacccactagctgttacactgccaaaagtggcaggtggccgttgcctggccggttcggccgaaccctgggtgggcccaaccggccccactttcggccgttgggttccaacggttagtgtggtcgtggcacaataaattatcgttgaaaattttattttggtttgctttgaaaaattcatttgaagaatttcctcaaaattcaaaataaatcctaaatgcaattctgaagttcaaacatgtgctgatgcaaaaaatttaaattgttgaaaacaaatatgcagatacataccaatttacctgttgactaaggtcgtgtcattttaggtccgacgtgcaagaccatacctccttgcagttcagttcgcggattttctacccgtctccggagaaaaggttccagttccctaacggatctgaagcaatggcaaggaattatgcattgcaaacaatggacaagtcatggcgcggatggaaaaacactctaaacacacaatacgtgaagaagggcaagacaccattcaagacatatgggaaaataacatcgttacaatgggacgaatttgttaagttcaagaccttgccggaagaaatggctaagagtaaattgatgtctaacttggcaaagcgtaacaaatggcaccatcgactgggctcaggtggttacgcacccaagatagaacaatggaacaaagaggaggaggaaatgaagaatgcgggggttccggtgcctatggaggactggaacatatgatccaagcactgggtgaaagctagaacaccgaagatcaccttggaaggcaaagtgcaatttgaagaacccgagctacaggtagttgcagacaagatagatgatctatcaagcaaggaaaagaaaggagaattcactccacagagggagaaggatgtgctaagacaggcgctggggaatcgggagcatggaggccgggttcgaggcgtatcctctaagctgagttggaaagaaggtttcaaacaggacgcctcctcatacaagaaatgtgacgcctataaggacaagttgagggacgaagggggtaagcagtttgaaaaagaattgattgatttctacatgaaatattctattccactacaagagcccaaagaaccggagccagaatatcccttcgatgatttacaagagactaaaccttgtcggttgtatgtcccgattggatgcgctgggaggacacttgaggcagcgaagggaattgttattcctggcagaacgtaccatggcagatttattgaatctgcatatgcaaaagtgcagccgcaagaggtgaacatagagttcgagtcgtatgacctagacatcccaacacctgatggaatcatagtacttggggatgtggtcgaccttgtcgttctgtagcacaaaaaggatatcatatttggcaatgtcgccgctgctcctaaaaaaccaccgagacctcctaagcataagccgttgaaggacaaggcggaagaacctgagatacctaagccaactgaagggccatctacacctgtcatgccgcaaaatgaacaggaggtgcaaattgtaccggatgtccaagaaccggctgtggctctaccagatgtgcaagttctgtcatccatcggtgtagagctggaagacatactgtcacgccctgaatttctatccaaaattccaaacacttacatgtgtgtgaaccctcgtccaggaatcagccgaggcacacaataacaaattgataatagagtacaattattactctaattaataagcgaataaaatgtcattacagaggtagatagttcctctcaaccaataaagatctaagcagcggaaagataagataaacggcgcagacgactccactccacaggcagcttgaccaaggctacgcctaatcctccacaccatcagcgtcactgtagaactcttcctctgatgaatgattgcaaggtgagtatatgacatactcagcaagccacacagcaaatatgcaggtgcacaggataacaaaggatggcatagtagggtttcatttgcataaacagcatttaatacacatttcagaatttaataaagccgttaagtaataattaaacaatattaaaccaacactatacaacataccctgttgcataggcccaaccattctgaacaaccatcccggctgcacagttctatctccaaaccaggaatataccattccaaaccaggagctaaacaaattattaccagttatagcatcttctattatgatgaggagtgtgagactaatcacgaaagacattgttagacccgcccataaccgcgggcacggctattcgaatagttttactctggccagaggtgtaccactgtacccacaagacacagccccacatcatgtcaccatgtgccttaataccaccacggtacctcggaaaggagctgtgacagtacccctcgcacaacacaatccaccacagcgcaccattcctggatcataatcaccccctataaacaaggcatggactccccagcgacccccgtgggcttatctccgccacttctctgtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccacaattatcaagttttagttggcaagtaattaattaaccaatcacgattgatcatcgtgaactatcattaagccatcattaaataatagtgagtcataagttatcccaataatgtgctaatgtttctaagtatggctaagcaatcatatctaatatctagctgaaccaatatataaagctcaactagtcaagttataataacccaaggtatcaaggaataaagtaatcaagaacaaaagggctataacaaataataggttaattccacccaatgacattcgaaaataaatacaatagttgaatagaaacaatagctttaaacgggatcaacatgctcaaagggttgtttgggatctgtgtgacttgccttgctggccttggaactcttcaaattcttctcctgcgaaaacggactctccggaaacatcggaatctaaacagaaaagagcaaaaacaccaaacagcacataaacaagcatgaacattacatgtggatatttttaacatgtagatctcaattttagaaaaatttagagacttgaaccaactaaatccgagctaagatggattagttatgaattttcaaagattaaatcggattaaatcatttatatggattttaaatgaattatgacgcaataatgaattatttttgaaaaggaaaaggggtttattgcgtcagcggctagggtttgcggtggaccgggcgcacggcggtggctcacggaaacgaacggccgagatcgatcctatccaaaacggacggctgagatcgatcgggtctacggcggctcacggcagacggaccctgatgacgtcagcggcgacgtcatctccggcgacagctcggcggctcgggcgcgcaagctcgccggcgaacgacggcacttcggcacgaacggagggcaccaggacgatgcgggcatcacggcgaactcaccggtgaccaaagcaacggcggaggagcaacggacgacgtcggcgacgaggtcgaagcggcggagaccttcggcttgacgacgacggcggtgctccggcggcctacagcgatggcgaaggggcggacgaggacggcggcaacttggcgaccacgatggcgacctccccgagcgacgacgacgactggaacaacggcgaagcatggctggagcgacggcgacgacagcggcgcgaggtccacggcgctagggctcttctgacggcgagagacgaaggcgagggtggcggcgggtagaggagacaccgggtcctgttataggggttggaagacggcgacgaaggcccatggcgaccggcgacgagaaggaaaggttagggttcggaggagagaaaccgatccgaatcgacctcgaatccacggatttccaaagcgatttagacgatgattccaaaagagaaaaggtagaggagatcccgaagatcatttcccctctattgatttcaccagagaaggaaaggcgcggccgaatttggaaggagacggcggcacggctcggctagggttcgggcggtggcggccggaggaagacgacgggtccgacaggtgggacccacctgtcagcgaccgagtgcgctcgcgcgggcggctgctgctgtggactgggccgacttgggccggggagagagagaaaagattttgggccgactttcggcccaaagccaaaagagacttttaaaaaaaattttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccatttaaacaacaatttatatatttaggatttttagggtgtgacacataccaacattgcaatgggatgaagcagaaccggacatctataaggacccaaatcctgcaaaggaccctgttgaggagaccctcgtgaatgacacggccaaagataagtctgaagtgcctagagtactcagaagccacgactccaagaaaaaggatgaacacaaggagaagtacatggtaagcgtcttcaagggggcaaggaaagagcactactaagaggggatgatgataagaaggcagctgcactatccggaccaaaatacgtctggactgatgactgtccggaaaacttcgaacttggctaaacttttctgccggattgggcacttgatgaggttcgatgggagatgagaaggtttcatacatggtacatggaagccagcaagaaaggcctacctaatttaactattcaatcaccggcaaatgcttttgccggtgaaggattcttctggcttgatttcaatgatctgcacgccatctatcgtcgggaaaagacggacataaactacgttcctgcatggtgcttgtgagtacaagtgtttatttattgcacgaataagtatgtgatcaattattaacaaattgcttttgtaggatgcaatccatagatgctaagaagatcggtgaacctattggatttctggatccaataaagatctgtcaaactcagcataccatgacattatcaccaaattctgaccagctcaagggcaagactcctgcagagatagcggaatacaagaagagcttgcacaagcagaagatgattattgtcgcacagtgcatcggacgagccttcttgcacttccaaaataagagagtcatcaaggccacgtacaacttcaagtaagtcaagtagattcattgtacatacctatgttatttcatatgtgagtaactgcatcgccattactatgtagcgatcattacatatgttccttatcgacccgaatgcaggcgtagtgatggtcctggacccccttgattattctcacatgacgtatagacattttctacaaatcttacaatagtaagtgattctcatacttgcatgcctactattaatgttttataattaaataacggtccttaatgcgaaacttttgaaaattccatacaatgcgtacaattactacaagttcaagggtggagaacaaactaaaacaagggagaagctgctagtacatacgtattgcccggtatgtaatacttataactcacttaatgtatttcaattgttttattaatttcaaattttaactatttccttctatctcatgaagtgtcacaagcaacctaggggcactatcctctgtgggtactacgcatgcgaatacctccgggttactgggaggtatagggttaacgcagaggatgtaagtctctcgactcaacgtacaagtctattggaccactacacttatgaatcgtactaatgtattatcattctttcgtgtaaacagttgcctagtattgagcgtcgagaaggattcgacgatatgagcattaaaaatgtgcaacaggacctctgccacttcatccaccgcatgtgttgtcatgtcttaggcaagttctttgacccagacaacatccttgatgaggacacaagtagctcagatataaccatggttaccttatgtattaatcaaacaaaggtgaatatgttctacattcgatttacttgttatatatttgaacaaacgatgctacacaataagttttgtgtgttttcgtttgcagaggtacttgcttgaacgaaagaaaagaggccgagcataacgaatgcatggaatatccaagaagttgattggggaccaaatcaagaccttctccaagtcgacttcgagtgcaattcggagcctaggaccagtatgcacgaaaacgggcgcccgggtcgcatacgtgctctgattggggcattctttatatggatggaaagctaagaagataacctttccaatggtttttgtcccacgtccaaattctttccaagtcaacggaaatcaaccgaacaagttgacgtccagaatctatcccggtgctgcgtcaccgtatttgggcctttgggtcgtgtatcatgttggaacccattagggttgtgtcaagaggggattgcacgaccctaaactctatatatcagtagttgccatcacctttagattttgggttttgcttagattattctgtcgagaacagtttcgccgctagatcggtttgtaagaccccaacttgtgagtttaatcattcatctataattttggttgtattttatctcattcttgtttgtgttcttcgatgggcaaatagggattagccttcttggcgaggtcatccgtgtttcgacacgggtgataaccaaaggagacgtggtgctgcaattgcggggctcaagagcgtgcgcgttcaagaagccggatcaatttgtgtcgcgacttcgcccaaatcgttgtttatcagaacatttcagaagatcgggaatcctagtgcacatcaatcctggctacaagcgatgaattcaaggaccttcgggagtagagtaacgcgatgccatgacatggttattagttacagattacagtgtgcattcgaagtgaacaatataaattaatgtacaattttttgtataatgctttgaatgatactttgaatgcaatacatgtcagtattgaatgttcattagttactatcattaattatgaattaattaattaattgcaatattattgaaaaaattattaatacaaaatttgcggctatttcaattcttgatgctattttcctaggcggtcctattctatcatttcgggcgggcttatcttatcttcccaggcggtcagtactagctcctagccgcctgggaagaacatgttcccaggcggaccggccgcccgcctgggaagatattctacttcccaacgattgtctacaggcggaacgccggtccatctgggaaggctatttttgctcgcctggaaatacttttttctagtagtgctcaccccttcaaaaaaaaatttcacacctatcctatctctctccttctccagatatttctctctaactctcctctcctctcttcctctcctctcactctcctctcctcaatctctctcttgcctccgagccgggtggcggtggcaaatactgtgttttttgcaaacgcaaatctatttcaaggtacagtgcagcaaaactgatcacatatcattttcttatgaaaaagatttacattaaaaacaatgacctgatcatattggtggtctttgttggacatggtggcacggtctattgtataactataccaggattcttttatccgtcgtagtctggactacggatacagacacaaagctgtggtcctaagtgcatggatgttgctataatcaaagttgtttatgggcttatggcatgtactgtaatctagatgtagatagggcgccaaaggagataagcacaaggttaggccatcatgttgtatcctaagtaaatgattgttttgttcatctcaatttcaagcattcatatgattggatacaagagtatatcaatcatactgagctttttcagttggtgcttaataatctaaacaagtactccatccttccaaaaaaaaaagacaacctaatattcgtatgtgacacattatattacaacgaatctggacatcttagtacgtggtggttttttttaggacggaggagtacatagtagtagtgtagtactgtatcagcttagcaaattggctccattatggccgtgtttagtttcctccctattcccatctttccagcacatcatatcacatcaaaaatttttctacacacataaactttcaactttttttccaaactcctaactttcttcaaacctactaacttttttcagaaactaaacacaccctatattgctcctcacgaggctcgtgctatcatgattctatttttcacgacactaccattgacttcaccaaatcgaagtcttggctgccccttggtttcagtgtttttgccgcatgaatgagttgcttgtccattcagaagtttcatggaaacagcttaattaagagcttggaagctaaagcagggtttttaatctgtaatcttggaatcatcttcttgttgtatttctgcttattctttttctttcctttcttttcatatgttcttggggttcccaagatgggaacgtgatcagtctaccttgagagtggctttcttgaggatgatcagctaggcaatacatcacttaagaacgtttctatcctttgtggcgatttctccagttcatattgggcattcctccgagggagcgcttggattaatcgccgaggttttgagatggtaagcaggccgaatcatcgttcaaccgaattcatctcatgcatctctatttttatcctatattttagcttgtaccacacatatccttgattccttatacacagcctgaaattgattcgctatcagaaaagtttttagttggggtacacaggtaccaagaaagcataatgcagatgcatagaatacttattgtttgttagatggatcacaatatgaagattccaaagatgttcccctctagctttactttgccaaaaaaatttagctaagaaaagaaagacaatgacataaacgataaaccatactacaatttagtatctgcaaagttcaggaaccaatggcactatccagcgcactatatttcttcagattcctctctgatgactgttctagttcgttatttgcgctcgaattcttagttcttacacgatttttttttctttgccaggatgctctgatgaaccggtcccgcgccttcgcggaggcggtggtgatcatggtgtgcccggtgctcctcgccgtggccctcaagaaggtcgacctgaagagccaggagcgcagccgcgccgtgccgatcttcatgcttgtcatggcggccctcaccctggcattcggcaccgtccccttcctggctctgtccctctccaagaggttcagcgaccacaggtggagactccccgccaaggcgaccacctggctggctccctcgtcgtgcgcctgcctcgtcggcctcgcgtgctggatcatacacctcatcctctccgcgcgctgggcttacgcgttcccggccatgggcaccgtgttcggcctctgcatcgtgatccactccgtccgctactgccgtgcagggggtgacctggctaacctggtacatcctggtgatgtgttgcatactaccgatgagttaactgacagaaaaaggagagaggctttgcagaaggcgatggaaggcaagctggacgagtcgctggagttcttggcgggggtcacggcgctgctgttcctggggctggaagggctagcgttggagggccagatcaatggcggacagggtcgtctcgccgcgcccatggggctatgcttctt

SEQ ID NO: 32228 - DNA, 2058 bp, Oryza sativa
cttcctgatcttgctggtacatgcattcgatctggtcttccccggaggcggcggcggcggcggaggaggagaggacgatgtcgtgaagccggcgtcgctggagctgagcaaggtcgcgttcaccgggttcctgaccgtggcgatatctgccaggacgaccagccgtggcccgctcagcacgtccacccagtggttcctcatctttgcagcgtcggccattgtttcgggcttcgcttggaggctcctgacgcaggccaaagttgggaaaagtgccaatgtagcttccttctgcacgcatttgtgcatcgtgcttgcaacggtgccatttacagttatggccggacaagctctgcactgattatttgtttgtactacagggtaatttggagggttattttgacaggcaaaaattaataaccctttagttgggtttggatgtttggtccagaaaacttttctcttcagtgacaggagtaggactatactataccgtttaaagtgttcagactcaatacgacataattttacctactcagttattttataaaaaaaaaattaaaaaaagacctctttttttacctgaagactactttggattgaagtactgaaatacatttttttagcaaaaaaataaaaaatcttgacatgggatgatcaggttactattcatgttttgcccttttgttatttcttcctctccttaggcctggtttagtttcaacgatacatctaatctttggacacatgcatggagcagtaaatatagataaaaataaaactaattacacaatttgcatggaaatcacgagacgaatcttttgagcctaattactccatgattagccataagtgctacagtaacccacatgtgctaatgacggcttaattaggctaaaaagatttgtctcgcggttttcaggcgagttatgaaattaatttgttcattcgtacccgaaaaccccttccgacatctggtccaacatccgatgtaaaacccaaaaattttcttttcacaaactaaacaaggacttggtacaagccatatcttgtgcattaaaacaactggagaaagattccatgtaatcaactcgcacttcaatttccctgaaaatactactctacaagtcacttgttcaatattccacctcataagccattttattacaaatatttagccctactcaattttgttgtaaaaaccactctagtatacacatgtttagctgaatcaacatgttttcataaattgtgagctatcaatgtgattcattaccatagttaaatacttctaagagtagtatcaatgctttttggagattccataaatataattgttgacgacaggttaaacattatcacactaagtctcgctatatgcaaaaaaaaaaatcaatggaacttgaagaataagtttaatgcaagcacttgaataagattgactcgactagtttaacaacaacagaaaaacgagttgatttcgttaagcctgtggttaagcagtcgaggagctagaggctagagaacgcgaccggagctcacgcagttttagtagacggagtcctcacggagatgaccgatgcaggcggtggggctagacggtgttggagctaagaggacggctagcaacgcgaccgctctgggcagtgggagggggcagtagtgggcttccgccttctgtttggtttcttttttgagtaaatcccttgtgtacacatgaaaactcacctaatcccttctataccctcgaattttacacgatcctctctgtacccctgaaattttgctttgatcccttccatgcccctcccgttaggtttccttcattttcacgttatgtgtggttccaaatgtctaaaacacccttgtagatggaagagtgccagctagagtggcatcaggagggagatggccggcaaagcccgcgcggcaagaggagcggcgaccggtggcccgcacggtgggaggggcggtggccggcgacgcccgcgcgacgggaggggcggtggccggcggcccttgctgtgggggcgcggtggccggcgacacccacccggcggg

SEQ ID NO: 32229 - DNA, 6723 bp, Oryza sativa
  unsure (1)..(6723): unsure at all n locations
gcagaggccattcgcatggaagaggatgagggagaagaaaaggggaactttagtttgggttggcaggggcattttggtattttctaaaaattctgacaacacaatacacggtgtgagcaacgtatctaatggaaacttaacgggaggggcatggaagggatcaaagcgaaatttcaggggtacacagaggatcgtgtaaaattcgagggtatagaagggattaggtgagttttcatgtgtacacaagggatttactcttcttttttggtctcgcctcgcatttctttgcttggtaaagtcttgatctgtctagagatttggtttgttggagggtattttaggatttgtttgtgccttgcacatgcatgctcactagtgctaaataaaacataacattggaaaaaccattatataacacttcagttttatttatttccctaaaatataattctagtatttgaaattagtaagtatgaagttatatccatcttggactctcaactagtattttcttattttaatctaaaattggaaattaataaataaatactccatctgtttcacaatgtaagtcattttagcatttccaacattcatattgatgttaatgaatctagacatatatatctatttagattcattaacatcaatataaatgtgagaaatgctagaatgacttacattgtgaaacggatgaagtattaactagatgtaattgcgtcgatcttttaatctaatctaaagcactacgatttagaaaataaccattgtattgcaacgtacatgtaggctatggcgactagttcacagaagggttctgataaaattattggggggagaggggttgggttaattatatctagctcaagggtgtgaaccagcggtccagcgcggttactgaatatgcttcaattctaaatttccgtgaacaggcaagtagccgtgaaaaagacagaccaagacaacgatattcacaaaggttgtcttactgttgatctattctattgcagatatatttctttgtcaagtttgattactggctcgacatggggaagtagctgggacgtctcgtcaatggagcagcaaattctacaccagcagcggagtttccatcgtacaaaaatagtgattctgaagtgctgagtgcgaactatcaatgatttggtaaagtaaggcctactgatagtctgatatcgatgcatataaaccgtatcatctctgatgtacctatacatagtcagatccaattaatactgtcgaaattttcagaaaatttcaggtaaagatcaggagaggagaaattcgccatggagttagagctggtgtatctgtatccggtgaccttggtgccggcagtcgtcggccggttcagcatccttgcctcgccgttgctgaaggaattcgaggaacacaacctgcaattcaccagcataatcccgctcttcttcttctactcctacatcagcaagttcctctccgacctgcagggtcagccactgcctctagtcaagctctatgcccgggcgctgcaccggtttaccagctgcagcagcagcaaaagccgtgctagcttgaggatctacatggacactgccgtcgtcgtggtgctgtcctacctgtctctgctcaagatcaacctgagctacatctggctcgccgtcttccccaccctcacgctcgccttcatcgncgctctgttcaacgagaagctccgcggtgacaggagaccccccgttgctgaggaagacgatgcaggaggaggaaagatccctcggctcgagcccaaggcgatggtggttgtgccctattaggtgctatgcgcgatggggcagtttcatggaggtgacagctttgcggtgtcccagtttcttctcttcctcggctccacgctgggggcgctggcgctaatggcggcgcggctgtcgcagctcgccggagcagcaccgggcttagcgccggcgtcggaacttctccgcagggccacgctcgtggtgatgctggtgacggcgcacgctgcggccgccgagctgctgggcgaggccacgatagcgctgctctgcctgccggagctcgcgccggcgctcttctggttcacccttcacctcgacggtgaaagctcgccggccgccaccatcgacggcatcaaatcgcacaggaatgtgctgtccgttctcgctgccgcagccgtcgccagtgttgcgtacctcgcggccgccatgggtgagcgtggcctgtccgtgagcaccatcacgatggtgtcttgcggcgtctcagggcttctggtccgctgcgctgtggtcgtgctcggtcagtggccggggcaagctgagacggccggtagtactgctgcctctttgatggaagttgtcctagtgctcaagttttgggggaacactttgctggcagtggcagctatgctgctgctgcttgcgttgctgactgctttccggttatgccttcaagaaccaatgttcgcgacagttgctaaatgtttcagcgactacattgacaaggtcccccaaatgatagtttagctgaaggggcacgttcatgtatttcctgtgttgacatatctgtgacttctcaagacaaacaaaaccgcatgttcataacacagtgccatacttgcaggtaccttaatccatatactgttatccatgattcgcagcccatagtcagaagcccactacaataccgtgacacaaacggacttgtttttggtaatcatcaggctgcttagcgatatatagcttgcctacctagcacctcacacataactacttgtaggaagtacaaaatacatgtgtttacccctcccctgttcacacataaaactgctagaaattggcaaaaaccctccacacacagatttccaacagactcgtcggacaaacatcccagttccactttgatgttggtattgtatcttatatcaattcctgtaactacttatatggcagaaagcaaaatgtttaacattaatatatcagaaagtataactaaaacaggaagacaaacctaatagcacatatatacgtatcaaaattccagcacatgcatgttggcagttttaccacaataattgtattaagctaaacccagagtacattaatccacctctatacaaacaaatttggagtttagcccttttacattcatcaacaaacagaaaatatagagtttatcttaatcagaagtgatatatcaggaattagaaatacagcacataaaggaactttgggaaaacatgaatatagaagcagatccctttgatgcacctaatggtaaaaaactgatgtcaaaagattaggtatcaacaatatgctcagaagtagtctccaagagggagcatagatcaattcagttttcaggccagtagtatccaagagggggcatgaatccagttttaggactaacctctttgaaagctgggtactaggttgtgaataggagagaagcagcaggtctaccaataagttaatagcaacatagcttattttaatactgatcatacacatagataccacccaaaaagaaacacattactttccatatttacaggaaacggggtagatagcagcattacaccacctgggaatgctgtcctggggatacaaggacattttcatcgccaccttgtataaacctctcgcaagtagcataccatattccttgaccccgttcctcgatcccatcaacccaggaacagaaactttgagcctatgttctggtccttaacagtgggatcttaactgatttgaagaatcataccacatgttgacaaaggatggtctactagagctcttaacatagagtagtttatattcagataaataaatgaataagacagtcttgtgagcttggtttttgaagataacaatcaaggccaacccctgttctgcttcaaaaaagataacaaatgaacttaccccatctctaataaagttgttaacgattgaagcctcttacacccccaaacaaaacaacaacaaaaaaaaagaaccctacaactgttgccgaagcctagatatcaaccctaaaccacgaagccagacattttacacccctttccataaaaagaactggttaaaccgttaaaggacccgtaaatgtctggattcacagctgaagagggacaaaacagacattactgttaacatattgtcagttcaaggcgtaaaataccacaagttaaagataactcgaattccctgtttattctcccttttcattagttacaatcattaccatattgctcaacatatatgaaccattattttatttacaccaatgaactaaccgtagatcaaaaggcatagccaaaaatcagactggtatggcagtacctgcctcaaaacaaaagtatcattcagcaaataatattaggacaaccacaattcttcaatcatccttttcaatcattgtaagcatgcctaaataacaatatctggaatggacattatggcaaactactatgtataagaatcagaccgcatcagactacattgtaaagtaatttgtgtcaagaaattcaacgaaaacaaaacaccacattcaattgttcttctatttcagttcgacgaaacaaagatggtcccccaaacccatagaatcacaggcgggagagcaattacccattttttatgattaactaagaaagaaataccagcttatcaagtattcgagtgcaattgtttaactattctatcagagatgcaactcttaaatcacacttctgaattattttaagcatgcccaaatgccagtagctgcaatggagattacagaatactactatgtacaagaattcagactgcatcagccatcaggctacatcctaaagtaatttgcattaagcaagcaatcttgagtccaacaaacgaagataaaaggtcatgttcaattgttcttcagtttcaattcgacgaatttgtggctgttccacgattcgccagaagcgagtaccacggaacagagatcccaatccccccaacctatagaatcacaggcaggtacatatatacagaagcggcagcggatttcagacaagagtgacgaatccgccgacaccagagacgggatcaaggcaggaggagaccgaccgttgcgaaccccaccccccttcaccagacggtggggacgaagcgcagcgccgccacgcgcgcggcgaggaggcccgcgagcctccgcacggcgaactgggtgcagttggagagcgcgatgaggcacatgagctcgtacaccaccccgagcgccgcctccgccgcggacctccgcggcgcgggcacgtngggctngnnggcngagtcctcgcatgcagcccgccaccccgaccgccgcccccgccaccacccccctcctcctcctccacccccgccaccgcccgggccgaagaagccgtcgccgtcgtccccggagaagggcccgcccgcgtcggagggaggcttggatcggcgggtgcgggggcgggtgcgcgcgcggcggcggacggtggcggtggccgaggcggaagggcggcggcggatgatggtggtggaggaggaggtggcggtggcgggggggacgggcgaggaggaggcgagcgggcggaggaggaggagcgacagcggcggcggcggcggcctggaggagggcgcggcggcggagatctccatggttggtggggatggccgcgcgatcggagaaggggaaaaggaaaggaagagacgaagagtaggcaagtgggggaaaagttacgtgtggcgggtggtgagtgacggtgaggagaggagaggaggacgggacgggcacgcggcggcggagagggggatctgcgtgggccgtgcccgtggtgggattccgtcctcaggattcagacgctgctgggatctttctccgtctcgtgtctggttgctacaccataagtttgattttgtggttgtggcaaaccgggaacgactaggatttattatacggacaggtttatagtggagatttgggtttgagcaatcggaagcaatccaatcgaggcagattgaaggcgggataaagcttgagacctcgtctttccacttatgtttacatttatattatctaaaatttaaatttttaatcttaaatttagtgattttaagattttttttatcgaagttttttcagtttttatttttaaatcgctgaaaacacgtatataaaaattttattcacaaattacttttcgtttgtaaatatgccatttccgatggctccgtaaccctcgactggtttttccgacaagttttggtgaatattttgcccctaaaactgaacagcacattttcattacttagacatacatgaaattacattcatatagttcaagaactatagaagaaacggttagggactatggattatacattaaaaacacacctaccgtctcttcacatatttacattatcccttaaaaatatatacaactagaattgatgtcaaatatatatgagttctattttattatagccaggcttggagtaataatttaaataaatgttggtgtcgaacagtatacaatagaatgtagatgcgtgatcaactattgcatcacattgaaaattttgatagtacattttcttaatgataatagaagttactccctcctagaaaagaaacctcgtactggatgaatgtgacatatcctattttatatttatagtactagaatgtgtcatatccatggaggaagtaccttttagtcatatcacg

SEQ ID NO: 32230 - DNA, 5811 bp, Oryza sativa
  unsure (1)..(5811): unsure at all n locations
aggactactgcatatttcagtcatgttagcatgggtcgttacgttgtcctttgttctgtttgaaatatccaatattattccatataggctcaaaacattattcgtatcgttcatcatatatatgttaatacatgattacaaaattatggaaatatgataatcctaaacatgcattgagtcaaatgaaaaaaaaaaacaaagccattggataactcctgtacttatcacaaccatcaatgtattagggcatcctcaatgtggtatgaaaatagtccacaggcaatataatattttattcagccagctagcaatatcatgtaatagtccatagtagaaagaaaatagcaaaaactacccattgcactatgggtaggcaagagcacaaaaaaaaaccatagttgggcagtgtcactattcataaataataaacaaaagtttcagtaacagttgcacaggtagccactggctttctggccatttcgcctaaaaaaactttcgcctacaaaaactgcaccaaaatacaccagctccattcatcaaatttgctagaacacaattagttccaatgaatccctcccacagaaacatctcaagtttcacaaattaagactccccaaaccaatactctaagagtagtgaccatatctcacctcatacaccacaatctcagtttatctttacatcaccaaattatccacaaaactttaacccttttggttctccaataaaccagccacctttggccactctcctccaggattttttttgaagagaacacagcaggggaggcccctgctgtttgaataattttattaaagaaaacaagaacaaaattacaacagattaatccaacttatgattacatcgtgatatctcgcagtaattctaaacaacaaaaggaagaggtcaccctttaagagttgcctccaagtgatgaaagaggggatcttttgctcgaagatgaacccattcctttgtttccatatatgccaagcagcataaaggaatttctccttgaacagctcccctgataatccaatttggcccttataaacattgcttccaaagggagagtagtatcccatgtaatgcctaaaagactccaacaattttgggcaaatgggcataaaaagaacagatgcattaggtcttcaacagccgccgattgacaaagaacacaagaaagatcacaatccggaggagcacaattcttataatttagcatgaacttggtgttcaatctattcatcatgagtngnncctgatgaacatttacttttgaaaccgctttgcacttccataaccatagaaagtggactggttcctccaggatttcaaggcgttcaataccaagggagctggttgtaacatactccatcaagctttcaaggttttcacctacaagagagttttggtcccttaccaacgatgcaatttggagatattgccaacaggccaccatctttgctgcaatttagctattcgtctggtgcttggtgctgcagccaacacctcttcccatggatctgagtctacttctccatgccttgcaagagaaaacgagaaacaacatgtaaccattgatgagtcaagcagtagcaatgacgaagaaccaaggcggcatacacacataaattggattgaagaagagaacatacgacttcttagctgttggttacaccgctcaactgatcctgtaaaaggcatcgacatgaaatcagaatattactaaaaagctgtggctgatgagttcaacaccaatgcgccaacaaatggacaaagaggtctgtcaagcaacaaaagacgcattggggtgatgtgaagagaaagatcacaaagttctatggagtacatggtagagttaaagctacctggagcagtgacatagccgtgaactcagcccatgtgatattcgaaaaagaaaacaaggacaaacctttcacattggagtatatgtggagggaggtcaaggaactgcctaaatggtgtagaatagtccaagagaagagtggaaataagaggagttgggggcgacagagagggctggtgcaatggcagcgtggggagggacgagaattgggcccaaaggaaatgagaattggggagaattgaggggctgctgatttttttaccactgtgggaccctccttaattactaacaatgtggtggtttcaacttctatagactagtatgccaaatacattgacgatgcccttatgtgtagttatcattctttatgaattacaacaaaagcacaaaatattatgtgcacttatcgttctctttgtccagataatatcatataaaaccattatctttttaatccagatttgtaaggtagaatcggagcaacagggacatgtttattgacttatagatattagtatagatattagctttttaatctctgaggtctccatttttactgactcgttttaataaaaaatgatgctccagtgctttctactggtaatataatagtactagtagaaatgttctaaatcgttcgttatatattaaaggtaaattagtaatttaattactaatgcagtgattaagggcaactttgtcatttatgttttttcttgggctagatcgatacatggttatccattgtactagcatcgctcatattccattagaaaagtcaaaaagtaggaaaaaaatgtgtagtcagtgctaaacgatgattatacctcttcgcacctttttttttcagagaataagctcctccacgtttctactataccgctaactagaataatactataaatatattttaacccttcgatcaaatgagatcaaatgttcaaattgctttctactaccagcaagagagtaccgtagtcgggctcttaattatattactcatgtatgctctaatctaatgtttctagcaacaggccggcactaacatcattcgattgatttcttttttgttttgaggttgctacgtgcgcatatgcccccgcacactcactgtgttgccaaccagcacgcgagctagcttactcgtgctcggcgtgtgcctccactttgatcagcaccatttgattgatttctctcattttctaataatttttaccaacctcatacgtttaaattttattccgaaatagtaatatttttattactctctcattgctttcggccttttaattgaaccagatcgttacttgagagcaaatgttccaatttattatggccggacagccggttcggtccgaccagttccgaataactgtgctatataagttggtgattattgccaaccgccttaattaaacttcatcttgcactcggctgattcctgtcagtctgtacaaaatggttactctcatccaaattcatcgatccacgcatactcataccggcagcgatcaatcatataacacagcaattgtataaatcaaaatgccttgcacttttgggagataattttcattgtaggccaccgagtgagctcatgcagtgctggctacgctcatctgaatgaggaagtaagtctatatttactcaaccatgagtctaattttcctcaaccgtaaaaccagatataacatacccttaaatattaaaaccagattaatttactgatccctaagcggttttgacggtagttttatctctcttctaggttgcccaaggaggaggaaggaggtcagcaggggtaagcagggagctcctatcgagcttgagcttgcagcggtagtggtagtctgtgaggccgttaagcttaagttcacgcgacgatgactgtagaaaagcttgagctcatttgacggagaaggagctcaacctatagaatccatgtgtcgtcgtggtgccacatatatagcaaagagtggagagagtattgacacgatagtagaaggcgaggaagccatcgatggccaagattgtcacctgaccgacaagggtaggttaatctagcagattgagatggcagcgacggcctccgagggctccgggaaaactaggacaatgaacatggtggcttcaattgctccgggaaggctaggatggtggaggtggaggtgaactatgatgatggcagctatgcaacatgcggcagaggtcaaccccgcggccagatccgaccaaaccccaccccgatcaaaaccagcaccggcaagaaggatctcaagctctgtggcagtctcaacgagctcaatccctacacgtccagctagcatgcccagcttgtcagtgttcaccacactagggaggaactcggcggccgtcatgccggagtgctagagctcaatagagttgttcccaataactccttcgttcctagtccaatttgatggatcgccgcctatgccaattgcgggtttgatcatcggcctctagcaacttcatggttgtcactctcctccagctcaagctctccacctccatctcaaagtggttgtgctgagtagctcgagagaagagatggagaaagagagagcgtggaggggtcgacgaggtatagtcaatgacatatgagtaccaccatttttaaaagttctgccctaacaaatttctagccacaaatatttatctcttattggcaccaatctaaaacaacgtatcagctgtaccttactaaaatttatgtttgtcattaccaatattaggttagcataagattaaaaccctactctactaatatgacagctagaacaatacttgttgggatcacctgggagtcactggctcactgctaaccacgtacaatctattgcattgtaaagaacaatcaaataatcaactacatatgttaggactatcttatatctttagctctattgggcttgttaggttactttgtcccatgcatgttatacttacaagatcccccacggatccaaacatagacccatccctggccgatatgattttaggtccccgcccaagtgcacatatatgcccccctccccccaggggcatatcctcatcccatatgggaaaatttccatctgtagcaaccacataaatattgaggggactatatatgaaaccaacaaataaatttataggagttaaaatgatcatgcattgacacttcacttccttaaaaacttagggatggatgattggtgagataggtgttccttataattataggggagaggctatgtgatatatgtgggaaaaggaaaaaatagtaaataaattcatgggcatggttttattcgcaaacgattgaaatactatatgctttagaaaaagagacgggtggagcgcgtgaaaacaaacatatcatgccaaagcgaaccctctggaaggacaagatcacaacgcatagaagagaaaatactatatgctttagaaaaagagacgggtggagcgcgtgaaaacaaacatatcatgccaaagcgaaccctctggaaggacaagatcacaacgcatagaagagctataaaagatgaccccacaattagcactaggagcatcgatgaattgagaaacttctctagctttgtcacccaagcgctcaatttttttacttacccctcatctcttttgtttatacttagctttctgtgtttcccatggatctccttcttcgttgatggatatactattgtggttgatactagtgttattattgcttatagatacaattgattaatgccatacataaaaaagacaaggtaattctattttctccttatcagtttttcaactcaaattcttgtttattgcaaccaaaagttattatgtattagtttactaaatcaaatgttttctcttttgataagatgcgggtgaagatcaggtcgaagacgcaggaattttacaggaatttcaaatgcgac

SEQ ID NO: 32231 - DNA, 479 bp, Oryza sativa
gtttgagaagcatatcagcgtcaactcggcgcaggctatgagaacgcgtgcatcgcgattgttctcggcaagctccttggcaagttgagggccctaccacctccagagcaaccgtggaggctaaggatggtgcgagagacagaagggttgaggccaagtagtgatgctagcttgaggtcagcactaggagcactccacataaaatcactagaacgggatcggctatctctaacgggcttaaatcatcatctctttcgggcagggccctcgtcactaagcaaaggtccgtgatgtgagaaaatatctcaatcaggcatccggccatcacggatgacgcatctcaattgggccaacacaaaagcccgtcacggatgactctcatctctaacgggcctaaactatagcccgtcacatggccactgtgttcaaggagggccacattgagaagccgtagacaaatccacattgagaaacaatct

SEQ ID NO: 32232 - DNA, 78553 bp, Oryza sativa
tggaacctgctatgcgttggacatatatcaaagtattgctgctgtatcagctttttttcttgctcagagagcgttaagggggtgtttgggaaatagggactaaatttagtccctctcacaaaagtataagtccctatggtagggacttatgtttttgtgagagggactaaagtttagccccactttagtccctccaaccaaacaccacctaagtcacccatggtctcatggacctctacacgtcaacaatatcgtcggcacgcagcaggacaaataagctgatttctattggtagctttacatcggactcacttttttgttatagggatttaatcttacctaatctcttggaggaataaaaaattttacacattaaatttcatttagaattcccaagatcagttttttttggatggaatttagcaaaacttttggtgatgcatcgaaccaacttttaccttgccatgatggatggacgattgagtagaggcaaaatggatagagctttggcacgaaataaacgaagaacagaaaatgtgaagaaaccgacgagactggaaaagcgaaagggaaggaaaaaatgaaaagaaagcaacaattttctagagtgccgtggagcaagggaaaaaaattaattcagaccctacaaatttacacccaccaataagcaacaagcacctaagcgtccaatggcagaccggcccaccaatcagccaaacagctgtgtctactcaactgtagcaccgaataaaatcgataacgtaaactgtagcatatatcatccctagaccaacactaatggactagaacaaagttcgggcccacaatacacagacgaaggatgtataggcaatgtccaccgtataggaacgatatgaccgaatagaccaggagtaatctagccaatagcatcttgcatactcttgcagtagtggagtgggtgcacagtgctcccactacagacgtggtcttcaaagcacccattaaaatccacccataaacaaaaaaaaatgttgtcacacaaggacaagggaacgacatggacatattctcactatgtgcatcaaacactggctggctgtacacagcaacagcgagagcgagccatacaccacgcccacccaaaaacaaagcaacaacttattagctgcttgtgtttttggtcacctgcttgcgtgctctttcgtcaaccattcgcttgccatggtgggccttgttgagtatgtctgccattggtccattgcactgcccgtatcgatgattgccagagccacacgatgatgatcgaacggcgtatgaaccaagcaaccacatgactcgaaacccagccaaaatccagtgccggatgacgtgtcggcacccagcgagggccacgccagggcaaaagccatttcgagccgcaaatcccagctggtttgaagtatttaaatactcctattcatcaatattgtattaacattattaaaatttcataatttttaacaaatttttgttgtttaccacgatgcaaggtaaaactgaaaatttttgttcagcatttcttgcgatattccatcttcttgttatacagttcttctttcactactagagaaaccatctttcgtgagttgggcaaaaaccacaatagtctcggatgaacaaaaaccgggactaaaagccatttttagtcccgggttataagttcaaaggtatttttaatcttcatctttagtcccggttcattcattgtcaggacgtgtcaggcccccccccaatatctttagtcctggttggtgtcaacaaccgggactaaagattaaaaaaatcgtgtgcgggctagagaaaacaaaaggcgcgcatgagagggggagagagaaaaatttcagagattccctcctcctctcatccttatcttcttctatctctttctctccctcacatcctctatcttttcctcccctcctccccttcccggcttcccctttccctctaccctaacatcggcagcgggcgggcagccggtggcggtggcggtgcgcggcgcccggcaccggagccgggggtggcggcgggcgtggcggcgtggccgcgcgggggccctgccattgcggagggcggccagcggcagcgtagcctgcgccatgcatgcggcggtcgaggcagaggcggacgtggaacactcccgcgtcgtcggagttctggatgagctcccgcagcacggtggtgccctctgggtagttggcaagcgcggccgtcgtggagtagaaaaagtagaagaacagtggatgatttttagatgttttttttgaatgattttgtgatgtaaatttgtggatgattttgtgatgtttttgtaaatgtggatgattttgttattgaatttgtggatgattttatgaatgaggacggtttgaaatcaatattaaagtagaaaaaaaaaacctttagtcccaggtatttgaaccgggactaaagacagcgatctttagtcccggattcgtagccccggtttgctacccaggactaaaggggttacaaaccggggttacaaatgctttctctggcggtgtttattttcgataatgatattgctattttgtggtcactaaacttggtagctgaacactatcagccagttcgtttgtgcacgttctgtgatatatattatttataaattttgcattatttgctagtaattatcatgacatattaataatattgtatgtatctaatatgcttaactagtttttaagaatcttaactaatcatttgttgtttccagggttggcttcttaggaattagagtgacgaatcctatatacttatatagttcttccacactaagtatagttaatgctatttctctcttctcccattaagtcatatcaccccaattatttctagcatttggatgatagatctatgatctaaattgtctcgtctttcatctctcataaaaacatgcaatctcaattatttttaggctcaaaattgtatcaaattgttttagttttgataataaaaatatattttatttgtacatattatgtaacttaattttccgcagcaacgcggcgtggtattcatctagtgaactattaagactgcccacagatataatgccaaaacaaaactgaatctgcaaggaatagatatcatcagagataatttgccagcatttttcgaggaacatcccattgaaaccatcaggcccatgatctctatctcaaggcattgaattgatgatttcgagcatttcatcatagaagccaggtagagagtccctcctaaggtgtaaataactcctgcaaattgataatgatttgattttgcttaatcatttgattttgctttgaggtgcccattttatttttaaaagtgctaagaaagcaagtgctttgtctgcatgtgaggaaatcacaatcccatcatggagatgaaggtgagaaatcttgttacttctatatctttttgtggtagcagcatgaattttttttattatcgtctccaaatttcacccatatgatactacaccttttttttttccaaaatgtacttctatagtgtagtagctttaggatgtgttctctcaggattagccagaagttccattttgaatggaaagtggtttttgttcttttagattgtccaacattacaatggaattgtttgaatttgagattagaacattgagatgtgaaagtcttttgctccaaatttccaagcgagtacataggttcaagacgcacgggtgcataataccttacttctgtgtgtggactatggatgttgaagggaatcacaaagtgatgcgggaaaagaagaagtgtgaggagaagttacttgatcactggatgtttggctaatctaatttagatgagagtgtgaacccttttctctatggcacggatcctcattttacacatgaaggggagtccacaatgccattgcatgcatgtacgagtggggcctactcctctaaacttaatatgcttagtcttgtagtagtccctccaagccagctgaccagatgtgaaagccatgcctaccaactaacaagtggagagatgaatcaaaagtcttcgttccaattgtccacgggctacccataagcgaccgtagccaacaggggtggaacttggggatggttgctgtggacgcgccatgtcgcacgccttgtgttctccggggtaacgtgggcatgcaaggggttgcatgtgctaccacgtctcccaagttgtgtatgagttcacctcacaattaatgtaaagtggtggtttaaatgtgagcatcagacccgagcagctgtccttaatggggtgaacctcttcattgattgaacggagcgtcctcgggccctgagggattaaaagcttgtaaccggttggctgccgtgtgtcgggtcaccccgtgtccatagggtgggcaagtccttggggcacccctacacactcaggcacggtgccattgccgaaagtagatttcgttggtatattggacgagcttcttgaagatatcgataaagaaggagttcatgataggcatgactttagacgagacactggtacacaccaatgcccgcttatatactttgaagtctccatattcttcttgaaaccttgaaggtgtagatcttgtagtgcttggtggggcccacagcgccatgagcacctagggggaaagggaacccttgtttccacttctccgacaggtggagctgggccaacaatttggtaaaaagtggctatagggaaatgtataaataatctgatcattcttggtgcatggactatatggaagcattgaaacgattgcgttcaacgaggctgccccaagcaatttggcttgactagttcttgtgagtgagaaggccctcctatagagtttaggcgaggccaaggggactttcattgataatcgatcccaattaagaaggctcatgattcaggttgttgggagaaccttggtgaggcactttgttcttcttttgctcgtgttttgttttttctccttttgtgttttcggattctttgtatttgcatcttacgcctccggtcttccattaatacaatgatacacaactctcatgcatattctagaagaaaaataatcttaattaggaaatattaagttgatattgattgcctctttttatcttatttttcaacagtttttcacatgcaaaataccattttcttaccgtgcggacttcatcttattcaagtattttctttaaaaatgcatctcaattgatcaaacctcgggctgaagaaaaccgtataagcaatatggtgttttaattatacatagggtattacaaattttgttacaaatccaaaaaacttaacaatcagagggcatatgaaagcaataaagagtttacttacaacatgtactagagttgagtagttgacagctcaaatatcttcacaaacattagaaaggaactccacaacatcaatacatcaccgctaggacataatcccacttaagcatgaacaattgatttactgtcatgcattaattagttaccatacactgtaataaaataccggagaagcataagattgtggccattaattttcatcaagacttcatgagagtgggttacgcaacaccattgcctctattgtgatacctggtccaaaggctagcattactccccactcaggttgttgatgctcatctccttccttctcccgacgacaacgcaactcatcaagaacaaacgcgatcgtcgtgccactcatattcccgtactcgctaagcacatggcggcttgccgcaagctttgctggttgcagctgaagctcaccttctatgttgtcaaggattgcacggccaccagggtgcaccgcccagaagaggtcattccaattaggatccatgtttccaaccgatcggaatgtgttgagcaagcattgtcggatgttgtccttgattagcgtcggcacctggatagagaggtggaaatctatgccattgctggtggtctgcatgccaagtgcatgctcagtacctggtatcgttgtttgcgaggcaaggaccatctcaaacagcgggcgttctccatcgaccaatgggtcagcgccgacaatgattgctccggcaccatccccaaatagtccatggccgacgattttgctttcatctggtttgagaagcatatcagcgtcagctcggcgcaggctatgagaacgcgtgcatcgcggttgttctcggcaagctccttggcaagttggagggccctaccgcctccagagcaaccgtggaggctgaggatggtgcgagagacagaagggttgagcccgagtagtgatgccagcttgaggtcagcgctaggagcactgcacccggagtaggtgctgaagatgaggtgggtaatatcaatggcaggacggccccactcggcgatggccttccgtgcggcggactcagcgagctttgggatctcagtggtgacgatgtctacacgagtttcaagggagggcatgtgtttgtcgatgatctccgggtgctcacggatgagcttttcatcaaggtggatgtagcgtttctctattcctgacctgtgacctgaaatggaaaaggaagcacccacatctcttacaattagtacatagcactctgaggttataagaatgataggacatatttcaattaagttgccgaataaatacaaaaaaaatatgagattttgcaagcattttccataacaagacaaaaaattggtttatatatgtcctatatttaggaagatgaacatgtgtttaattttctgaaagattggattagcacatcatatgttttgttcaaacatgatcttatgattttctcgtaacgtggggacataactctatccactaagactcaattcctggtgccaacatatagacatgtgagtgctatttttctatacaaatttattaagatccatggatttgttactatgactactctgtagatctcttgtatttttgttaaaagcgtagactgttgaaatctatatgagtacagaggcatgggtgcgagatggtagtctgatgagcaggagagacagtatatgacacactatcatatttaacgaggtattagtggtggatccaggatttctgagatgggatgcaaaactttagtgttatgattgaagataacagataaagtgaaaaaaatatactagcaaaacagtacataaatagctagtacaaatacaatgacataaataacgtagaaattcaagtggagcagatcaatagtcatggatgaccttaagtgggcctcgtattgagcatactgcgtacatatgccaagtatatactgtgtgtatagtagatttttttccaaaattttgggatgcaacgtcaccccgtgcatccacattgcatcagacacacgaggtatataaaatttgactgaactccaacatcattatactcttctttctacatagtataaatatttgtatggtttataatgaactatggcaggagtgtcctgaaaatttaagcgcttgcataacttattctcatcagagtttatgaaaaaataactagtgaaaatgatgatcagtgcaacgatcaaagtggaaggatcgatctgcttacatattctcttcattttgtccttcagctcagtaagatgctcgctctcggttagaccgaagtagtagtcggtaaacccatcttgatagacgatatttgtggggtttgcagtgccgatggcgaggaccgcagcagggccttccgcgtgctgtgtgcacgggcggctgtcaacaacagcggcagtagctgttccaggcatggctgatggaactggaagaacgtgtgcttttgcaactagttgaaggagatggctgtatgatgtgtttatggatggatattctagcttctggctgtgtggctttatactagtttttcgacaacctggcgcaagctagcccccaactatgtttgcattagtaaatgacttaaaagaatatttaaaaaaaatcaaaacatgctccatataatatcatataacttacaagcagaatatcatgcttaaatctgaacaaaatcacatttgatcataaaattaaatttttgtatgacttgtccaaatcgtttttggagaaatatatattttagtgcaggtactaattttgtaattctgaactggcctcgacccatttctagtttgcgttgtagagtttacagaaaatgtgaagattgctaacatatatatctatcttacagtcaaaatgctcctggtattgttcctggtcatttgaattatagagtttacataaatgtgtaggaatgccaacatatctacccatcttatggtcaaaatgctgttggtattgttgttcctggtcctttgcttctggagcagacactcaaaagttcactgaaaataattcaatatatgcatttacattatatatgtgtatgcttaattgggtctaatattttattctcagtcttttttctcagaatctacttctgacattattttgttctgttctattgaattttatcagtatttgttgagtgaatatctagtcttgaagtcccgtgtctgttactggcgttgctttaccgaaacatattaatgtcttacttgaatattgatctttttagttttgataattctccaaagatttagataaatattaattgccttttcaaagtggcggtaaaaaaacaattgtatcagcaatgtactgtaagatggataacccaaaaagtgatactatgcctttaattttactaatactatcttgtttcgccggttctataataattttcaaagtttaaaattaatagttgtttaaaattaatactagttacttatgtgcgttccaaactactcactcactctgttttgaaatgttaatataatgctgttaatttttaatattatgcttgatcatttgtcttatgaaaagttttaatgtaaatatgaaaaatataagtaatataatggttaatgtactttcatgatactcgtatagatttatttaagaagacgattattgtctcgagatctgccatgcgatgcacacaaagaaagataacaaagcagctaatgtggtatctggacgacgaacttgttgtccacttcgtgtgattagctccaagatcgtgcaaagtaggcaataaacacttattatattagaagacgctgcaacgtggccgatattgccatatcatgatatttcaattgcacctgcagcgcatggcattggtatgtaattcgtactaattatttttctgtatttggattttacaagaaaatatcccagcctgctcaaaagtgtcccgatttgcacgatagtttttaaattagaatatgccattaaataatatctaattctagaatacatataccgaccccaatttctctggagattacatatcactatgtataacgcgagatcggtcgactgaatcatagagcatattttcatatttagtttttgatcgtgaagctattaatgtacttagtccaaaattaatgtaatttatacattcttaaaataattatctgctttgcacaatcaccccgcgtctcataatcgatcataagtgatcatgagaatcaatgacccaataaataaattaagtaacatggatcaaatcgcgcccgagatgtgttaagtctggtaacattgtggatcttgagtgattaaatgcagaataggaggacatagacacatataatcatcatgccatgacaattaaatgagctaaacatccctttcctaaggtggcctcatgcatctcaaaggaacggtgatcatggagagtggcaagttcggctggcacgaccttcaggggtgcctctagttttcctaattaattttttggaagtgtctaattcagatgccccaaaataagaagttctgtcacttttttttaccatttaggataggacgtgactagatagtgcactatagtgctttagttctaaccggagaccactctatcccatatataaatcctctttagcatatggtgtatgtcttttttaaccctttaatgacttatatattttaaattacatattatttttaatatttatttgcatcattgtactccacataaaatcactagaacgggatcggctatctctaacgggcttaaatcatcatctctttcgggcagggccctcgtcactaagcaaaggtccgtgatgtgagaaaatatctcaatcaggcatccggccatcacggatgacgcatctcaattgggccaacacaaaagcccgtcacggatgactctcatctctaacgggcctaaactatagcccgtcacatggccactgtgttcaaggagggccacattgagaagccgtagacaaatccacattgagaaacaatctggaggaagccagagccgaattcgtgatattcctgaagctcacagaaccaataatccgagttccatattgcccgatccactcccgatgagatcaatctcataagtcgcttgtggatgacagcactttagatcaataggaccatcataattaatgtaaagtggtggtttaaatgtgatttctggacccgagtagctttccttaatgtggtgaacctctccattgattgagcggggagtcctcgggttcttgagggattacaatcttgtcaccggttggccgccatgtttgggtcaccccttgtcctcaaggcaggccaagtcctcggggcaaccctacatattcgggcgcatttgcattgccgaaagtatatttcgttggtatattagatgagcttctcaaaaatattgataaataaggagttcatgatgggcatgactttcgacgagacactagtacacaccagtgcctgcttctgcaccttgaagatgtagatattgtaggtctccatactcttcttgaaaccttaaagatgtagatcttgtaaggcttggtggggcgcatagcgccccgagcaccttgggggaaagggaacccctgttcccacttctccgataggtggagcagggccaacaatttggtaaaaggggctataaggaagggtataaataatctgatcattcttggtgcatggactatttggaagcatcaaaacaattatgttttcaacgaggctgcctcaagcattttggcttgagtagttcttgcgagtgacgaggctcacctatggagtttaggcggggccatagggacttccgttgattatggatcccagttaagaaggcctgtgattcaggttggtaggagaaccttggtgaggcactttgttcttcttttgctcgtgttatgttttctctcttttcgtgttttctgaatctttgtatttgcatcgtattcctccgttcttccattaatgcaatgctacataactctcatgcatattcgagaagaaaaataatcttaattagtaaatattaagttgatattgattgcctctttttatcttgtttttgaacagtttttcacttgtaaaatatcattttcttacagtgttgacttcatcttattcaaatgttttctttaaaaatactctcaattgatcaaaatgattgaagcaaaccatataagcaatatggtgttttaattatacacaaggtattacaaattttattacaaaacaaaaaaaaaacttaacaatcagagggcatatgaaagaaataaagagtttaattacaacatgtactagagttgagcaattgacaactcaaatatcttcacaaacattatataggaactccacaacatcaatacatcaccaagtaggtcataatcccactgaagcatgaacaattgatttagtgtcatgcattaattaattaccatatactgtaataagatactggagaagtataagatagtgacaattaattctccttaagacttcatgagagtgggttacgtagcaccattgcctctattgtgattcccggtccaaaggctagcattactccccactcaggttgttgatgctcatctccttccttctcccgacggcgacgcaagtcatcaagaacgaacgctatcgtcgtgccactcatattcccatactcactcaacacatggcggcttgccgcaagctttgctggctgcagctgaagctcgccttctatgttgtcaaggatcgcacggccaccagggtgcactgcccagaagaggtcatttcaattaggatccacgtttccaaccgattggaatgtgtcaagcaagcactgtcggatgttgttcttgatcagtgttggcacctggatagagaggtggaaatctatgccgctaccggtggtctgcatgccaagtgcttgctcataacctggtatcgttgtttgcgaggcaacgatcatctcgaatagtggacgctctgcattgaccaatgggccagtgccgacaatgattgctccggcaccatccccaaacagtccatgaccgacgatttttctttcatctgggtttgagaagcatattagcgtcagctcggcgcaggctacaggaacgcgtgcctcacggttgttctcggcgagctccttggcaagttggagtgccctaccgcctccagagcaaccgtggaggctgaggatggtgcaagagactgaagggttgaggccgagtagtgatgccagcttgaggtcagcgcttggagcattgcacccggaataggtgctgaagatgaggtgggtaatgtcagtggctggacggccccacttggcgatggccttacgtgcggcggactcggcaagcttcgggatctcagtggtgacgatgtctacgcgagtttcaagggagggcatgtgtttgtcaatgatctccgggtgctcacagatgagcttttcatcaaggtggatgtagcgtttctctattccttatctgtgacctgaaatggaaaaggaagcacccacatctcttacatttagtacatagctctccgaggttataatggcaggacatatttcaatttgaccgaactccaacatcattacaatgaactatggcaggagtgtcctgaaaatttaagtgcatgcataatttattctcattagagtttatgaaaaataactagagataatgatgatcagtgcaacgatcaaagtggaaggattgatctgcttacatattctcttcattttatccttcagctcagtaagatactcgctcttggttagaccgaagtagtaatcggcaaacccatcttgatagacgatatttgcggggtttgcagtgccgatggcgaggaccgcagcagggccttctgcgtgctgtgtgcacaggcggctgtcaacaacagcggcagtagctgttccaggcatggctgatgaccggaagaacgtgtgcttttgcaactagttgagggaggtggcagtatgatgcgtttatggatggatattctagcttctggttgtgtggctttatactagtttttggacaacctagcccaaggaaacccccaactatgtttgcattagtaaatcacttaaaagaatatttaaaaaatcatcacatggtccatataacatcatataacttacaagcagattatcatgcttaaatctgaacaaaatctcattttaatgataaaattaaatttatggaagttttaatttgtccaattcatttttggagaaatatatatattaggtcagtttctaatttaataatttagaactgccgatttcttgtttgagttatagagtttacagggaggccaaaatgtgtacccatgctgttggtattgttcttcctggtttgcttgcttcaggggtggacacagggagattcgtgggtattcaagtgaatactcaaaagttgtccgaaaataattcaacacatgtaaactttttccaatcctaataaccccctatacttctgatggaattccgtctagcaccctgaactttaaaactggacgttcaaccccctaaactttagaataccgttgatgtaaccccctaagatggttttgcatagtggtttttttaatctaatttgtatataagttggatgagtttgatcacatgtcatatactttggacatatatacaaaaattttgacttaaatcattctttttgccttttatttgctctcactaacaaacaagcaccaatataataatatcatgatatcactatataatgataaattgatgatttataactgatgatacgtaaatatgttacattagttattcaaaattgtcatttatgttaggaaacgataggcaaataaacgataaagaacaatacagatcaatcacagaagacatgagatttaacgtggaaaaccctcccaaagcaggagagaaaaagccacgggcgctagccagtaaaatatcttcactatattgggtgaggttacaatgccgcacggcggcttacaagagatatatatatatatatatgaggtagaaccctaaaaggtattacgatccgtaccgtaaaaggtggaaccctaaaaggctctgaaccaagcctaccggcgacgggcctccgcttcactacggcagaatctagcctttattaagtgtaaataaatttggatcacaactcaacagtttaagcttctaaaatatgcaaaaccatcatccaaaaccaccttaacggtaatatggatggtatggcaaagttcagggggttggatgttcgattttaaagtgcaatgtgctagacagacttcaatataaagtttagggatgtatatatactttttcatattacatattacatacgtatatacttatttgggcctaatactttattctcggtcttcttttctcaacacatctactcctcccgacactattttgttttgttgtgatgaactttatcggcaataattattgagtgaatagctagccttaaaatcatgagttcattgttgctttgctttactgaaacaaaaaacacttatttgaaaatgaaaattgatatgtttttagtccgggtaactttctcgagactgggataagtattatttgccttttcaaagtggctgtccataaaaacgattgtatcagcaatgtactgtaaaatggataatcacgtcttaagttttgcaactactattttattgcaaggttcaataataactgccaacatttcaggtttaaatgaactgtaatttaaacgtgcgttccaaactactctctcggttttaaaatatttgatgatgttgatttttaaggtgatatttgatcatttatattattaaaaattttaatggaaatgtgcaaaagtatatcatggtccaaatacatttaattattaaaaaaatcacaaccaatataaatgttagttttatttaggaagacgaatgtaatgtggaaatgtcaacaggcttatgtatttaaaaacataggtagtataaattacgtacatagctctgtgaaatgtttcttgtaaatatttttggataattgtgagatcagtcattcgatgcacaaattaggacaaagacaacaaaaatgacatgacgaacttcacttcgtgtgattagctcacatcgtgcaaagtaggcaacgagattgccttattatattagaagaagcagcaacgtggcggatatatttttgatctgtaattcgtaattatttttgcattacaggaaaaatattccggccagctcaagagtatcccgatttgcacgatagtttgtatactagagtatgtaattaaataatatctaatactagattgcatatcctgattccaattttctctggagtttgcatatcataacgtataactcgaggtcgatcgatcaaatcatagagcatatttttcttatttcgttcttgatcgtcaagctattaatgtagacatgtagtccaaaattcagtcactcaaatattaatcttctctgcacaatccacacagcatctcatgaccgatcataacttcataagtggtcgaatcaagttcccaataaataatatttgatcaaatcgcgcccaagaagtggtaagtctgctaatataatgttctagacctttattgattaaatgcagaatactaagatattgacacataatcatgccctgacaattaaatgatataaacttcctcttcctaaggtagtgggcctcgtgcatctcgaaggaatggcgatcgtggagagtcatttaaaaaataacagttttcctaattgatttttgcctaaaagacagtcactttttaaacgcctagaattgtatcgacatttgtgtagagtatttctatctcaccctatctcttttgctcttcttgtccctatttcaagcacgcacacatgcaggatggattaccgctgatatacatcatcgccgccaccttcccgccgaacgtaccacccctggctcgccggatggccggaaggggtcaacggtgccagcgaggcccaccagacaagcctccttcccgttccccaatcccacgtccctccctctcttccttcttgattgaacagcagtggcgcactgccatagctttcaaaatcaccaccgccaatcgcctcctcctaactacacagcctccctcgcccctactaccaaccatgccgactgccagcctccatccctgtggctctagtagtgcccccacccagcccaaccctcaccccaaaacgtaaaccacaggtttttctatcagagtctccatgatgtcaccatcagtaactaatatatcattattttcttattttataaattttagttcttttctctttttttaaacaccaaaaaccatgagaacaaataatataaaattcaccatccataaaaaattcatcgtccatcatgtcacacattcatatgtaaatattcattgattcatatttatattgaacagcgactacatttattagccgttcacattcttccttactcctttattcctcatgtacgccttcggcgattcactaattgtttcttctacaagcttaatgtagtttccaaaatccatgaatagtgtcatgttctcgtattgattgtatgcctcaacatcttcaacatcaccaactcccaaaatcctttgttttccggaaataactatgtgtttcttcaactgagatggggttagtcacgtaaaaaacttgggtggctcgatcggcaagtaccaatgggttattcttgtggcttacgttgtcaaggtcagcaattgtccgtctaaatttgtccacaaacacgccagctgggtgtttcactcattgacaccgaaacggtggaatctgcatattgggttcgtagtcccgttcccaaatttcttctatgaattcatagtatgtgctcttttgacctgttgtgtcgatttcctatacttgaacgccattattttgagatgcactccttttgtctcttgctttggtataaaatgtgtacccattcagatatacgctcaccatgaggtgtacactcttgaatgcccgtcagccaaacttttcatagttttttccttcgtgctatcaccatatggtcggccgaggtcctttaaccattcggtaaagtcagatttgtgccatttcatgatccatgcttcagagcgcctgacatttcttgcttgtaattcctttaggtgctgctctatgtacagctccactatcacaagctgttacaggacaatgaaatgagcatctttcactgctttgtagtcattgtcgaggattcttttttcctttttgtccctcttccagataacctacctttatgtcgaggtactagtaaaccaattgctttcccatcttgcaagtaaccaatgcaacactcaatgactttcttggtagtgtatccctctatcatcgaaccctctgggtgggcacggttccgtacatagcctttttagattggacatatactgttcgaatgtccacatctgatgaaggtacaagggcccaagcacaagtatctgaggcacgatatgaaccatgaggtgttgcatcatattgaaaaatgacagagggaaacacatctcaagcttgcacaaggtctctatagcgaaaacacggagatgacctaactcttcaaggtcaattactttatgtgagattgcattgaagaaataacacagttttgtgacaaccatctttacgtgtactagtttgattactttgattgcaatagcaatgaatattatgagcattacatgacagtcatgagaaatgtagcccaaaagctataaatccttcatcgacactagccgctttatgtttgaggagaaaccggtagggactctcacctcgtgtagggatttgtacaatgccattttctcataatttgtcaaggtgtaataagtcagcgaaaggtgcactcttgtgacatcctggcctagggcttaataggattaatagaatactcataccatcaggttgcaacttattttccttaaccgatctccaaataactcagaggttaagcgtgcttggcgtagagcaattttgggatgggtgaccgaccggaaaattcttcccgggtgcacacgagtgaggacaaagtatgcagaaaagacttgtgttggtctgtgagggtagtctatgtccaagataagctaccagatgtaagtaggcctggcctaggagaggcgggatgttacaactcttccattaccttcatccgcaggtgaagctcttctgttatctgcgtattcacaaggtccttacatgtgacaacctggcccaattaagatatggcctatgtggtactccctccttccaaaaatatgagacctatttctttttgcatcaataccaagaagcaattaactcactcaccatatggcaaaaccaatgagcatgcaaccaataattattagaatgacttattggtttctgatcaacaattcaatttagtacatagtgactacaaataggacttagattttgagaaaaaccaaagaatgaaataggtctcagatttttggaaggagtacatgatagctgtgtgagcatgtttagtaccaccttgctagttttgcttgtcccttcaaccatatcactccctggttaaccctattacacgaagcaatgacgaaagtgtaagtggagtggtatctgtaagtgggaccgcccgttggacgagctgggctacacgattctggagggcgggccattacaaaatggtatcagttccgaccctcgcggttgcttgtatgggtcagtgtgcgggtatatggcacatgtgggctctatgtaaggcggactgcactaagcattaagagggggtgtgttcctagacatttacctatatgcctgtgtgtgactatatgggtaaattgggccaacggggatgtcgggtcctttgaggagggtgtgtgacatcctggtataattaggacatggcatgtgtggccaataagacctgtgtgcgtatatttagtaccatcttgctagtttagcaagagtgggcttgtccctccaaccatatcactccagggttaacacttttatacaaagcgaggataaacgtgtacgggagtggtatgtgtaagtgggcccgcccattggatggtctaggctacgcggttctggaggacgggctgttacattatgtgacttcagtccatcatttgtcttgcttggtatggctactaaagtcccaatggttctatagaacacatttttctctaggtgcatgacaccgataaaatgatgtatctatatatctattgaatagaacgcttggtccttccgcatttcgcttccgcttggtttccttcttttttgccttctcaaaaaaaaactttgagatttttcgtcatttggaacactctatcacccttgcatggtcctggtggatcatcaagctattcagtgttgtcgaaatatgctgctttggaacggtatttgtgattccttcttaagaacctgtatacggtaccattcacacagataacacagcctatcttccccttgatcaatcatattcgcttccgaacatcaacttgtgtaggaacaactttcatttgaacctgccatatgcaaaaactaatcttgccatcaaacttctcaatgtcaaatttgatacatgacatgttggagaaacaattccagatcaaaaaatatatataatagattccaaaagaaaagaaattccctgatataaagtctttgtggacgtacaaaaatccaacaggaatttggaacttcacataaacacgaagcgagcagtatcttcaattgatttttcttcctcctccagagccgtgcagctatgcgctgctgctttttcggtggatgcgtggtagcaaaaaagaactccgcttcggattgctgcgccgaaaactcaatcacgtcgagccgattaactcgatgagacgacaggaggacgcacgcctgccgccaccaaccagattcatcaaagaactcgccgtgggatgaagcgcgtatgctgccgccgatcagatggatctatcgaagaacacaccggtgtcagaattgttctcgctgatcagatcgaacgacgagaagatgaacgcgccgccggttctgaaagcagatcgatctccctagctaagacacaagaatttggtaaaacgggctataaggaagggtataaataatatgatcattcttagggcatgttctatttggaagcatcgaaacgcctgtgttttcaacgaggctgctccaatcatcttctcgactagttctagcgagtgacgaggctcacctattgagcctaggggaatttcgttgattatagatcccggttaagaaggcccatgattcaggttgttgggagagcctcggttaggcactttgttcttcttttgctcgtgttttgttttctcactttttgtcttttctgattatttgtatttgcatcttacgcctccgttcttccattaatgcaatgatacacaacatctcatgtatatttgagaagaaaaacaatcttaattactaaagattaagttgaaattgattgcatctttttatcttgttttggaacattttttcacttgcaaaatactgacttgatcttattcaagtgttttcttgaaagatacatctcaattgatccaaactcggattgaagcaactcatataagcaatatgctttttcaattatacacagggtattacaaattttgttacaaatacagaaaaaacagcaataaacattagataggaactccacaacatcaatacatcaccggtaggtcataattccacttaagcatgcagaattgatttagtgtcatgcattgattaattaacatataccgtaataagataccagacaagcataagatagtggcaattaattttccttaagacttcatgagagtgggttacgcagcaccattgcctctattgtgatacctggtccaaaggctagcattactccccactcaagttgttgatgctgatctccttccttctcccgacggcgacgcaagtcatcaagaacaaacgcgatcgtcgtgccgctcatattcccatactcgttcaacacatggcggcttgccgcaagctttgctggttgcagctgaagctcgccttctatgttgtcaaggatcgcacggccaccagggtgcactgcccagaagaggtcattccaattaggatccatgtttccaaccgatcggaatgtgtcaagcaagcactgccggatgttgtccttgatcagtgttggcacctggatagagaggtggaaatctatgccactggcggtggtctgcatgccaagtgcatgctcagtacttggtatcgttgtttgcgaggcgaggaccatctcgaatagtgggcgctcttcatcgaccagtgggccagcgccgacaatgattgctccggcaccatccccaaacagtccatggccgacaattttgctttcatctgggtttgagaagcatattagcgtcagctcggcacaggctacgagaacgcgtgcatcacggttgttctcggtgagctccttggcaagttgaagtgccctaccgcctccagagcaaccgtggaggctaaggatggtgcgagaaacagaagggttgaggccgagtagtgatgccagcttgaggtcagcgctaggagcactgcacccggagtaggtgctgaagatgaggtgcgtaatgtcaatggccggacggccccactcggcgatggccttccgtgtggctgactcggcgagcttcgggacctcagtagagacgatgtctacacgagtttcaagggagggcatgtgtttgtcgatgatctccgggtgctcacagatgagcttgtcatcaaggtggatgtagcgtttctctattcccgatctgtgacctgaaatggaaaaggatgcacccacatctcttacaattagtacatagcactaagagattataagaataacatgagacatttcaattaagatgccgaatatttacaaaacaagaatatatgatattatgcaagcattttccgtaataaaacaaaaatggtttatatatgtcctatttttaggaagataatcatgagtttaatgttctgaaagattggattagcacatatgtttcgttcaaacatggtctaatgatgtacttgtgggtgcataactctatccactaagactcaattcccggtgccaacatatagacaagtaagtgctatttttcagtacaaatttattaagatccacggatttattgctatgactactctgtagatctcttgtatttttgttaaaagcgtagtctttaaatctatacgagtacagtggcatgggtgcgagatggtagcctgatgagcaggagggacattatatgacaaactatcatatttaacgaggtattagtggtggatccaggatttcagagatggagatgcaaaactttactgttatgattcaagataagagataaagtgaaaaaaatatactagcaaaacacttaaatatagcgagtacaaatacaatgacataaataatgtagaaattcaaatggagcatatagtcctggatgaccttaagtgggcctcgtattgagcatactgcgtatatgtaccaagtatatactgtatatagtagattttttttcaaaaattttgggatgcaaccacaccccatgcatccacattgcatcccacacgcgaaataaagaaaatttggctgaactccaacatcatttcactcttctttctacgtagtatagtataaatatttgtatggtttataatgaattatggcaggagtgtcctaaaaatttaagcgcttgcataatttattctcattagagtttatgaaaaacaactaacgataatgatgatcaatgcaacgatcgaaatgaaaggattgttctacttacatatcctcttcattttgtccttcagctcaataagatgctcgctcttggttagaccaaagtagtagtcggcaaacccatcttgatagacgatatttgccgggtttgcagtgccgatggcgaggaccgcagcagggccttccgcgtgctgtgtgcacaggcggctgtcaacaacagcggcagcagctgctccaggcatggctgatggaatattggaagaacgtgtgcttttgcaactagttgagggagatggcagtatgatgtgtttattgatggatattctagcttgtggctgtgtggctttatactagtttttcgacaacctggtccaagttaacccccaactatgtttgcattagtaaatgacttaaaagaatatttaaaaaaatcatcacatgctccatataatatcatataacttaccagcagaatatcatgcttaaatctgaacaaaatcttattttaatgagaaaactaaatttatggaagttctaatttgtccacttcgtttttcgagaaatatatattttagtccagttactaattaaataatttagagctgccgatttcaagtttgagttatagagtttacagggatgccaacatatctacccatgctgttgttattgttcttcctggtttgtttgcttcagggtgggacacagggaggctcttgggtattggagtgaatactcaaaagttgtccgaaaataattcaacacatgtaggtatattacgcattacatatgtatatacttaattgggccaaatacgttattctcggtcttttttttctcaacaaatctactcctcctgacactattttgttttgttgtgatgaattttatcggcaatatataattatagagtgaatagcaagccttaaaatcataagttcattattgctttgctttactgaaaaataagattacttatttgaaaatttatttatttggtcctggtaactttctggagactgagataagtattatttgctttttcgaagtggcggtccataaaaagatagtatcaacaatatattgtaaaatggataatacaaaatatgatatcacaccttaaattttggaactactatcttgttcctaggttcaataataatagccaatatttcaagtttaaatgactgtaacttaaacatgtgttccaaactactctctcggtttttaaatatttgatgctgttaatttttaacgtgatatttgatcatttatcttattaaaaactttaatggaaatgtgcaaaagtatataatggtccaagtacatttaattattaaaaaagttcaacaccaaatataaatgttagttttatttaggaagacaaatgtaatatcgaaatgttaacaggcttatgtatttattacataaaaacggaggtagtataaataacgtacgtacaaaagctcagtgaaatgctttttgtaaatttttttggataattgtgggatgccattcgatgcacaaagcacaaaggagaaagacaacaaatcacatgacgaacttgttgtccacttcgtgtgattagctcacatcgtgcaaagtaggcaacgagattgccttattatattagaagaagcagcaacgtggccgatatatatatccattgcatctgcacgggcgcacggcattgatctgtaattcgtaattatttttgcattccaggaaaaatattccggccagctcaagagtatcccgatttgcacgatagttttcatactagagtatgtaattaaataatatctagtactagattgcatatcccgatcccaattttctctggtgtttacatatcataacgtataattcgagatcgatcgatcaaatcatagagcatatttttcttatttcgttcttgatcgtcaagctattaatgtagacatgtagtccaaaattgactcactcaaatattaatcttccctgcacaatcatctcttgatcgatcataacttcgtaagtggtcgtgactcgtgagaatcaaggacctaataaataatattgatcaaatcgcgcccaagaaatcttaagtctggtaatataatgttttggatcttcagtgattaaatgcagaataggaagatatcaacacataatcatgccctgacaattaaatggcctaaacttcctcaacctacgatagtgggcctcgtgcatctcaaaggaatgtcgattgtggagagtcgtttaaaaagtaactgttttcctaattaactttttagattgtctaagttttgcctaaaagactgtcactttttaaacgcctagaattgcatcgaggttcgtgtagactatttctatctcgccctatctcttctacacttcttatccctgtttcaagcacgcacacatgcatgatgtatcacaaccgctgatatacatcaccaccgcctccttcccgccgaacaagtccaaaattaatataatctatacaatcccttaaaataattatttgtgctgcacaatcacccacgtctcatgatcgaccataagtgatcgtgataatcaaggacccaataaattaaggaatatggatcaaatcgcgcccgagatgtgttaagtctggcaacagtactctggatcttgagtggttaaatgcagaataggaggacatcgacacataatcatcatgctctgacaattaaatgacctaaacatccccttcctaaggtggccccatgcatctcaaaggaacggtgatcatggagagcggcaagtttggctgggtcgtcctacaggggtggctcagttttcctaattaatttttgggagtgtctaattctcagttgccccccccccccaaaaaaaaatcaattttttttgaccatttaggattgcaagaattgggtggactctttctctctccccttatcacttcttccctcctcaaccccgtttcacctatgcacacatgtatgatgggttgctgctgactcctccctgcacgacgatgctactcttggcttgtcggcttgccaaaaggagtcaacggcgcaggtgaggcccacaaaaccatataatcctcagccttttcctcatccctgccatcctccgtctctttctccataatccagcggtagtgtcattcccgtatgctgtcggaattgttgtcaccgaccgcacagttaccatatggcctccctcgctcaggttgctgccaaccctgcccattgtcggcctccatcctcacagctccggtggtgcccccactgccttgctacctgcccattgccgccgcacaccgccagtccaaccaatgtccaaaccaattgctctaaaagttttacagcatactaataagaagacatagtaataaagagttctacaacacatgaaacttcattactccaccagtaggtgataatcccacttcagagtgaacagttcatactgtgttattaatataaccctcacaaaaatacatgcagtaaaaatacttatacaaaaacgttggagatgaaagcggatatattttagttaggaaaaatttacgacagaacactccaaaaatgtgatatttgctgagggacatcgtaagaacgtgaatttgtccgagaatactcataaaacacggtaatttgctaaaggacacaataagcattaaaatataatatttacttatgtgaggagggagaaaccacgtaaattgtctattttaccctcgtatttcttcttcccaagtcggccgcccagaaggaggtgttgccgctagtcgtcaagccgtgctctccatcatctcttccctgttccttattcacctcatcatgtcgaatgttttaacttttgacctcaccctctgtcatgcagcggatcgacaagaaagccgtcatgccgacgtgactccggagcgagctctctgtgtcacagtcaagaccatctccacattctgggcaccatggcgcatggtcgggccatccatcgcgccatcgtcatcgccgagaccctaggagccctccgacccaagcaattgacatgagatgtcgtgaatcatgagatcgtcatcgtcttcccaaactctggccaaccgctgccatcttcgattccgtctctcaattcctcatgaatgtagcgtctctacgtctctacaaacatcttggtagcatcgaactataagctccttggctcgaccggactagcaccgtcgtcaattctggccacctccggctaaaagacgaccaccgtcgggttcgcaagaagcctgcacatctttctctatttggccgcatcgtccaaggagctgccattcactgtcagcgtcgccgtgaaggagtgccagccggcaaggctctgcctcagctactgctctctccctcctcgagacaatgacacacgggctccactccatcaaagcaccagggacttgatttgtaaagaaaacaaaactctttgtactaattggtcctaggggcaaatctcccatgttgtgaaaattctccctccaaaatagcaaaaagtcataaaataatgtgtatgttgtctaccaataaattaccacattttttgagtgtccctaagcaaattcatgttcttacgatatccctcagcaaaggccatggtttttcaatgtcctgtagcaaattttgtctttttgttatagatcagcatgcataagtttgatggatttgtaatacaacctataaaacgcatggagaaaaattaagttgatgggagatgatatgcgggtatacaagtcattcgcacttagtgtagttaatagcaactttctactttctcgtgcttccacgtcacctcattttatcctagccattggatctcaatcgggtgatcaaccatgcacaccacatcacatcgccctttgtactgcactgcatcgcaccctccacccacaccacgtccactccctctcccttttcttatcctcctatccttcttttagttcagccactttgtccaatttatcctcttgcatattagttgatttaccaagcaaatgaaaattggaattttactcttgttcgtggaattatgctcggtggattcaaaataattaaatattttccactcttacgagtggttatataggatttgccacttgaccaacatatcatagacacatgagatagatacatgagggcccacacatcatacacagcgagtggcaaatcattaattggcacatcttaaaagtggcaaataattaaatgtcctagttcgattcatatacatctccacaccattatcctctccaatcgctccaatgttattgatagggaaaatagatgcaaaagagatacataattttatgtgaaaacatccctctaatatagagagaaaataaccatagaagacaaaatcaactatgatggttcagggttacatgtagaagggtggcccatatatttagacacatattgaacaagaccctaggactaaatatatttgagtcattatccaacaacctttccttgactcaaaaaccctataaactagatgataccctgcgcgttgcagcagaactttctaaatgacaaaataatttctaggaatgtaacataagattgttaactaaaagaaagaagaaaggaagcaaaacacacatgtatacatcctggcatggttgattatgtaaaagcacctagctacaaaacaaaatggtgcaacaaagagggatggattcacaatgctcagcgaaagtaaatcgataactagaataaaaaattgttcgagttaccttcttttttggagagaatcccttatatgccactagaatttgaccagttcccttgtatgccactaaaaattggcttcccccttatataccactagttcaagtttttccaacattttatgccactcccaccactatagtgttagttgactgttagtcaaaggttagtttttttcgtaaatgaccaatatgccctctcaactaaaaaatgtgtaaacttcaaaaattcataactaatttattttaaatcctttttgagtgaagaaaattttgtcagaatcagtgaaaaatgctctttatattaaaaatattattggaaaactgcatgtttcatgcttacattgaaaatttatttgtgatggtaatggctaaaattgcatgtgatgcagaaaaaaatcaattttcatatgttgtatctagtagctatattagtactaaaatacctattattggttgtatactaattctaaagggcaaatgcgtctttttacaatgaagttaacggtcaactgacggtggactgacggcaatggcataaaagggaggagaaacttgaaccggtggcataaaagagagaagccaatttgaagtggcatataagggagctggttaatttagagtggcatataagggattctctctaccttcagagacaaccatgatgatctctttgaatgtacatttagctatcctattttagttgaataaaactaattaacttcacatagaaatatatgaatgctatatttatccaaaaaaagaaaacacacctatttaggcaacaaagtagttgtttgcacggtagtaacatgacctgaaagaaggagagcagcacatttcaggtgtcaatacagtagaaaatcaaatgacagaaacctacagcaaggcaaaatgccaagcgcatgtttaatgaaaacatagtttgattatctttacggtttgctatccctcagtagatcgatatgttgggttgcttaccttaccaatagtaaaatccaaacataatcgatgtggagaaggatgtgtgttgtacagtaggagtgtagggcaaaagagaatatatatattttacagcctgactgtctgatagtcataatttcgttgaaagcctgctaagtttgcctaagcttcaatagccgtaagagcgtagcaaagaaaacccgcttcatacctcgcactttgcttcgtctgtctcgcgcaagaagcccatcgaccatagcatgcatgcctcctccgctctccaccacctgctcgtctcttgcttcgttaattatgccgtccaatcgtcgatgctgtaacctactccaaagaggcgaggcaagagagaccagtagcccggaaccccctgcgttgcaggcaagcacaaattgaaattagcaaaatatgaaaatacagaaagaggatttcccgactgttgacgctgccttctgagctggaggggatggtgcttgaggttcatctaaacggaggatgaattgtagggagggaataaatggaattaagcccattattgatggtggtgacggttttttcctcgcagttcgtcttccaggtggcttttacggcggatgaaagaaaagaagcgacccaaatccctgagccgcgccgcgctaggccgaactcgagtcgccaccatggccccatcgatttgttgcaggggttaggagaagaagcgacacaatgacactgcatggtgtgccgtggggatgaaaagtgataaagacactgcatcgtagtggatcgatttggattccatggcagctgcgggagtccaagggaggcggggccgagccaaggagacagggaggagtgattgggcaaggaatcgctgggagggagatgcagtgggggcggcggagagagatgcgggagagggagccgatgtgggtgcgctcgcgtgagagagtagcaatgcggtggggccggcggagcgagacgcgggggaaggaagacgtacgcggatgcgggatgccgggatggggtgtggatcaattagattagatccaacggttaggaaaaaatgatgaggaaaaaatgatgacgtggaagcaccaggaagcagagaatttctagtggtggggatgatttgtataggtatataggatatgttgtagaagaaaatgtctccaaaaccctgaagggctgctaagtaccacaaatacctactaagtataggcaataattgaacttagttactgagagtaactttgtaagcatatctacgggattgtcatcagtatgtatcttcctcataaaaacttgcccttgagcaacaatatcacgaataaaatggtgcttaatatcaatgtgcttggtcttggcatgaaacatatgattcttggtcaaacaaatagcaccctgtctatcataataaacaatattaacatcctactgaataccaacttcaggaataagacctcacaaccaaatagcttcctagacaccttcagtagtagaaatatattctgcttctatggtggaaagagcagtaacagactgaattgaagctttccaacttacagcagaaccacacaaagagaatatccggaaatagaccttttattaagaacaaaccaaacaacatcatctatcttcaccttattcatatcaaacattaagccaaaattagaagtaccttttaaataacgaagaatccacttaacaacatttcaatgttctttgccaggattatgcatgaatgtgctaaccacactaacttcatgagctaaatctgcgcaaatggaaatcataccatgcataagattgccaacagcactggcatatggaacatgcgatttgtaatctttgtcatcttcattaatagaacactggcttgaagataatttataatgtgaaacaaaaggtgtagaaacaagcttgcaattacgcagattaaattagtcaactatcttatacctgtatcttttctgatatggaaataattaccagccttgcagtcatgctgaattttcgtgccaataattttctttgtgagaccaagatctttcatctccaattcatatctaaattgagccttacactgattaatcggtgacttctcataagaagcaatgagcatatcatcagcataaaacaacaaataaatgaaagatccatggggaaatttcattaagtaaacacaattatcataattgcttcatgaatattgttgtgcaatcataaaagaatccattattttataccactccctaggagcttgtttaagaccataaagagatttcttcaaatgacaaattaaatgtttttttcctagaatagcaaaaccttcaggttgtatcataaaaatcttctcttctaaatcaacatgtaagaaagttttaacaccaagttgctctaattccaagtcaaataaagcaacaaaagcaatcatcacccgaatggagaagtggcgtacaacagataaaaaaacttcattgaagttaataccttccctttggtcaaaacatcaatgaagttaatacctcattgaagtcttgcagatttaactctagaaatacaatccttcttatcaatccatttgcacttcgaagaatttggaaagcttttccaaatcccatgtatgatttttatgaagactctcaatttcttcacttatagcagtcaaccacttagaagaattttcacatgagatggctttagaattagaacatggttcaacagtatcattatcaacttgtgtagtaagaacaacataacaagccatatcattagagtcacgatatctagcacacaattgaatatatttttcttctatttctatctcaagcaatacaatgatcatgtagaaaactaaatttatggaagttcaaatataacttacaaacataatatcatgcttaaatataaaaaaaatcacattttaatgagaaaacaaaatttatggaagttctaatttgtccaattcatttttggagaaatatttattttagttccgtcgctagtttaataatgagtaaattgcatcagcggtacacgaattgttaggtgggtgcaatcttgtacaagaacttgtagaacactcgtttgggtgcacaaacttgtttggtgcatgcgaacaaggtcaaaatcgcatggcaaggttaatcttgttgattttgttgttgatttaaactctatgtaaatatgtatcgaagaaggataaacacataataaggcataatgattgcataaaaaaataaaaaactgagtaatgatgtaaaggatagaaacaaagaaagataaagtggaaactaagtttataaatataacctttctactatgtgcatgcacgtcatctactaatttataatttataatgttcaacatagaaaaatcggtcttgtcatgccattttagccttagtttgcatgtatcagacaagtttatgcaccaaaacgagcattttacaagttcatatactaaattgcacctacctgtcaagttcatgtacagctaatgcaatttactctttaataatttagaactgtaattattaaccaccaaaataattaaggcctggatgcactttcgaagtgttctctttaaaaatacatctcaattgatcaaaactcggattgaagcaaaccatataaacaatatggtgttttaaatatacacatggtattacatttttttacaaatccagaaaacttaacaatcaaagagcatattaaagcaataaagagtttaattacaacatatactagagttgagtagttgacaactcaaatatcttcacaaacattcggtaggaattccacaacatcaatacatcactggtaggtcataatcccacttaagcatggacaattgatatagtgtcatgcattaatttattgccatataccgtaataagataccagagaagcataagatagtggcaattaattttccacaagacttcaagagagcgggttacgcagcaccattgcctctattgtgatacccggtccaaaggctagcattactccccactcaggttgttcatgctcatctccctccttctcctgacggcgacgcaagtcatccagaacgaacgcaatcgtcgtgccactcatattcccgtactcgctcagcacatggcggcttgctgcaagctttgttggctgcagctgaagctcgccttctatgttgtcaaggatcgcacggccaccagggtgcaccgcccaaaagaggtcattccaattaggattcatgtttccaaccgatcggaatgtgtcgagcaagcactgccggatgttgtccttgatcagcattggcacctggatagagaggtggaaatctatgccgctgcaggtggtctgcatgccaagtgcatgctcagtacctggtatcgttgtttgcgaggcaaggaccatctcaaacagcgggcgctctccatcgaccaatgggtcagcgccgacaatgattgctccggcaccatccccaaatagtccatggccgacgattttgctttcatctgggtttgagaagcatatcagcgtcaactcggcgcaggctatgagaacgcgtgcatcgcgattgttctcggcaagctccttggcaagttggagggccctaccacctccagagcaaccgtggaggctaaggatggtgcgagagacagaagggttgaggccaagtagtgatgctagcttgaggtcagcactaggagcactgcacccagagtaggtgctgaaaatgaggtgggtaatgtcagtggccggacggccccactcggcgatggcctttcgtgcagcagactccgcgagcttcgggatctcagtggtaacgatgtctacgcgattttcaagggaaggcatgtgtttgtcgatgatctccgggtgctcacggatgagcttttcatcaaggtggatgtagcgtttctctattcctgatctatgacctgaaaaggaaataccaacatcttttacaattagttcatagcactatgaggttataagaataacaggagacacttcaattaagttgccgaatatttacaaaacaaaaatataggatattatgcaagcattttccataacaagacagaaaataactgatgataatgatgaacagtgcaacgattgaagtggaaggatcgatgtgcttacatattctcttcattttgtccttcagctcggtaagatgctcgctcttggttagaccgaagtagtagtcggcaaacccatcttgatagacgatatttgtggggtttgcagtgccgatggcgaggaccgcagcagggccttccgcgtgctgtttgcactggcggctgtcaacaactgcggcagtagctgctccaggcatggctgatggaagtagaagacgtgtgattttgcaactagttgagggagatggcagtctgatgtgtttatggatggaaattttagcttctggctgtgtggctttatactagttttttgacaacctggcccaagctagaccccaactatgtttgcattagtaaatgacttaaaagaaaacctaaaaaatcatcacatgctccatataatatcatataacttacaagcacaatgtcatgcttaaatctgaacaaatcacaatttatcataattaaatttatgtatgatttttccaaatcgtttttggagaaatatatattttagttattttagtttttgtactaattttataattcagaactggcctcgacccatttctagtttgagttatagaaaatgggtagtgtaagaatgccaacatatctgtccatcttacagtcaaaatgctcttggtcttcctggccatttgaattatagagtttacagaaatgtttaggaatgctaacatatctacccattttacatgcaaaatgctgttggtattgttcttccttgtttgcttgcttccggggtgggcacagggaggctcctgggtattgaagtacatactcaaaagttgtctgaattcaatacatgtaggtatattacatgttgcatatgtatatacttaattaggtctaatactttattcacggtccttttttctcaacaaatctatacctccagactctaatttgttttgttgtgatgaattttatcggcaagaatcattgagtgaatagctagccttaaaaccatgggtccagtatttgctttgctttaccgaaacaaaaaaaaaacattacttatttgaaaattgatttttttagtcctgataagtttctagagattgagataagtattactccctccgtcccaaactatgagcttttggactccgacaaagtcttcgagatgctactttgaccaacaatatctataaatataaaatgttttaaataaaaagagttgcatattgtaatactttgattaatgataaatctagtaacatcaattttacatgattaatctttttttttatttttttgctattaatagtcaaatttgaaaataattgacttggcactgtgctaaaaatacttatattttgggacggatggagtatttgctttttcgaagtggcggtccataaaaacggttgtatcagcaatgtactgtaaattggataatctaaaatgtggcatcacgcctttgatttttgatgcgggatcaataataatagccaacatttcaagtttaaatgaactgtaacttaaacatgtgttccaaactactctctcagtttttaaatatttgatggtgatgatttttaacgtaatatatgatcatttatcttactaaaaattttaatggaaatgtgcaaaagtatatcatggtccaaatttaatattaaaaaaattcacaaccaaatataaatgttagttttatttaggaagacgaatgtaatatcgatatgttggcttatctattactccctccgtcccataatataagggattttgattttttgtttgcaacatttgaccactcgtcttattcaaaaaattttgaaattattatttattttatttgtaacttactttattatctaccgtactttaagcacaattttcgttttttatatttgcaaaaaaatttgaataagacgagtggttaaacgttgtaatcaaaaactcaaaatctcttatattgtgggacggagggagtacgcacaaagctcagtgaaatgcttttttgtaaaattttttggataattgtgagatctgtcattcgacacacaaaggagaaagacaacaaatcacatgacgaacttgttgtccacttcgtgtgattagctcacatcgtgcatagtaggcaacgacattgccttattatattagaagaagtggcaacgtggccgatatatatttccattgcatctgcacgggcgcacgtcattgatctgtaattcgtaattatttttgcattacaggaaaaatatcctggccagctcaagagtatcccgatttgcacgatagttttcatactagagtatgtaattaaataatatctaatactagatttcatatcctgatcccaattttctctggagtttacatgtcataacgtataactcgagatcgatcgatcaaatcatagaacatatttttcatatttagttcttgatcagttaagctattaatgtagtctaaaaatcagtcactcgatcaaatcttctctgcacaatcatcaaagcatctcatgatcgatcataacttcagaagtgctcgtgagaatcatggacccaataaataatgttgattaaaaatgcgcccaagaagtgttaagtctggtaatataatgttctggatcttcagtaactaaatgcagaataggaaatatcgacacataatcaagccctgagaattaaatgacctaaacttccccttcctaaggtggtgagcctcgttcatctcgaaggaatggcgaccgcaaagagtcgtttaaaaattaattgttttcctaattactttttagaatgtctaatttttgcggaaacgctctctctctcttggacgtcctgcggagaagaaacatatcaggtcttctcaaccactcatttcacacccgtgacttttcccctccctactttttctcctttgtatcgctcctctctccctctcccactaaggttcttgtggagcggcagacatggtggctgccacaagcagtggggacgtcctcccgtgtggctcaccgactaggtctcgcaacatagcttaaggccggggagcttggaggaagatgacaggccccccgtaatctggagctgaggcagcttccgtttgcccgagtagcaacaacgacatagctgagggctaggactggcaatgacggggtgatggtcaacagctttggtggagatagaagggcccatggtgccctagcttggatttgcaaatgagactgaagaaaccggtggtcactggagaggaggaataagctagatctaaaatggcaaaatttgtgatttttcgatgtttcagctaatgcatcttgatgttcttggggttagatcaaaatgttgcatgggatactttgatattgtttcacttttttgtcttcagttcttgcatatccatagatgtttcagtttttgaagcttgatgcttcatttgtgaagaacaaaatatttcaatctttgatctaactttgtttcatcattttaatatattgaaacatttttatcttattgtcgaaacatttctctattagaggtgtttcttaactagctccttgatgcaaacgaatctgttgatgcttcaccggtgtgaatgaaatgtttcagtcataatttgaatgtgttttagcattttaacaaaggtgaaacacttttctaatagcagtgaaacaacacccgatttttagggaaacgcctgatatgtagttgtttcgatttgtaaaaattctctctcatgggggcccggcggataagaaacatattgggccctctcaaccattcattttgcacccatcactgttccctccctaatctttctcctttgtatctctttctcctttgtatcacttccctctccccctccggtgtgaatgaaatattttagtgatgatttgaatgtgtttcagcattttaacaaggtgaaacattttttatctagtggtaaaatattttttttctagtacgaccgattttttaaaaaacttgggcacccaattttttgttgtgtcgtaacccgaactgagcaatttgctgctgcccacctacgaaggctgggatgcgccgatgctgccgcttgctgattggcttggagaagctggaatgtcgttgcctactgtgctataccactgagggaaaatatagtgcaaatcacatatatagtggaaacctaaaaactaccgttggattgtaaaatggacgtttgagattcgtctacatcaccaagtaaaacttttactcatgagtaaatatacgagtaaaatttttactcataatgacgtgaactactctcatacgtccatattttccctacaactgatgggttagcgtgttgtatacctgtatatgtgttgcgagcttgcaagcaaataatgcccagcaacaaagacccaagtttggacggggccactacacttaattaactgcaacatccgtcctataataaaattaaattagagacagattagcagcatacacaaatgaccacaatagttatatttaatgagatcacactgcacgcacacatttcatacctaaacttgattcaaaagaagtttgagattgggatggaaaaatgggaggctaggaggcaatatatcccatatttaaatttgttgggttccttcgtgactactaactagaaagacagatatttattttacaaaacttgaaaagatgtccgtgcattgcaacgggtgaatgttattttaatcttattattgttatacagtttagctatggtgaaatttactgtgggaattcgcttggatattttttttaagataatcacgagctgcagttaggagtctgatttttatctcaagttagtatgcaagttttttaaaaaaagattttttatatgacttatttcatatttctaaaagcaaatgaatttaaaatccgactcaaacacggatatgtattttcaaaagcgaacggacttaaaactaactcaaacatcaaaatatagatgacgtaccaaaatactaacaaaaatatttttgatttttataatagtagatatttgaatggtagaaattgtcgatgggtttgatccgatcacggtattttgggattattagtacgctggcaccagggtatacgtgttaccgaatgtccgagatttgcttgattatcttattaaaattgggttcagagcgtgcggaataaactgtgttttttttgttgtttttcagtttgctaatcctagcgcgtgtcatgccgcttccgccctcggtttccatcgcacagttactgatactgcaggtctgtgggtgtgcagggctttggatttggtgtgcaccacggaggcattgtgcagttgtgttacatttatgtctttttcattttctttttaagagaaattctcgttcaccagccacctcttctacaaatcaatgtagaacacgagttctacatggcaatggcacactagtaaaataaaatttatggacaaacaccctaataggttaaaaataggctataagtgtccgcgtctacaattttcgtatacggctctttataatacccacacacaaaaattaatttttcaaatgaaccacttataacgtccacatgtaaaaataaggatattttcgcacatagggctcttaactcacccacatgcaaaaatacccctcctcttcccactattttttttattctctcctccccccctctctctctctctcgcccggcctcacccgctcctctcctcttcccaccctcacccactcttcctctccccgctcctcccgacggcctcctccatgctcccccgcgcatggtggccctctccggcggcggagggcgcgggatcaatggcgggcttggaagatagtgacagtggtggcggactcgagtgggaggctggcggcgagtctcccccatcctcctccgcgcaaatttggcggtggtgtggatccggcctccacacaccgtgatcggccaccggcgatgacgagaggtgtggatccgccggcagcgaagatgggagaggcggatccgctggcgacgacgacggcggcggccgactagagttagggttagtttttttattggaatttttatttttctttttgagattttccatttttccgtgcgggcagcttatgcgcccgtacacgaaaatctgattttcacatataggtgcaccacccacacgtaaaagtagcgattttcgcataccatttggtgtgtgcggttagccataccgcatgcgtgaaccccttttggaccgtatgtaaaaaccgttttttactagtggcatactagcattttttttatcccttcttcccaccactgtttggtttttcagctatagggctctattaagtcctcttaaaaccaacgcaaccgagcttaaccgattagtttctttggggtgaatcagcttatccggatttaagtcctaaacatgctcgcattatgtctaattattcttttagtgttaaacaacttacctgtcttatggagttatcgtggtaattttgtcactctcaaaatatgccggcccagtctttcgaacgtgtttataaggataaacatataacggtccagtgtttctaagatactcatagaaatagagcgtatatgtgcacgttaacagggtgaatatgcatgtatagcaccagtgtttgtaccgtatttttaaaaaaataccacatttaggttttcatcttagagggcgattgtaaaaataaaaaatgatgtaggggtggccatacggtttatacggataattctgtttggtttcttgggttttcataatttcgattttctaaaattgccaatagaaatactcttcaggaaaatacaaacagcaccgaataaacggtgcttttgtttcggtttggtttacggttttacaaaacaaacctggcaacaactcacagtgaaattcaaacacgcaacgacggattagaaaaatcatcatacggatcgcaagacaccagatcaagatagggggtggaggtttttcagtttttctgacctcgctgttggcaagcccaagagcctctggagtcatggagactggagaggagatcaatgccaaattgccaaggcgatggtgtactggtgtggaaccacaagccagcgacgcgggacaagagcagtgggcggtggcgcatggtgattggtgactgggcctggtttggtgcctgacattgggtgggcaggtagttcgatggcctggaagatttgggctttaggtgaactaatgtgggggtactttgaaggaacaagtccacttcacgtccgtcaagtttaaataaaatccctgaacgtcaataccgggaatcttgaccctccgacttgtaaaaccaggtaaaattagatcacatggcagtatggatagatggttttacgcattctagtcagcaagaataaaatttttttaaaaaaacatatagggcccacatgtaagtggccaactctactctcctctcttcccctcatctcctcttccaagggagtggcagtggccggtgagcccgttcgtaggaggagacagcagcagcactggtccacggcgaactcctcttcttctcccgtcgatcctcttctgccacagcttttaccgctgatttggtcaccacgccggcaaggcgactggctgcagccctgcggcatttgcggtagtcggacatgacggcaatggctcggggacctcctactgccagtgcatggagaacgactgcctctggccctagcctccgctgacccccttgtcggctgccattgatggtcatgaagcttgctagcgcaatcactgttttgttgccgcgcgcgacgagcccgccttagctgttgccgctctcagagtagttggtcctcagacggcgacgatgactattcgatgttgcacccgcatccgctggtctatccgctattggggcctcttcttgccggtgtcgtctcgccataagtagtgtggcggtggtacggcgagccggtgtagggggcggtggcgcgtctcttggtccgtgcttgtggtgggatgaaggaggcctccgggttcccgatggggtcgttgtggtgcagcagcgacggcgatgacgactgctcgacgctgtacctgccaccactagtccgtctgctgttggggtctcttcttgccagctccatctcgctactagcggtgtggtggtggtatggtggccttgtgctccaacctcgaggcacggatgcggctttgtcgggtcgcacatgaagagaaacaagtcagttgcggaaaaagaactctacgggagtgacaaaccagcggcacaacgagccgaagcatgcggcctagctccatgactggtctggctcaagagtgacggtccggctcatcgcagcaaatggggacaagagagaacaaacacgagcacgggtgactcaaagtactgacaagtgggcccaaacatatgccatgtaagagaaaataaaggggggaatagggtatgtactgccgtgagaccaagttgtatgcttttttttttgtacagtttaagaatgaaaatttctgattttaggattagggatatcaatcaaactcgacgtaaagttgagggacttcaagtggacttactcctacttctattacttagtttcttcggttcttgggaatagaagatcgaacaagaaaatggttttgctagattttctgaaaggaaaccttccatttgtatactattagatctgcatttttgcagccaaaatggtagctcgctcatgcaaggattcgacctagcgacctcatgtacgctactagccaaccgagcaaagggttctttttttctatcagtaacatagacatagacataagttacaatactattatataatgtaataacatcgtaactatccccagaagattaaaaaaaataccactctcctcgataaccattcaaagattagaacttaatatatcttgatacggagcatggtacgtgatatcttggccaaataacaatcgtacatatggagttgatctcctcccttctttccctcctcaatataaagggactgtttggcatggatccaactccaactccatcccaaacacggatctagctccaactccacctttctattagctaaagcctaatcaagcggttttagctccacttaaaaagggagtgaagatagctggagtgttctcatataataaactagagaaatggatctgtgtttaggctgcttcacaatttcactctagatctaagtatctaaccacaggagttaaatttaagagttgaaactctacaaaacgcaaccgggccctttagtctatatggcacgtatatatattgttcagcttatttattactcacccagtcctaaaatgtaagtacttttagatattttacgggaatttaaaaagtatatgaaattgagtggtggaatgtgattggttaacaaaagaatgtaggcagagaaattaaatggaagaaggttgtaattggttgagaaaataggatagttgaaaaaatagctacactttagaaaaaaaaatttgactaccttagtatatgtctcagtggtatcacaaggaaaatttttaaagggaagttattcctcagttcgtgaatttagtaatctgtcagggatggatcaatgaaaagcttacgaggaaattaaattacaccacgatgactgatcgtctgatcctgagatagagaaatcctgatgcagttgaaataacctggacaccgattttctctaaacaaaaagcctatgctcaagaaaacaatctgcatgccggcatttaaggagacaaaagatgttgtgccgacctcaagacatgatcgaactagagagaaagctgcttgtctgacccataatttctcagtcgaattatgtacttatcccagctgagaaaaggccgtcatggccggtgcaaaatctgagtgaaagaattaaagcgactcttggattggtaaaaattacacctattgaaaagcatgttgctatgtcagcaatgcaattgagcatgttaagtgcaatgaaggagagaaatcttttttaagaaaaagcaaaaatcaacggttaataatgtgctcatggataaacatcagccggcctacggaaaaactacacctatccagtcatacatattcggcgcggttgactttaactatgaaatttgatcgttcgttttatttaacaaaattacattaatattatttgttttaatttattttatcattaaaagtgtttagatttatactttggtactccctccatcccacaatataatactccatcccataatataagacatggtaaaagttacgcagtctccaaaactaatctttaacttataatttctcatatgctataaggtttgtagcaacaaaattataatcatatgaaagtaaatttaaatgtcaacctaatgatataatttttaacaaataaaatttatttcatattacattaaatatatgttggtcaaatgttttaaagtttgaatcttgaaatacgctcacgccttatattatgagatggaggggggattttggatggttgtgacacatcctagtaaaatgaatctggacaaaacgtctgtctagattcattgtattaggatgtgtcacatccacccaaaataacttatattgtgggatatagggagtatctcgttttgaaagatggttggggttggagggaaatccaagatatgaaaagaaacttaaatagaatgtgattgatggatgacagacatgactgtaaatagtgataaaagtgtttatattttagtggtagcgctaatccacacgttgcgcgcagaatattagttcgagtgccgcataacgctccctccttctagtttttcctttttttactaccccacgtttacttcttatcccacctttcctagttcatttttttttcattttttaccacatcaccttccatacttcttttcacttttccatcttatccatgcttcatcaaagggcccagtaaaatattaaccatccagatttttccttttttttccttctctccagtttttcagtttttgcgttttagaaaaatatttaccgtctagtttttctttccgagttttccatttttctagtgtctcacgtttcaaaagtaacgaatttactccgttaagttttccatttactcctagcctcccacatctgctcattcaaaagtaacaaatttactcgcatgaatgcccccttcaaaagtaacaaatttacttgcataaataccccaacattatacgacactcctagatggtcgtaaaagaattactactagcttacaatgctagtaattcttttactagtgttataaatattgtttacatttcatagtctgcgagtaaaataattacaccttcctctcgatatagcccatgatctcatagccaccatgtagtaatatgtttactgatgtgttcaatacacaatataagagtaaaaactgagactttgtgatctgcgagtaaaacaattaccacatttctctcgatatagcccatgatctcatagccaccatttagtaatatgtttactgatgttttcaatacacaatataagagtaaaaacttatactaagagtattgttaatctatatcacaaaatggccgtacgaatgaaaaaattacaggctcaatcacacacaagtgataaaattactcgcaggtaaatcaaactagaaaataaaaaaatgattcagccaaaaatccatcatgaaatttggatcttggtggctttgctggattttgctataaggatagagcggttgttctatgtcttgtgactggtagtggagagggcaattgggtggcgagcggtagtcaacgatggaatcatggaatgatgtagcagcgtggtgagatgggctcgacattgcgcagtagcagccatctatcatctagcacgaaaaaaatacaaaaacattcttattcatgttatagagacgacgagaaaaaaaaacaaacaaccaccatcatcttacccctagccaccactcgtttaacgagaggcatttaagtcttatatatatatatatatatatatatatatatatatatatatatatatatatatataatttatttctccaacgttacagttgtaatttattacttcatctatcttaaaatataagaacttattactagataagatattttctgtgtagataccttatattagaaaatgtctaatcggatcctaagttttttttaaggataaaggggcaataacactagcaaggaaaaaggaccaaaatcaaactggtgcagctaggagcagtactagctttttcacataacctaatttacagatagataggacggggcactagggtacgtcgctggcacacgcagagtggatggtcggcttaacgagagagccaattggcgtgtgccttttttccgtgcgtgggtcccctgcacgccggtcacgttgtgtgcaatatgatgtacggtacgtcagggcatgttaccggctttgcttgtttgcttgcccttccgtttccatgaaaggccgccatgcgctcatggatgcaagctacagctaggatggaacggcgtgcataattgtagcttattattgcgtcaaattatcgtgttgactggttgtgcgtatgatttgaatcgataacactacggggagaattgatatttcgtcgaacggttcaaaacgcaaatatctaagctgttataagcgccggtactaaagatgattttcactaccaggtaaatattagacccgtcccactatagagataaaaaagattgtatatatgattttcggatgatacggaagagatgaaaattaaaatgaacgagcaattaacaggaagtacgtacttttaaacttgttttgaggaacaaacataattaagaggagaacaaattttagtctagtcgtctagatgatacgtccattaactcttgccaatgtctaattgtgtcatcttttagctttcaaatcagataaatatgcccctccattcgttcaattgtggttttgacctacttcctccgtttcacaattaaagtcattatagcacatcaaaatgaatgtggaaaatgctagaatgacttacattgtgaaacggagagagtactatatacgtggagtttacacagtgtggaaggtggcacactggcactcgcttaattataatggagggaaatagagagagatagaaaaattacaataaaggggatttagttttttctataatcaagtcaaatcgttttatagaaagctagctctacggtcaacttggatcccatatggacgccatgtggtcatttgccaaatgacacgaaaaaagaagagaaaagttttgtccgatttaaatgagttaattgaggcacgatattaaattaaaccatttccggatttaaggaacaagaaatagaattatccctagtgcttttacatgttggattaattgatctgtcagggttatggataccacatacctaatagtagttgactaaactcggcaggacccaccacataccatgacttatacggaaacaaacatcatatataaaaggagtttcggataaggaaggataagaagagttctatatgaaaacgacaatgactactcggattgtacttatatttatctccttagtcttacttagacaagaaggcatctacgggtataaatacaagccccctaggaggagagaggacacacccaccatagacgccacaaagccacaagccaacacaaaccaatacgccgtcagatctcgacatcagaaattagcctagccataccccatccggcacctacggaggccggcaagagggatctagcgttatctctgatctcgccgagttcgtattcgaggaggaagaccaccctgccgtcgactacgagttggttatctagccgccaagtcgacgacagttagctaggttatcccagatattgtatttgtgtgatccagatgaataaagagcaacaccggcttcggccaacaggatatagggctattacctgtaagatatggggcccgaacctatataaaaacccctgtctccatctcttttacctcaatctcgcatataccctggtaccaacgatccccaaataccgtacttgcgatatcaaacgtcgacatgatcgatgttgacggttgcttgtatttttatggtacggccatcagcacgattgatatactccctctccatcccataatatgagggattattcccttttggataagtttaaggatagcaagacaatactagaatgtccctgttaaatgatatttgcttataggtgagtgcgtagttgagggttaaaatgggtaaaattttgaattggaattgatggatgtgataagtaggacactaaaatcccttatattataggacaagggcaaaatcccttatattgtgggacggagggagtatctaaactcattcatgatgaagtagcgagaatgtagcttgaagcaacatctaaaattgacaccgttgatctatagtagcgattgagacggatctatatatagtactcctatatacaggaaccgatggaaacgatgggctccagacaagatgatgagcttcaccgatgttaatgaggccgaactacatgatctaggggtgtgtctagatcacgctaaaattgaaagtttggttaaattggaacgatgtgatggaaaagtttgaaatttatgtgtgtaggaaagttttaatgtgatagaaaagttggaagtttgaaaaaaaaaattagaactaaacaagggcctactttaatttctcagaaactgactgcttgtaacaagggaataatgacctttcaaaggaaggagacaagggtcatatagaaatgtcagaaggacggtggaacttgtgggaaaattgaggtttggtgtcactaaatttcaaaaacaagagctgagctggggcacaataataggaaagcatttcagaaaataaattcgaagatattaatggatgcctgttgatgttctatatcggtaagtattaaagggacagtgaactagatctaaaagtaaatggattgctagaacaaaaatttagacagaaccaaacccttccgatgagaggtaatacccaattgttatttgaggatttgtattcgttaagtgtattatgatatatgataatcgagttgtggtatactctcagtccctaaaaaaccaactactattagcaactactagtaaaatacagacaattttacataccattttatatgtagtcctatcttatagggtcatataaggtagtcggataaacctatcgtgtagatacctgatatgcgtagttgttcgcaatgcccatgctaaagtatttgcgtggctttaaggccatgtttagatcaaggattaaattttagatcctgttatatcggatgtttgatactaattagaagtattaaacgtaaactaatgataaaaaatccattctataacctggactaattcacgagacaaatctattgagcctaattaatctataattaacctatgttatgctacagtaaacatatgttaattatggattaattaggcttaaaaattttatctcacaagttagctcttatttatataattagttttattattagtctatatttaatacttctaattagcgtcaaatatccaattcgacgggaactaaattaaatttagtcatagatcaaacaccacctaagcaatgaaaaccatctgactgagatgatgcccatgctcaagtaaaaaagacttaaatgtggagcccaaacatatatcaaattgcagtttggtctgtgttcgctctcattgtgctgttgtgtgtttgcgagtaattggcctgtcgcactgatgggagaaattatgacagtgccaccaaaatggatatgcctgatgtggaatagggttaattagatacataccattaaaaatttatcagttttgaaatataccatcagtattcacgtatttggaaccatgccattacaattttacacatattcaagatatgccactacctaccatttacgaaaaaatttagaccaaattacccttctttgcttctttttctcccctctcctttcttccacagctcagagaacaggcggcggcggagcgagcggcagcggcggagcggcggcggcagcaacggcagcggcggcagcggtggcggagcggcggcgagtaacaacggcagcagcggcgcgagcggcgagcggcagcggcggtggagcgacggcagcggtgagcggcagcggcggtgcggcggcagcagcatgcggagcggcggcgagcagcagcgcgagtggcgagcagcagcggcgtcgagcagcagcagcggcggtgacggcgccggagttgaagcagcggggagagagagcttgaagatgagagaagagggagagaggtagaagatgagggcattttcgtccaatacatgcaaaatacgtgtcttagtggcaccactgaaattacaaacaaatatcaatggcatcgttccaaatacgcaaatagtaatggtatatttcaaaaccggtgaatttttaatggcatgtatctagttaaccctgtggaatatgcctaggaaaggggacccattcaaagcctttgactgaacgtaaatattgtgagcaaatgttgctgtcaggagaattgaaggcctaccaaatcacgggtactccagtagttctttttttaaagagacacaacggcatcacataatttacagaagggaaattgttctgctcccttcctctcaaatatatgcaacctccattttaaaatataaaatgtttaaaatgtatttgaatagaacatgttacattttgagatgggtagtagctattcgaacttggacatataaacgggtaattgcacaagcttatttcagaattttctttctctgtactggttaccgcatatcagcacacaccttattcacagtagcccatgagttgagatgaaaacggtcggaaaatccctataccgattttattttcatttttttctcgaaaatggaaatgaaatggtagacccaaaaagatattggtaatatcggtatattggaaacgggaccgtcagaatagaatataccgatactggtcggaagtcgaaaattcatgtcggaatcagcggagcctggcatagcacacattttaactttattcttgcattatcaccctcagcataacactgttagattaatgatatgataataagtgtgacgaacaatatagtcaagttcaacaatacttcaacatcgataattggaaaagaccaaagttcagcaaaatacacatgccacgtcatagggtttacaacattttccttggtcactttcctttttcataggctgcaagtctatcaagcttccttcattcgtgggctttcgatgggttgggttggcttagccgctggagaagtttcggaattttgacggaaattaccgtacaaataatattatcgaccaaacggtcagaaaaacctccatcccatttccgctactatttctgaaagatattaccgtttccttttccatcaccgtcgattaccgataccgactgaaacggtcggtgcaaactggaaacggcagctaaaaatctcggaaatttccctaccgttttcacccatgagtgcaaatcgtttaacaataaatgcatttattaacttcactacattactttcaaaagggttcgctaaattactattaaaaccatatatgcgtgtgtgcagttgtcaagatttgaaccacagtagatcgagttatatatatatatatatatatatatatatatatatatatatatatatatatatatccatgaagccagtatcgtacttacttattagtgtttcccatgtttagattcttttttctttcactggcatattcaaagtgtatgcaaaatttgacattattttagaaatacaaagctgtgtctgcgtacatggttactgaattgttaaacgatgtattttcttaaaaaaattctagagagaagttgttttaaaataatattaacccatttttgcaagtttaaataattaatacttaattaatcatacgctaatgactcgccacgttttagtatcttcaaggctgtgttctttctcatgggttcccaaccggccacatctttttcgcgtacacgctttttaaactactaagcagtacacattttgcaaaaagtttatataggaaagttgttttcaaaatcttattaatccattttataaatttttttaagttaatacttaattaatcacgtgttaatttatcgttccgttatcggaaagaacacagcctaatctttttctttctcctcctaaacgtccgatgatcaaagttcaaaatggtcatctataaacctggttactgtatggcatgtcactactatacaaaatgtcgatatgaatggctacgagtacaaattaatatacacagtttccgatcaatctacgtgaaaggatatgtactccttatatcgtactaaaatggaagatattttggttggatgagtcacatcctagtattacgaagccgagtagtcttcctatctaaattgtattatgggtgtatttagttcatgctaaaattgaaagtttggttgaaattagaacgatgtgatagaaaagttggaagtttgtgtgtgtaggaaagttttaatgtgatgaaaaagttagaagtttgaagaaaaagtttgaaactaaactcggcctaagatatatttcatccaaccaaaatttcttatattttagtacggataaaatagtaataaaaaagaacaccatgaccctgactacaattaagttgtgcccgttgccggtgtttcacaaaaccgatgaaattttgcaaaaaccggacttctttcatgaaaccgttagatcaaccggtcggtattaggtggttttgtatgatgttgaccaaaaatcatcggattttatcggttttcggtcggatttcgataaacctgtgagaagctgtatttacttcgaaattgaatggttaaaccctggtcgtagctatcacgtcgttgccagtagcgcagccgcccagccatcgccatggcccatggagatcaaagctatcgctgtggccttaattcccgagccacactaaaggggaggaggtgatggccactggtaccctaggtgtgtttagaaccagagtttggattcaaacttcagtccttttccatcacatcaacctatcatatacacataacttttcagtcacatcatttctaattttaaccaaatttaaactttgtgctgaactaaacacagccctagtccacttgcttgaagctgccattattgcccaacatcttggccaccgtcatcatcaggttcgcccatcgctgcattgtttgaggcccctattgcggattcatctaccgtcgagtcgatcaagaccgctattgttagatccgataggccaccaccggccgtctctgctcgatgccaccatcatcattgcctcctcactcgaagaggggatctataaagttgattcatttgtatcataatgtctatatcggtatcagaatatattaattatacttagattatagtgttataatatatgtgttgacactttttcgtggccaacacaagatcacctaacgatttacggtgtaaataatagagtcgtcaaaatggaatgatcaaaatccgctagtgaaaccgatttcgagattaattcactttcgtgaaatcacacgactaatttacaagcaaattagcaaagaggataaatatcgtacttacgtgacgatgaacgactagtttccgagcaaactaataaaggataatcttctcgctttcgtggagaagcacgaccgtttttcagcgcaaaacggtaaagattaactaaattctagggttaccaaaactcaaccatgaaaacaaaatagaaaataacaggaaagtatagaaaaggaaaatagtagattgataattttgttcgggggtccttcaatcgaccgtagacctgtacatatacagataccatggtccaaccgaaaagaaaactaactgataaaatagaaaatctatctaggcatgttcaatggtagagacgagtatggtctcttaacaatataaaattatttagagaccgtatctttacaatagttgagacaacaaagactctaattattaacttaaaaaatattccttttattaatattctttctattttttttacccttgtgcaaccatatttccatattataatgatcaagagtcgttgttaagccgttgttatgtataacaacgatgttttgtctctcctatttctctttcttccatgtcaaagtattcctaattagcaatgctaagagaccattattgacaaccattgtacatgcccttatcttcctaacagccgtacgcgctaatcacgcctcatcatctccaaaccaacgccactgatccaaccttcgcgcaatacgcagccgcacaaaacagccaagcgagagcacggcaaatttctgctcgcctgcatgtatgtgatcatcagcccggccagaagcttgtcgactatagcaaatttccacttgcaaccagctgcacgagtcttcacctctctgatctctatctgcatgctaatgcaaatagtactaaataacgcaaaaaccttccttgactatggttaagctcagctaatccataatatttccattctaagataaatgctaagcctccctagccatccacgcacacacatttaatcggctctcaaaccaaccacttcaaatcatgacagctaaactaaataatctggcttacccaaataaaataaactattagccaaattatgctacaaacaatatagatcataagcagtttaatcataagttttgctgaaagtcgtcggtgtcgtctgataccgacgctaacactatatatccgcccctgctggaaatccatttttatactgcatataaattgtaaatgctggtaactagccgaattgctaaaattggaatcaaactggctgttgttggattccatcaagagatagtgctccaaccaatctattgggtctttaatcatgactatatatatatatatatatatatatatatatatatatatatatatatataggactagatatgccgatcaccctaaacgataaaaataacggaaaccctaaacataggctgtgtttagatatagggatgtaaagttttgacgtgtcacatcggatatacggacacacatttgaagtattaaatataatctaataacaaaacaaattacaaaatccgcctgtaaactgcgagacgaatacattaaacctaattaatcattagcaaatgtttattgtagcaccatattatcaaatcatggcgcaattaggcttaaaagattcgtctcgtaatttatacgcaatctgtgtaattagttattttttttgtctatatttaatactccatacatatgtccaaacattcgatgtgacagtgtgtaaaattttacggggggccataataagtttttagttagtttcttagtccctctattcgtgtgagtgccagacgaccggttgaccatattagatagtagtagcagcaaatatattgagaaataattttaattgcataatataaatacaaatttttaattagtttctggttgaccgctattattattctatattaatatataatggtataaataataaagcaaagtgtattactcactccgtttcacaatgtaagtcgttctagcattttccacattcatatatcaatatgaatgtgggaaatgctagaatgacttatattgtgaaacggaggaagtaactaagatctatgtctactctccatgacttgcctccacctcaacagatatttcttaatagtgtaacagcattgtgataaacaaagatggttcacgattgtatattattaattattttttggaagctcttaccgcttcatatggtaattttccatctcgatacatagagttatcttgtaataccatggtcaagtgggacctacctagtacataaatcaattttcagacagacaaaaccgatttctatatgcggcttggcggcccgcctacacctaggtgtctgcaaaaatcaatattttttcttatgggtagcccaaccacatgcaaagacaggatttgcgcatgctatcacctatgccaactgtataaaaaaataatttcaacgaaaaaaatccctaaaaaaaatagcccaacccctatatccccattctctcaaaacactagctcatcctcctcatcatcgtcattgcaaccaccactgccatcgttgttgtcgcagtggccaccgctgccgtcgtgtcgtcgtcgttgtcatagctgctaccatggccgctcgctcccactgccgctcctgagggcaggggcggcggagctaccccgaggctaccggatccgcacgtcggcgccgctctcgagggcgggggcagtggatccgctcaccaacgtccctgaggctgcctctgtctcagtcgcctgcccctgagaccgccgtgtacaccgtagacgccaggagtggagaagagaaagggaagagatgaggtgaggtgagggtacgggagtggaagggaaagagatgcggtttaggatgagaaagagaaaaaaagagtgatacggtgggacgtgtgggctcacttgctctccaagttgaccgtttcacgtgcagtcccttaaaatgtacgcctacgataatgtatcttcgagatgggcctattaaggggacgtctatgaaaatatatttttacatgtcacccttaaaccatcccgggggagcgatttttgcaatttgaagagaacatagttcagaaaaaattaattccgtagtagtactagcttcaacttcaaactactactacatgtgaatattgttggcgagttttacatagtatgaaaaacatatgaaaacgtatgtagtaaaaactaaaaaactaccgttggattgaaaaatagacgtccgagattcatccacgtcatcatgagtagaaattttactcacggatttactcataagtaaaaattttactgtgctcgtgatgatgtggacgaatctcggacgtccatttttcgatccaacggtagtttctaaatttccactacatatgtggtttccaccacatattttcatataaatgtataccgagcacacataccaaagtgtggtggtggagtaattttcatgtagggtttaaatcctagtttatacaaataattaggcacatgaatatgtgtctttaatagaaatttagttattgggtatgcattcgcgaggtgtatgcgcttacttgatcaggggaaacccgtaaaagcataccccgaagcagcttaaaatgttcgatgcacaactattcctgcagtataataaccgaatcgaaattccagctgtttacatatcacaaataaccgaaatggggaacaaattgagcaatatagcagtaatagtgatagacaatcatcaatcatcgtcctagcgatcaattcatatctctatctcaattgtttaacgcgtacgcgtacttacgttaatttcttgtatgacactgtacttaattcttagtactacgtagtactccctccatatctaaatatttgacgccgttgacttttccaaacatatttgactgttcgtcttattcaaaaaatttaagtaattattaattctttttctatcatttgatttattgttaaatatacttttatatatacatatagttttacatatttcacaaaagtttttgaataagacgagtggttaaacatgtttaaaaaagtcaacggcgtcaaggagggagtatataataactagagatataatcaccaattaattacgcctggtcagtctatcgcccggacatcgccgtacgtacctgccactgccgccgctgaggtaagctagctaaattaatactccctccgttttcaagtaacggacaatgttaacggtatggtttcacatttgaccaataattggttaaaccatgacaaactaaagttctggacttatagttaggatgccatacaatttaataatatgaaaacctttttagtattattcattttatagaaaaaaaacgagcggtcaattgttgaaaaatatatttctatctctgttacaaattatctttctaggattcaaaaattagctcaaaatatttatcactttcaagtactgttggtcccatcaatcatctcccatttaaattccctctattctaccctaacttccactataccttaatttatagttctaaattatttaattatttagaatgataagtattttacggagaaagtattttaaaaattataggagtatatactttgcatatacatctccctgagatgcagggcaatccaggaagcgaacgagtggcccgtggggaaacaggtaacctactgtcggaccacatgaatggcctaccaacgccgtttgcctgccgctaccgcctgtattgcagatagtatatactccctccgttttaaaatgtttgacaccgttgacttttagccacatgtttgactgttcgtcttattcaaaaacttttgtgagatatgtaaatttatatgcccacataaaaatatatttaacaatgaatcaaatgataggaaaaaattaataattacttaaattttttgaataagataaacaattaaacatgtgataaaaagttaacggcgtcaaacatttcgaaacggaggaagcagtactgtatttgctttcattgacatgcaagcaatgtcaaacacaatcaatggcaatataagcgattgcaatgctgggcagatagctacccatatccatccatccatagattgcttagatctggatctcatgatgcatttacactgccgcggccagccaggcatgatcgatcggcagggagcaaagcatttcttattccagggtgttttccacgcaaacatgtaaaaggatagaaatatgccactcacttcatccgaaatataagcactttagttttttagattaattaagtatagagattttgtatgataaaatttacaagtgacacatactgccgagataaaatccacagatttatattgatttgccataccactaaaatagacaatacaaaattaaaaaaggtaaaattatctttctatgctactattgtatagggtaattttataaattcgcgatacaacggaacaacactagatgtttacattcactcgatcctaattcctcattccccatcgtccactcgttcttcaccattgtgaggccatctccaatccagacactgccaagtagtttccatacttaccagtgatatagaatctatgtatagaaactactatatattcaatagatggtgtcttcaaatcaaattcttattcaatcacctctcttctctcttcttttatccatctatatccccctgtttttattcttagtacttgtgaagaggtggttccttgcatgagaaataatttcttcatctttttacctctctcctcattaattttcttggcacatcaaaattttgcttatgtgtcaatatatttaatgctatgaacactagatgacatgtagggttggggatggcctgagatggtgctattaaaaattattacacaaataccatgtctcaattaatactcctagaattattgagatactccacctatacttttatgttttaacatagttaacttttaaatatatccttcatttttatctattaactaggaaaaagaatgcccgtgcgttgcaacgggtgaaagttgttttaatcttattattgttatacggttaaggtgaaattcactgtaagaattagcttggatatatatttttctagaaaattatgagctacggttaggagtccgatcatttcaagttagcatgcgagttttcttaaagggatttcttatacgactccttctgtgtttctaaaaacgaacaaacttaaaacctgactcagatacgaatttgtattttcaaaagtgaacgaacttaaaaaccactcatacacggaaccaaaataccggcaaaaacatcttcagtttttataatagtagagatagagatttcttacaaatatgaaaagaaattaagtaatgcttaaattacataaattttaaataagataaatgatcaaatcgtagattaaaaagccaactgtgtaaaagataaaaaaaaaaggagtaacaatcttctttgcagccctgtaggctatccactattactccgtttagaaaaaaatgattttcaactgtaaatctagacacatgacatagctagtttcaaacttagaaattaaaattttgatataacaaaagggagtactatatgtttataaatcagtataaatcatattcattttgcctgtccgtatttgcagccgatacacgctggtggcagtaaccccgtattaaaaaccatttcgtccttttgcatgacgtcatcgcgcgtcaccattttttgccgtgtcgaggtgaagcaccgaccgcgaccacgacgagccacaccacccacacacgcacacaccctcatcaggcccggtccatgcccaccccccctaccgcgtcgtctcgcgcccacaccccacttgcgcgtggggcccacatggcagcggcccatcgctcttcctcgacggcatgcctctttctgccctgacggtgaccagctttagaaaaagggcagagccctccctccgattattggcacggcgaaggcggggaaaaaagaacagcgcgctcacgtcactgacagggtggggtagagctgcgtgggtcccacatgtcattgtccggcgcattgaatgcaaccgccggcacaataggcaagtcggcgctgcgaccggctttggcaggttatctagatattgtaaaaaaacttgcgaagggtcccacgagttgtgtgaacaaggtccatggactcggtcatgtactcatgtggtttcctgcttctgaagcttcgtgtggttccgctttacaaacaagggtctgtgtttgtcacaatttttaagttgaagttatacgccgctaaaccaataaaataatttttcgcgtactatgcataaatgtgctcatatttaggaatatcacgtgcgctagtacataatgacttattagagaatatcacgcctagcacaataacttacttcctccattttatattataagactttctagtattgtctatattcatatacatgttaatgaatttagacatatatttgtgtttagatttattaacatctatataaatatgggcaatgctagaaagtcttataatataaaacggtgggagtattaatgattacatagtcaattttatgtttgcattagacatgttcaatcattggttttgcggctacaccacggccggcgccaatagtatccaaatgcaacggtagcacaataatactccctccattttacaatgtaacactttctagcattgcacatatatatatatagatgttaatgaatctaaacacatacatatatcaagattcattagcatctaaatgaatgtgaataatgctagaaagtcttacattgtgaaacggaggaagtagctgtcggcctgacaaccaggccctttaacatctcttgagaaaccctcgggaattctagtgatttttccttacatagtacatttcttttataatcagaattatgttcctattaagcaattatactttttgaattaattttgcaaattataggtattttaatcaaactatctaaaactatgcttcctccgtcccaaaacaacctcatttttcacctatctcagacataccaataaaaaaaagactagattactcccactttattaaatttcaatctaattattccctactttatctactataaataaatttatcttctactttcacaaactttagtgcaatggctattcaagagtgaacttattttgagacaaacggaaaaaaaaggcaacaatgaacttactataggatggggaaagtagatttaagatgttatattacaaaactataaatttagcgataattttatcatgaaactataggtttaaggttaagtatcgaaaactacaaattttaatattgaaggtatcacaaaactataagttgtagagttttaatccctagcattaccgtcatgttggagctataaagttgtagttttgtgattaaattgatactaaaacttaagttttttttactcaagttactacttaatttatagttttatgaaactctatcttgaatatgtagttccgtgataattttattgctaaatatataattttgcgatatacagtcttaaatctatagttttgtgatagtttaatcattgtaacaaaatttactctatacttttttatatggtccattgtagcttagatttgttacaaaataggaaaaagttaatatgatcaataaaattctaatataagtctgtatatcacctagaatatgatataaagaacactttgaaatatgaatatattagtatatacttttatactaaatatacttataatttgacaaatcactaagtcataattactccatttgacattttaaaattagcatatgccttgtaaaatgataatttcaatatttaccattccaaaaaattccaaattaatcacacccaataaatatgatagtactaatctatctttttctaaatgaagctacaaaaggatctttttagaaaggtggcacattctgaatccaacttatgccactaggatatacacccatccaagttgacaccctaatactatatgcaaataaaaacaccactaccttggacattagtgctccccctcatggtgccaaagatattttccaagttacccaccgactaacctactacgaaaaacaaaaccaaaacaaacaactcaaaccccctattatttttctttaacagaaatatcatgggtgccctcgcggctaagcaaaccctttaaaaacgacccctccggtccatgcaccgggctcacgcacgcaccctccccacccctcccgccccctcggggtccgcgcatggataactcgtgggtgggccccaccaccccctcctcccctcccgcagatttttgtacccgcccgtgtgtgtgcgtgtgtaagcaaacccaacccaccgctaccctcttctcgccgcaagcgaggcgagccaagcaaacgcgaggccgacgacgacgacgaggaggaggaagcgcagccactagtcgcggcggcggcggcggcggcggcggcgggtgatcggaggagggatggtggggcttgtgggaggaggaggttggagggtcggggatgatgcggcgggtgggggtgggggaggagcggtggcggcgggggctgcggcggcggcggaggcggagcacatgcggaggctccacagccacgcccccggcgagcaccagtgcagctccgcgctcgtcaagcacatcaaggctcctgttcacctcgtgagttccacgactcacgacgccttccatcctcttttttttttctgttcttcgtttggtgtttgttcgattggttgcgtttggtttggctacttggctcggtggttgctccttggatctgaattttttttatactttgttttggcgctgggtttggtgctcgtgcggctcggtttgatgcgtagctgttgcctgagatatttgttcggttgattggtactagctcgaattgaatgtgcgaatttcgccgtgtttttggccgctcgagatcccaaaattgtatgggatgttttgacttgtttcttcgcggcatctgcttggttgattgtattgttggtgatgggagtatttgattgtttgatcgattgatcgatcgctgctgctgctgcaggtgtggtcgctggtgcggagcttcgaccagccgcagaggtacaagccgttcgtcagccgctgcgtcgtgcgcggcggcgacctcgagatcggcagcgtgcgcgaggtcaacgtcaagaccggcctcccggcgaccaccagcacggagaggctcgagctgctcgacgacgacgagcacatcctcagcgtcaagttcgtcggcggcgaccaccgcctcagggttcgtgccactcgatactgatacccatttctgtctactgctctgcttttttttgtccctttttagattagataatgtgctctgcttatttctgccttcttaattactaatccagtatgattggctcactgcaagtatatcatttatgccttcttaattactaatccacagtatgataaactcactgcaatccagtatttttagaaatcttgttttctgttttatcttggtagcaaatgtttggcattataacctctgcatatggcatgcctatctagatttagaatggatatgggttctggaagtcacattggttcatccatcgttttgattggatcagatgatagataaccttgtgcttcattatttgacctactaatttctaggaagtaatataatcatgagtagttttgacttccactagggatagaatgaaaaaatggacactgggaaactcaaccctgttttccctgttcttcatttgggcttcagtttaatgatttgcgatgtgaattccaatacgtcgtctgctttcttgaaaggcaatgacctactagtgtggtctgcatgtggccttgctgtttcttgaaccttacttgaaaaataagttgaccatgttgccttaattgaagaataatgattttaggttcttgtttatggacagctaggcactcatgatctttacgacttgtcaaagctttattttgatttgtactgatttctgtctccccactccttcagaactactcatccatcgtaactgtccatccggagagcatcgatggaagaccagggacgcttgtgattgaatcatttgtggtggacgtgcctgatggaaatacaaaggacgagacatgctactttgtcgaggccgtgatcaagtgcaacttaacatctctcgccgaggtatcagagcggctagcagttcagtcacccacctcgccacttgaacagtagggtcatcactggcacgggacatgcgaactggcatgaataagaagcttcaaatggttgctagagatttaaatctttttgagatggtagttcctccattgtcttcgatatatatgcctcttgtaaggattagtatgtagggttaattatctttagttgctggctagtgatgggcttaggtctttttagggactgcacctagctaccttgtagttatgtatgcatactgctagtagtatgtgtataaatagggaagcatggagtggtttttgcctctttggtgcacatgtgaaacaacctcaagagttctttttcctgcatttgagctggcttcccattgtagtatagtattgttgtgttcttggatgacattccgctaacacttgggcttggttgggggccttttgatttgggtggatcttggattgtgctgtaatatatacatatgaaaggagttctcctttgcactatgaaatcctttcatagtcaaagaatatgcttattgaaccagtataatattcctgcacatgaccatgagttcaaagacaaacaagatacctagaagtccaagattaaagtcagccttaaaaggagtttctgaattctcatgttgcaacagagaacagaatcgttgagaaaatatctgggttttcctgtgtgaagttaggttgccaaccctttgaatgacaaccaaaaatcatcaaggctgaaggaggcaagtccatcctcgcatgcttttgcaatccatgccctctttgggtgctgtcagttttcaggtcacttattattatcattaatccaagtctacccccattctaatcctctcgttacaagtagctttccaagcattgtttgagacaaagcaaaggcggtcactttcagggccagaagctcctgagatggcttctcgagaaaagtcgatgctggaccaaacaatgcacaagctttgctcgcgtctgttcttgtttgtagctttgtttggctgagagggagactctgacggtgacttgctcctaccaccaaagtatggcggttttcagagaaaaatgtgttttggtttatacaagtttgcatctttttttttcccctctttatctgtttgttcactgcagcgatgactaactaacgattggtcgtttttgttccctaagatggtaaggatgatatcgcttgttttgccgtttatgctggtggacagaatgagtggcatcacttgtgagagtcatcttgagactacgttagtgcgctgcggggagtacgccgtcctcgcacatgtttgagtgtttgactgaagaggttgtctgtctgtgtgtgcaagataattatggacatcaggatattttccgattacaagacacccaccgcgtgcaagtattttagcgagtactcctactttcctgtacacacactacttatcgaaaggagcaaacatgtgcgtggataattccatggccgtggtacccatgggaaactaatgtagtgcagtcttagcttgtgcttgagacatgggtccacatgtcattgacctattttagagagtagtggagtatatcagaggataactcatccataccaaagccagaaaggctcgaactgatggcaagaaatatcgcaaggatttggcttcgatcaaaacccctcaagagtagaattgaagctactaacaaattaatttgtagagcatgacttggtagttggtaccaatccaaaatgcccataaaagtttagtaaggtgtacaaattgatttgtggaaatccaaattttgggagttctaaaagttctctcataaaaacactactaaaatttaagaagaagacatcgaactaaacacatctaactcaaccaaattttatgtacactaaaacatgtaaaaaaaaaacaataattttagctacaaactgaacaaaccccactaaactcctcgctccatatccatcgcagaggacaagtagcagaccaatatgcatcgacctcgcacgcagctatagctattatcgtgttacgagaatactccatctctgcatactctttggccaaacaaaaccactgcactacaatactacacagaacatgcatatggaccggtctgcatcaaccatccgcacgtacagtcttcctcaccttttttgcaaaagagaagaggagatcgatcgatgttacgcgaccatctcggagaggggattgtcatcgccgtcgtcgtcgtcgcaacattcgcatcggtcggacgtgcgtacgtgtgccgtggcgccattggccgcggcggtgtcgcgagcttatccggtggccattttgttggatctttggatcggtggggcgccatcgcccgggagcgaggtgggaggccgccattggccggcgccggcggagggtccttcctgatatggcatgtgtcaagggaggtagagatggcgggttgaaaatgggacatggaatctttggacctgtctcatcacaaagtgtttttttttttctgttgcgtgtaaaagtttgttgaggataaaatcaaatttggatatatctttcaccaaataagatattaaaacggaggaattagattatactacgaaaatacgtgatatatgtaatataatagctgcatatataatcatggtattcacaggaaaactaaaagcaccgtggtggaaccaaaggagtatgacttcattgacaccgctcaacatggtttaaattaaggataagtccattttacccttctcaacttttaaaattgttcattctacctccttgcaaaagtcaccttgactttcaacatccagtcagcaaaaaagtaaagaagaatttatcgacaggttgtaatcgcctactgtcgagccaactatgcatcttctttttgcctctattgatgaagcaagccgtggaagcagcgatggcagcaaaggcggatctcggcagacgcagtgtatggataagttggcgaccgagctcatggtgagaaagagcccaaagagaatatgacactcaggattcagggaagagaggaactcaaggagttgaccatgctcggtggatgtgggaggcactccttgaaagcagaggcggtatgtggactgtacttgtaagttgtaacgcccaataataattagaggaaaaaaaatactactagaaaagaaaggagttgggccttgcaagcaagcagtagtgctagtgcagctagcagaccatgggccttgcatccttgcagcgagcaatagcagttgggccaaagctaagctagctacggagaagcagcagcagcggcaagatggtctagagcatctccaacagagtggctatttttgactctccaaatatcctattgggctacttgccaaaaatttagagaaccaaatttacgtttcactctgacagcatctccattacacttctccaatttaatagtgggacccatacatcagtctcctattcttccctcttctctacatttcggtgcgggatggaggcggcgccggcaggagaaagcgcggggatcgaagcggcggtggtgggagcggcgcgggtggcggaggacgacgggagtggcgcgaggatggaggcggcgccggtgggagcggtgcgggcggcggaggccggtgggagcaagcgagcgacggcgaacaacaacgaggcggcggtctcggcggcagacgacggcagacgacggcagcgtcggcaacggatgacaacacctcctccgagttacccgtatgttctttctctctcggtgcacgataccaggctgcgagcgggaggccacgacgaagccctccctcgctggcccctctaccacctcgtctcccatctcactggcgccgccgcttccttcacgccgctgcccctcatcccttcttctctctcttcggcgctcaagagggcacggcggcaaggcgacagaaatcagcgctggatgccggcggcgacaagtgggaggctgcggcgacgctcgccgtcgtgccgccatgccaccacatcctcttccctggtttttccctcagcacggccgcaagcggatctcgtggcgacggaaatcggcgcgggaggtcgtggtggcggaaatcaacattggggaaaggcgtggtgcccacaatttgccagtcagtttggctggccaagtttgactagtgggaggtgaagtttggccatccatttagcttagccattcaagtagagagactgttggagtgagattttttttgctaaaatttaacttggagacgatgttggagatgctcttagtcccacctctctcagccggcagccaactagagcagcactagtttataaggtggcctacctagttactattattaactccattaaactttttatgtaaaatgatgatgaaaacacaagagagttaaaagcatatgtagctgtgataagtaaataagttgaacccaaaaacaatattgtttttgaaccctaggtgataactaaataaattaggcccaatacaattccagccctaagcgttacagtggctctctctgaacttttcaccaccatcaagccgacatccaagcagtggcgtggccaggaatttttcattgggtagtcctactcacaaatacacatcacatatagctaaattttcaaatgtcgtaaatcccatatacgagtacaaatttaatgaagtcctaaatcccatatacgagtacaaatttaatgaaaaagtgataggaatgtaacaatattgtctaatatagtcaatatttgactaacttaacaagcaagttcacacgttcaaatataaaagatattgggcacatatagaaaatcacagtgccactatcttagctataaaagttgttattctcatgtcttcttcactaacttcggaaaagatatctcacttgatacatgtgacgaatcaatgattcaataaatcataggagtatattgtttctctgcgtggtcatcactagattaaggctaacatacaaacgagcaattccatatcaacctcatgtttacaaatcctacaactacaatagtaccaaatagcaacacattcacattcactgattcaccaataaaaatagagtaaatttcgcaaaactacatgttttatggtttaagttgcagaaaaccacctatattttaacatttggcacttaagtatatatattttggtagtgtagtttcacaaaaccacactatcaataaatggattcacatgtgagatgacgtagttgttacacctaggatgagaatatggcatcctattaatttcgtgtgatggctggtaataagatgccacgtcctcgtcataagtggaacagccacgccatatcacgggtgaatcaattcattgatagtgtgattttctgaaactacactactaaaatatatgtacttaagcgctaagtgtcaaagtatatgtggttttctgcaacttggaccacaaaacatgtagttttgtaaaatttactcataaaaataacattcacagattcaccgattcacaaatcagagtacactgatttactcacctaagcacgggactctaaggggtagacagaaggaaagcatcgaggcaggggatcaactagggccaggccgccaggggtcctgggctcccggctcctgacgctggcggccggtggcggcgccatgtgaggagccccggcgcaggcagcccacacctgggcagcgtggcgtggggagcggtgcctctagcactctgccattcggcctctgtagatcgagttagggaagtggtggcggcggctcgacggcggcgcggcgaggaagcgacgacgcaagcgcgtagcaaagacggcgaggaccaaaggagtcgagatggcgtcgtggtgtgtcggatgcctcgactcccaaaagatcagacctagcgctttttcccttctctctttgtgggcttgttttttttggcttgaatgagaaccaaggtttatgggcttttttttcggagggtggggtatcctgggcaaaatcgggggtagtcccgagcccaccaaggattgttgtggtgcttgatgaaagcggaggtggagacaagcctttgtaggcttgtagccaactagatccagactttaggacatgtcatgttctcagtggacctaccagcttagccagcatctgagtagagaagctctagccaatcgcctctaagtgtcacatgcaggggaaaagagctttggatggcgtataggtgggcttggatggctgtgaatatgggaggcaaggagcggcgtggatggacaagggctctgagcaacaacggtagtatgaggagattcaagctacgtataaacactagcaaatatggactaagcgacgccggcagaagactggataagagctccggtcgacgtaggaacttgcgctctaacttacaagatgcacaagaagatataagagagcgatagggagagagagggaaagaggatgagtggatgacatgttgagccaacaaatttttttataaaaaatattttcctcattagtttggtttggaagaggaaataaatgaacggtcgaggatagaatgaattgttttaagaatttgggtgtattttaagattaccataatagttgtaatattttcctcattagtttggtttggaagaggaaataaatgaacggtcgacgatagaatgaacagttttaagaatttggttgtattttaagataaccataatagttgtgtagggtaaactttcggccataagtgagcagtttttgataaaaaaatgaataaggtccaaagattttgatcctggtattggtctctctgagcacgtgtattgaaaggtcgagccttgcaggtgctgcatgtgccccaacaggtcaactttattttttctttgaaacaatatgtcaacttttatttgacattgtatacaagttaccaacacgaagcatttcttgggactattttatgtactctgttgagtttcctactacaagcaagagtggattaactccgatcataaatatctcacttttaagacatgatttaagttaaacgacatgtaaaactttaggaaaaagtacgaattacccccctgaactatcgaggtcgaccgaattacacccccgaactcgaaaaccagaaatgctacaccttcaactattgaaatcggacaaataaccccccgattcaatccggagtggttttgagtccacgtggcagtctagtcagtatttttttaaaaaaataatcagtgggccccacctctcagttctcaccactctctatctctctctactctatcccaatctctccctctctctctcttctcaccccaccgtgctggtgagagccggaagcaggcggcgctgccggcggcggagggcggtgggcagctgagacggaggcgaagcgggcggccggcagcgggaggcagagctcgcctgcgcaggttgctgtgcaggttgaggtggcggacgagcgcgagcaagccgagcacggtcggcgcacgtacccggacaggttcttctggcgatggcgacgccgacaagccgtggcctgacgacgggcggcggcgcgaggacgggccgcggcgggcggcgaggacctcggctcctcgcatcgtgacgtctccacgcttagcaccgcccacaggtcatcccgtctggccgttcaccaccagcgctccagccgctccattccaactgctggcggtctactgccacatccgcgccgcgcgcctttccgtcggtcaccgcggcgcgaccgcgcgaatgcaactgcgacctgccctgatatttgttgccatttgctgatccgccgtccgccacccgcagccagcctcggcctctgtccccacccaccgcccgccagccgcctcgacaacgacgtgttgacgcacgtcacaccggcccaccggcacgggtcggcgtcggcgtccgaccacgacgacagcgtccccccgacgggtcatcggtcaccgccatcttgaacgccagcagcgccaccaaatcctccacccgtggccacggcgaaggacgggtagttgaggttgtacatggactaggccttgctctccgagcagccgtagctcttgctcctcgccacggcggcgatcatggtggatgtgtagttgagcgcgcagcgtcgtgggtggcgccgcctgctcccgccctcgtgcagccgcagccgtgctggtgagaagagagagagagggagagattgggatagagagcggtaggaactgacaggtgggacccactgattatttttttaaaaaaatgctgactagactgccacgtggacccaaaaccactccggattgagtcggaggtgttatttgtccagttttaatagttgagggtgtagaatatctggttttcaagttcgggggtgtaattcagtcgacctcgatagttcggggggtaattcgtactttttccaaaactttatctcgtcaactatcaactctacttaatttggatttcttgggctattttacatttattatgtcataaaaatactataattgagatcccaaacataagcataagacgacatttattaattttagaataaaaaacctaattaagggtccggatgaagtacaacataatatttttaaaatttattaatttgaaatatcagatttattaaaccaagttaatagtacacttatactccaaactgactacaatttggtatatatcaattttaaatttaaattatactacataatctatatctatatctgtactaatataaaaaggaaaaggagaagttgtccccctacaatcctactacccaaatcaatctggtataatcaccatcgtccatctacatccacatcaccttgatcgctaatcctaccgtccaccgcgatttcaccctctccaccgcgcgaagaccacgcctccgcgcaatttcaccctgtccaccgggcgaagattacgccctcctcgctcctcttcctcgcgtgtactgttgccgccgcctcactcaactgctgccgcaccggagccgaggtcgtccccagccgcccccgacggcgaggtccttcctcgccgccgccgcactccacctaccgcagcctgtccccgacggcgaggttgtggttcccccgtccaccggaccgccgcgactgcccccgatggcgagatcctttcctgccgccgccgcactccaccgcagtctggaatcaccggcgccgaggtggttccccttccaccgcacccgtccgggactgccccccacagcgcctaggtggaagtggaatgcctttccgtgctttcattccacgacttcttcaccggcttcctcgccgacgcctaccttctgcccgccatcctgaggtcttccttgattctcatccacaaggtacatccacaatcacttattctctgtacggtgatgatgtaatactttaggactttcgattcatgaggattgtcagctggaagagccatacatcttcactcagtagctttactcaatcttgttcatgttgcatacttgcttgcatatggttcgtctaaatttgtattgatttgtatggtggtcaggttttgatatgccggttgggatcagatataatgctttcgttgatatattctgagatactgaagatgctacggttatacggcttactggaattcagtttggatattttctatctacgtgatctcaacagtctgcttaggggcaacacaagagctaggtgggcgatggaacacatactatgaattcacttctgtctgaggtgtgttttgtcaatcttcagtacccatgttccattttgaaaggtcggtgtgttgtggtctgctacatggctgtacgcctgtacatatctcaggcaagatgatttttgcacttgtactggcatttagcacgccaaccataggcaatctcaaaactactctacaccagggaatttccatcttgtagctagcttgctagagggcaatcttttcctcaagctcctatctaccagcaaaaagattgctagcatttatgcttcagatttctgaacaagacttgaattggattgctgcttgaaaatttccaactgcaaatttctgttaatttccataactacagggttgaatttccatcaattacttgaatccaggatttaaagacgcgcatagctcagcaagcagtggattatactaaggtcaagtaggtcaacaaatttgaattggtgtagggcttgaagaagaaaaaaatagtattactctctattggaacttgaattattttttctaataagtttcttgtcagtgaaaagaatttgtggtcagttactaattaagaactgataactgatgggtgattgggtgttcattctatactgcatagctttttttaaaaaaaatgaagagaatatatttttgtagttgaagcagtcaatttctacaacaacagattactaggactttaaccttctctatcagtgtttttatgctggtatggactggtaatatcaagaagactgaatgcataaccagcagttttacatatttttcaatggcaacacaaagtaccatttatgtttatcacaaacacttgtcttcactgagaagtgccatttatggagtttgtttgcagtttgttcaatagattcacaacatttcaaatatggagttatttttcggaacattcaaagaagtacagctggctcaatttttgccgcatgctgtgagctcaaaatgtaagaggtcgcctggaacttgtgcttatttagtatcaaaatttcacctgccgaatatgtcatctcaatatgttctcctaaaattattgcttgagtatagtggtgttccttttgtgaactcactaagcatattttttttcaagctaagaatatacagatgaagcatggaaggagggatgcttttacattctggtttgttttgaagccttaaagtagtcagccaatgatcagacacctttcatttgagggccggagggaagtttgaggaaaaggctagatttagttatgattttgcatgcttcagtatgatatgattaacctgattcttgatagcttgtattttgaaaccaagtgttatgttaaatttacatcaaatattggtcatttataaaagcaggttgtctgaaaaaatgtaagtatgttggctttatgtatgcaggttgtctcaatttgacctccctttatagcttctgcctgattgtgacaccttttttagctgtacaagtagtgggaaacacaaagcaacaatgaatatgggcgaatgggcaagctgatgagcagactgtggtattgtttgcttgctgctgcgtagcactcacagactaagcatctggtggcctagggtactatgcagtggtgaggagtgagccatagccacttatctgatcaacgagcacctgaacagactgtaggttaaggtgatgtcctccttttctagatcctcaaataataaatattttagtgccaaatttgagtcatgtttttttttactgaaatctatattttttttatgaagttgccatgtatgatcatttttttttgtgatggatatagtgcgatgtttgattgctgatttgctccatgcataaagagcttctaatttaaaatagtttcacaaaagaatgatcaggtattaactaccaattgccatttttttccctatcttacttgagtgcaaaaatcagtttttatttgctcttttttcatggcaatgcaagaaggaatatgagatgtgcattatttgttaatacagattctatttggatgtgaaatatctttatctccttggaaattttgctctcttattctgccattaacttgttaagattcagaatattatggtcttcttaaatcttgatttgtcggtggccttgaacatcgtagatgagcacggctatcgctatcaagcaccatcatcttaaaaaatagtattaatctcacttcggtatacttcagtaccaagttctccatatatattgataaaaaaaactaagatgaaatttctcttaaataaaacattgattatgagcattagggagatgccaactgattggtgcaaactttttgtgtggagatggtgcctgcaataaagatgaggctcacaagctaaattgagcaccttcctttaggatatcgtggtacagaatatatgtatcacttttttttttgctacagaaggtggagcagtttttatgttcttagtttttgtttatatgtatttataacaattattcttttctagatcaattatttgtgtagatcaattatttacacctcttggaaaggaaccaccaaatacagcatatgggattttttttattgcctcatgattttttgtttatctatgccaacatttaccggcacaattgcctgcttctccatgtgctcccgtggtagattgggtatccacatcgagaataggtaattcagaaaacataagacaaaattttacttcaatttaattatactatgttatttattaattatactatgttatgtttattcttcttctttcaatcggtttctgaccagcgaagttcttatttacgggaaattgtcaagtaatctctattgtgcgtgttcctgatcgaagcatgtagcggtgcatatgtattcaattgtagtactctcaaacaaaaatattgagcatttgatgtacatcagaattgta

SEQ ID NO: 32233 - DNA, 2033 bp, Oryza sativa
  unsure (1)..(2033): unsure at all n locations
ccccattatggtttttaaaataataaaatctaggtgatactccgcgttttgctgcgggattcatggatgagtatatgttaaatattgtcaaaatgatgaaagttgaaatgttaagaaaataatgtgaggaagatgatttgacatatacttgttgatctctataatataatattatagatgatgtgtcatacttgtatgagattttaatagggcttagaaatagntaaatttntgcttaagntggagtgaagatgtggcatgcttgcatggaattttaaatgatctaaaatagtaattgctagtgggtgatgatgtggcatacttgcatgttgagttttagcttctaataattgttagtgagtaccaactatataaaagtatagatgttctcccttgcagtttggcaagtttaatttaagcaatttgcccgatttaattcatattgatttttacgtgcattgtacgtgcacgataactagtaataataataaaagttatagttgacaatctggaatttattagctccaaatttcagaattattagatcataacataagtattgttgagactctagatttcgtacgaaattatcaaatcatgggaatactaaatttgagatttcaaaccgagtaccattcgcttctgcctagtatattagtaagaaatatttaaatcttccagcttgtatgatagacaaacaaatacacacgggcttacattgttcgtgcttagtttttttagaggagatgtatcgatcagtaagcactaagagcacccgcaatggtaaagtaagttgctctctataacatatgtacatctcagcaatagactatattaatagtaaacctccttaatagtatgtctacatgggtatcgatctattgcctcgttttatctatagactatctccaagttagtagatagttttgctctctctctcttcatttaatatcttccaagtaggaagatatgctgacatgaatctcttgtagagagcatatagataactattgtggatgccctaagcacactcataattatacaagttaaataaagataagaacgcgccatccatcgatttgtggaggaagcacgttgcaccaagctcacacaccattattgcaatatataggtggtgtttggttggagggattaaagtggggctaaactttagtccctctcacaaaaatataagtccctatgtagcccctctctcccaaacacccccatagcatttcctttctttcttaattagctcttgttaccacctggacctacccttctcccaccagaagctgagcgcttcttcttcttactcattgtcttgtttgttttgtgttcgtcgtcattattatcgtcgtcatcgtcgtcgttgtcatcaccatcgatgtcatggttagagtcagaatcatgatccgaatctgagccgcgatcaaagtccgaatcatgatctgagtccgagtcatgatcatgatcagagtctgaatcgtggtccgaatcggagtcatcaacagagtcccaatcactgccatcatcgtcatcattatctaatttcttgatctctatacctcggtgatgctcagcatcttggcctgatcctctaccgacgtcaagctcgccgtctcgccgatcaccggcttggacggccttgctggctgccttctcctcgccttcgtcttgcttcaccggcgaacttctcttttcctccatggtggcgccatggcttacctggctaattggctgctgcacggttgtcaacgggtcatctgaggcagcggatgaaatgacggcgaggaggaagaagacggctaggcaaatggcggcgcgcgccatgtgcacggtgaggtcgccggcgagctttctcgctccgatgaccgagcgggctatgtgtaatgagctgtgagaacaatgttgggagagcaaggtatttatagtgggtggcctggcctatatctgtttacataatgcaatatatttctttactagaagggggacgcacacacattgatcaatactccctccgtttcaaaatg

SEQ ID NO: 32234 - DNA, 13770 bp, Oryza sativa
  unsure (1)..(13770): unsure at all n locations
cacacttatacaggttgcgaatgcatcccctctcacatgtttaaaaagacggaaaccaacggtacatccataatctcgctaaatttcgattgacagttcatttacgtgtacataatattcgtagacaccaggatttgaactctgaaattaatcatgtacccacgactccatcaccactccaccggtgcttccccataatgcaatgtaatttaatcgagcctctccatgtccaagacgtgtatgctgccatcttcatcagtgatctaatatcattgtagcatattattattattatttaccttcttctcccaggcgtgctatttcaaaaattatcttaattcgaggtgtgtgactttctctaatggaagctgagtcgatctgccggtacatatattatgtcgtgcttattttttttgcttaggtagtgcctcagtgcgctgagccaacgaactgcaacaaacgttgttgcaaagtgtgtggcatatgcctccattttgcactagcgcggcaagtaaacttttgtcaaactaaatgcatgcattactggattctgaaattgtttatgctgttcatcacgagatgttgtttcggtgattgttcacgactaacaacaaagatcaatcaacaagttgctaataactgtgtgatactgttgacgaaaaaaaatcgaacacaccgtcctgggagatctgcttagctcctgtgcagatccaaatattgacgagattcgagcgtaccagtcagtttgatcctgcaactgacaagatatgcaaatagtagatcgaaatagccgatcggctgacaagccgatggagtagttccagccgatgccgataatagccgatgccgataccagccgatagcgatagggtttaagcaatcggctatatgtccaatgtagataatgatataaaggcaattggctgacgacgatgtaataaaataacaatataatccagtataaaccaatcagcaaataatgatatgataaataagcatcgattcgaaggtcaaaacacacatcggctggaggtctgatgtcatgaaatccacaagattagattaaacactgaagcctttgttgtcatcggctaaatccaacttatatgtatatgcaatccttatgagccgatgcaacgtccagataactcaccagctgaaaccccgatgaaacccttattggcaatcaagaagcaggctagagattatggttctaagcacgacttagtagatcaaacttaactgatgcagcactaagtatgaaaagaaacataatatctagacaatcaagtcgttgactgagttttcagggtggtagatgtctaagctaatctaatctagcaacgcgatttagccgatgcctgcagaaaccctaaaacgagaagcagccgatagagctaaattgatatgctaagactagattaacagagatatatgataaataggtagacaagtatatcatccaaaccagatcaatccaagaggtcgaatgtactgatgcagccttgaacatgccgacgtaaacgatataattgcctgggccggcggaacattggacttatcccttcgccggagatcgaagacgatgcagccccgcgtcgggtgccaagttccgccggaacgtaaaaacaaaagtagaaataaaaagggtggcgatgcgccgaattgtattgatcgtggagatagattacatagaccccgggtgtacatatttatacccatgggttgatacaagtccttgtcggacaagaaagaaaccttcctaaagataaaaggaaaagataaagtccttataggacactaaacacactttcctaaagataaaaggaaactaacatactattcctaattaatagatacaactgccttcttcggactcgatccttacgtggcaatcatcatgaagcacgtcaactcaatccgacaatgattccaatatcatcttgccggaatcagctacatcggcttgtcttgtccgattcggtaactgccgatgcacactgtagccgatgcggttccgaagccgattcataccctgtttccgttatcgatttcctcccaaatccgcttcggccttaactccaaatccgatgcatgatttatcaaatttcatcattaacagatactggacatttgtaattgcatttggcatgattatgggagcagagggggggtacccatctgatgtactacctccgtttccaaattttttatgttggttagttcaatttgagctaaccaacgtgaaaactaaaaaaggagggaatatttgagatggagattatatatagcaggcactacataaatgtactttgaatggctctgagaccagagcagaggtgtcaagctgtgttaccattgtcggacggtaaacagtaacggctgatgacacttgtgatttatgaaggtaattatgactaaaccaagaaccaagttatactttgcacatttgagacaaggaccatgcattttctagaataactactaatattaaacggttggctagcttaaattataaagagtggagattttcttagcaaaagtacagtagttgagtctggtattggctcttaagcaatacacgccatctaaagattatcccctggcaactgtgagaactaagaaaggctaattctttggtcatcctagttgcctaggactaggagcattggaagcactcactactacgaaatcgatttttccattcagtcaaaaagggtttttccgtgcggaggtcttgcctgtctgcacccaggtgtctacgaaaataaatattttcacgtgtggacggcccaaccgcacgaaaaaatctatattcctgtacggtcgggttaagtggaccgcacgggataattggattttcgcatgcggtcatgttatgtcgcccacaaggaaaaataaaattctagaaaaaaaataaaaattcaaaaaaggaaaccctagaatccagcggcggcggcgcggatccggccggcacgcgtgcgtgcggagccagccgctccgctcccagccgccgttgccttctcgtcgtcatcggtaggggcggcgtggatccggccagcacgcttgcgcgcagggccggcagcgccgctcccggccaacattgcctcccagttgtcatcggtcggggcgatgcggatctggccggtgtgcgcgcggggccggcggcaccactcccggccacctctttgtcgtcatcgtcgctcgaggccaccacttgtaggcgggcctcacgcgaaaatcgattttcgcgtgcgggcctcttaagggtccgcacgtgaaaataggagtctgatttttgcgtatgcacgcaaaaacggtctgtgtgcgaaaatgggagctccttgtccaggaaaattgtttttttagtagtaactacaacgcgacatccttttcattttttttgtccctgatataaatcaagttttaagggcagttagagatgatgccttgtggtgtgcagtgtgctgtatgcatgggctaaacacaccttctggagttagggcctgtttggttgctaccctgaggaaaacttgcttgacctgagacaagcctgagttattttaccctctgtttggttgccaccctcagccccttttccacttgcctggcctgatgaaacctggcatgtcattagcctgagtcaggcgacccattttggtcacctgagctcgaggcgtagcatcactcgaggattaccagcctaatctcttgcgaagtcccatgctcagctagcgctgcacgaagccaaagccaccgccatcggtatcgttgccatcggccgctatcgcgggaagcccctctcctggccaccgtcgcgcgaagcccccgccgtcgaccgccgtcgcgagaagctcttgtcctggccaccgtcgcgcaaagccccccgccgccagctgcagtcgcgcgaagcccccgccgtcagccgccgtcgcgggaagcccctgtcctggctgccgtcgcgcaaagcccctgccgccggccgccgtcgcgcgaagcccccgcctccggccgtcgcccgtcgtgcggagccatcgccaggtccaacggaagctggcgtgcggtatagtgcgatctctcaccttctcgcatgaagcagcccctgtcatctatctagctggatctaccgtcttaccaagatggctgcctccatttgtttcgttaattgatttgatttgcatgcgactgggaattgaaagtttaatttgcgagttattggatttgggtgttagataatgtggtttctgttaagtcttctgttgagatagatagataaggatagaagatatagataagatagtttttctgtttctgttcttgttgtaactacacacgctattatcttgagataatgcgtgattctctcacttgtaaacaccatgccaggggtgattcctgcgcctatattaacacgtacatgaacctggaggaagggtatcacttcaactcacatggtatcagagccttctccctccacccgaatccttcctccaccaatctttagattagatggcatcatcctcttccaccgttgcatctgtccttaatggacaggctgtttctgagaaactcacgaagagcaatttcgttctctagaaggcgcagatccttgcggctttgtgcggcgcgcagatggcaggctccctagatgggagcacgaaagcgccagatgcaaccatcaccatcaccaaggatgatggaaagaccaccaagaaggtggcaaatcctgctctcccgctgtggagggctcaggagcagcaagttctgagctacttgctatcgtctctgtcccgtgaggtgctgactcaagttgctaccttcacaaaggcgacggaggtgtgggaggcaattgaaaacctctttgcgtcgcagtcccgcgctaggatcatcaacatccgaatggcgctctcgtccaccaagaagggaacacgcactattgcggaatatgttggtaagatgaaatcgttagcagatgacatgtcctctgcaaggaagcctcttgatgatgaggagcttgtgtcttacatcttcgccggccttgacttcgactacaactcggtggtgtcttccatcgctggccgagccgactccatcaccatgagcgaggcctatgcactgctagttggctttgaaagtcggctagaacttcttcaaggctcttcatctgccttggccaattctgtgtcgcgaggagggcgcggcggtggccggggtcaaggcggaaaccctggacgtggcggctttggacgtggacgcggcgacggcaagccaaggccgacatgccagctgtgcggcaagatcggccacaccgtcatcaagtgctggaaatgcttcgatcactccttcactggagaagagaagaacgccaacgttgctgcatcaagctcctacagcgttgacaccaactggtacgtcgacagcagcgccaccgaccacatcaccggcgagatggaaaagctggcggtgaaggacaagtacaccagcaatgagcaagtccacacggctagtggaacaggtatggacatcaattatgttggtcattctactattcgcaccccaaaacgtgacctatttctcaaaaatatccttcatgtgccaagtgcatataaaagtctcatatccgctcattgctttactagagataatagagctttcatagagcttcacccatatttcttcttggttaaggatcaggtcacgaggacgccgcttcttcgaggcaagtgtgagtgcggcctctaccctctgccaactgacaagttgtccagcgcatcacataagcaggcctatggtgttgtcaaaccatcgttgtcccggtggcatagtcgtttagggcatccatctcttcctattgttgatcgagtcattagcaagaataatctaccggtaactagggattctagtcaggagtctgtgtgtgatgcttgccagagaggcaagaatcatcaattaccctattccaagtcttttagtgtgtcctccaaacctttgcaacttattttttccgatgtatggggccctgcaccaagttcagttggcaataaagtttattatgttagcttcctcgatgactttagtaagtttacatggatttacttactcaagcacaaatctgaagtttttgagcgatttcgcgatttccagaaccttgttgaacacctcctcaacaggaaaattaaggccatgcaaaccgattggggaggggaataccagcacttaaataccttcttccagcgcattggcattgagcaccatgtctcctgcccctatgcgcatcaacaaaacggttctgccgagcgcaaacaccgccatattgtttgaagttggcctttccctgctagcccatgcgtccatgcctctcaagttttgggatgaagctttcaccactgctgtttatctcattaatagaaccccgttaaaagtaatcaatctccctccggattactctcttgttcgtacttttggctgcgcctgctggcctaacctccggccgtacaatgctcgcaagctagctttctgctcccaacagtgtgtcttcctaggctatagtactctccacaaaggttttaaatgcctagacatatctgccgggcgagtttatatctcaagggatgttgtgtttgatgagtcatcttttccctttgctaaactccactccaatgcgggcgcctgtctccgttcagaagttctcttgctgccaccacatttgcttccaccatcatcattgcttgatccagggggcaatatagtacatgatcaacctatgattgatgatcctaaccacactaatcacactaatcaggatactgagcatgctgcaggacaaaatactgaaaacaacggagaaaacagcgatgaaaatgatgcaggaacggcggcagatgatcatgttttcgtgcaatcggacgaccacggctccatgcaaggttccggcggacaccacaccggtgctgatcccgacgcaagcatgcaggcgccgtcaggtggtgctgagtccgaagacgagcaagacacaggctcagtgggtgcgtcgcccatcgtgcagcctgctgtgcacagtcccgtgcatgcacaagattcctctgcacaccagtccggatcatctgtgctgagcaacgaggaaatcagctccacaacgcaagctcctgctcctggtcgagtcacaagatcaagacacgggacccgcaagccgaagaaatacgccgatgggactataaggtatgcatgtctgacagatactagggaaccagatagtttgcaagatgcactacgtaataaaaattggaagttggcaatggataaagagtatgaggcacttgtaaataataagacttggcatctagttccacctaaaagagggacaaatattatagattgtaagtgggtgtataaaattaagaggaaagcggatggaactatagacagatataaggctaggctagtttaagcagcgatatggaattaactatgaggatacctttagtcctgtagtaaaggctgcaactattagacttgttttgtctctagctgtcacaaggatggagtcttcgccaacttgatgttcagaatgcttttctacatggctatcttgaagaagatgtgtatatgagacagccaccagggtatgaagaggcaggactaccacatcatctctgtaagttagacaaagctttatatggtctcaaacaggctccaagagcttggtactctctcttaagtaagaaattgcaagaacttggttttacaccttccaaggcagatacctctcttttcttctttaataagaaaggagtcacaatattcttacttgtgtatgttgatgacattattgttgcaagctctagcacctcagcagtcacaacattgttaaaaggtcttgaaaaagagtttgctctcaaagatcttggtgatctacactattttcttggaattgaagttaagaaactaggaggtggtctgttgttgagtcaggaaaggtatgctggtgatatccttaagtgagttggtatgaggaattgcaaactgttagcaagtactcctatgtccatagctgaaaaactgttagcaagtgaaggtgtgaccttaggagtacatgatgcaacacaatatcgtagtattgttggtgctttacagtatttaactctcacaagaccagatatatctttctctgttaacaaagtctatcagtttcttcagaatcccactgatatacactgggctgcagtgaagagaatactaaggtatgttcaaggaacattaggacttggacttaggattgacaggtctttctctagcattgtaagtgctttctctgatgctgattgggctgggtgtctagatgacagaagatctattggaggctttgctgtgtttctaggtactaatcttgtgtcatggagtgctagaaagcaggctacagtgtctagatctagtactgaggcggaatataaggctttggcaaatgcaatagctgaaataatgtgggtgcgcaagttgttggaagaacttggaattccacatcccagatcatctcaattatggtgtgacaatattggcacaacctatttgtctgttaaccctgtgttttatgctagaacaatgcatatagaagtggattatcattttgttcgagagcaagtagcacagaagcaactggagattcgatttgtgtcgtcaaaggatcaagtggcagatggtttcactaagcctcttcctgttcggcaactacagttgttttgtaacaatctcaatttgggaaacttgagattgagggggagtgttagataatgtggtttctgttaagtcttctgttgagatagatagataaggatagaagatatagataagatagtttttctgtttctgttcttgttgtaactacacgcgctattatcttgagataatgcgtgattctctcacttgtaaacaccacgccaggggtgattcctgcgcctatattaacacgtatgcgaacatggaggaagggtatcgcttcaactcacattggggatctctttcttagcatcctatttctttttcacttctttgtgtgtatgctattaatttctcagagctaagatgcgcatagagtttggtcgatttttgtttcttcccatgaacacataattaacataaataatctaagcccaatcactttttctttctctcaggcaagtgtgccaaaccaaacaagcaaaatctcaggttgcctgaccaggcaaagcacatgcacttctccgatgtttctcaggcacctaaatttctcaagcacagcttctagggcaccaactaaataggcccttagtcactgggcttcttggtagccctatctcttgtatctcttgtttgttttggtatgttttttattttcatttttttcatttggatttttaccgtctttaatgaaatgatgcccatttttactgtgtattcaaggaaaaaaataaattaatgatctaacctttaatccaccaaaatattttgtttatcattccttcctttctgcagcctttagcagtacacgtcatctagagaaattcgctactacatacccttcattcgttttcttagccttatataatacttcctctatttcatattataagactttctagcattgcccacattcatatatatgttaatgatatctatatgaatatggcaatgctagaaagtcttataatatgaaacggagagagtagcaattttctcttttatcctatgctaacaatcgttgttgaacttaacattgatgtttctctcgcctcatcttttctctcctctctcgttcatattggcatattgatctagttgacagttctatggacaactattaattgtcagtgtacatgtcatgaggcctatataataacctagcatattcaacactgaagttctactcttttactgtgtttgatagagttatacacttctacttctaccacaacagctaccagctcttgtattttagcgattctttttttcttttggcctgatatgcgctgctgtgtgacattggatgattggaacgtaggcatcttgtgatgttaactgtgctctgtacagcaacaaaaacaaggatcactgtattcaagcttgatgtgtagcatagcaaatgaagacaaccgaaaaaaaaatgtcagctttcggattttaggtgtccgaagaaaacgagtcaggggctcacagccatatatcctctgcaaattgaaatggaggatattgtattggaaaacttttgttccgttttttacttctagctcaaccaaaactataactcaattaactaatcatatattccccccatttcacaatgtaagtcattctatcatttaccacatttatattggtgttaatgaatctagacatatatacgtgggaaatactagaatgacttacattgtgaaatagaggaagtaaaacctaatgtttttccctacaacatttgccctttttctgttttacaatcaacagcaaatgcaggtttcttagtccgtccgatctgccacgtgacaggatccagtccctctatctccctctaccagttctgccctgccgtgtggtttcttctccatggactcctccttcctttgccctctcccgatgggaaatttaactatttgccactcttgtgacatggcaattaacgatttgccacaccctgtcaatgacatgtgggccctcatgtgtctatgacatgtgggcctagtggcaaatcattaagcaacatccgtaagagtggcaaatagttaaaagcccctctcccgatccccttttgtgcagccgctgctcctcttcggttgctccacggagccgtcgccaactgaggggatgatggccggacggcgaactcaccgaggcacggctgttggagcgaactaatccggagggggtcaggactattttgcgccgccgcggaggcggcggcgctagaggcaggtcgagcggaggcgacagcgtcgggcgacggggtggtgcaaacggtgggggccgcccggctcgagcgacagtggcgccgaaggcggtttgagcggaggcgacgacgccgggtgacgaggcagcccaaacggcggcggcgccagaggtgggtcaaacggaggcgacggcgctgggcgccgcggaggcccgagtggagggcggcgacgacaatgcgtggcgggccttcctccgcgctgccccccctcgctggctgccggctcccgaagctccgccttcaccgctctgttcctccccagctccgccgctctccctccccatctgcagctcgacggcaccggcggcggcttgacgacggccgctccgtgcccctcctcgccagatccggccttaaggtcgccggatctggccttgggaggcggtggcggcggtggcggcttgaaggcggcagcagcagatcgaaggctgcggcagcggctcgactgcgggagcagcagctcgaaggcggcggcggcggctcgactgcaggaacggctcgacgacagccagcccgcgccccctctacagtgcagtagaggtcccatcgatcggtaacatcgattcactgattcttccacatctctcccttgcgccgcttcgtcgcccacattcactgattcttggaagcacaaacgaaaggatcacatatgtacgttactaccttttcctgcaaatacatatacaccacttggatatacatacccattctgccttgctttacatgttaattaacttgattgagcaaatgtttgttgcattgatcggcctgtatctcaaagtacaatgagtaagtgactgaaggtaattcattagccttttatgtctatatatgatcatagaatgtatgcagggtgcatcagacaagcaaaattatatggcaagtgatggcacatttcttagggaaggatttatgagtttaatgtcaaaatcctctctatcagttgcttatgcagctaaaaatagggaaacaacctatttatattcataggatactctatgagttcaacatcaaagtttcttataggatactctatgagttcaacatcaaaattatttatattgacatgttaatttattatattctaaatccatatgttattgagatgtgttctccaattgatctgaatgcagagtatcctatcataatattaacaatgttggaccatacttttggtgggtgctgcatgcagttattattatcaaagccatgaaaggtattttacattgttacatcttcttcacctttataggtttctaatagtgttcttgcttctttgagtggcttcgtttgctaattcctatgcccttcatatttcaggttcaaggcttccagctggttggcaattgctcttcagggtttctctacctgttaactgttattgcctgatattatttcagttttttgggtagttccttgggatgtcttatttgttgtttagtcgttatattcctatgcatgatcattatttagttgttttgataaatgaccttccctactctattttttatcatataaattagtattcggttaaactatagcatatatttttttgcatgaggcaatatttgtatttagcagcatctcactgactacattcatccattttcgttttcaggcatgggcacatggcagataccacaatgtgaggcaaacattggaccttagctaacataaatgaatatgtgatgccactttcactgatgcttctatgaccactagtccgggtaatttcaactttctcatgctgttatatgctgatgctatattacttagcatgctttaggaaattacagactatttcattctgttcaaattacatgttgttatttgtaatagtgtgggatatgcatgctcttcattactgtatatggcatgctcttcatcaaggttaaaccgtggatctattttccttttattattggtggctataaaatagattgatgctaattaatggcaagtttgcgaaaatactgaactctcatatctccaggattggctataaaatcgtcagttctgggtcatggaacagtaaaccttaatttctatttgtttttgctaatggccaatctgtatagattaattgtaaaacatacacaatatgagttgccactgtggttagggttgcgatctgcggttagggtttgggtatggaatagagcaagtgtgatggccaatgtgcatgacagagtcagctccactaaccaatgtctctagatatggttctactctgtgatctcccccatcatctccgtcatggattaggtctaagcttgatttaggtgtgtggctgtccagccatctgcgctcctccaatggcatgctgctggatatgcagccatctccagcttggttattctctgctgaaaaaaaattaatccctcctatcacatctaacatttgcttcgacccatgacaatgcttggtttggtatgccttttttcaccatcctttactctacaatccatgatttgcattcattgtttacaaggtaaatttattgaagagtggtctgttcttttgcgctgcagcattgtattgctcagaagctattttccagtcatcaaaatctcatttggataagcagctgtgttctgctatatattttttttgtccactgactctgtgaacaaccccgccaattatactaaaaccaaacaaaggtacacagctttgttattatatcatttcgttaagtacttgcagatttcggaattattcagnnnnnnnnnnnnnnnnnnnnnnnnnnnnnnnnnnnnnnnnnnnnnnnnnnnnnnnnnnnnnnnnnnnnnnnnnnn

SEQ ID NO: 32235 - DNA, 715 bp, Oryza sativa
ctctttcaacagagacatcttccttgccactctactgttctttgatacttctttcaccaaggaaatcactcccttcatttgctatcttttctatcattcttccagcggatccaaccgaggagtccattttttaactgaaactacaacagcatgaataattcacacattttttcagtcattttttggccccacacataacaagcagaacacaaaccattatagcttgaaaaaaatagacatgctgatacctacactagagacaagctgatacctaaactagagaaaaacactgatacccaaaactagagaagatgatacctgtctgggcagaagaaggagcactcctgctcggagtgaggcgtgccgggttctggctggggctgctcggagtagttgcggcgtcgcggagcgtcgccggcgaggtatcgcacgcctccgcgcgcgataccgagccaggttctggcttgggggagtccctacttggagtagttgcaggcggtgccggcgaggtatcgaggattcggggcgaaggaaggagcgctcttgctcagagtattgcggcgtcgcggagcgtcgccggcgaggtatcgagcgcgataccgagctgggttctggctggggtcgctcagagtagttgcggcggagctccgcgccgccggcgaggtatcgcacgcagctgggttctggttggggttgctatgagtagttgcatatc

SEQ ID NO: 32236 - DNA, 5019 bp, Oryza sativa
aaatatgagctgacaagcatgcaaattagagataagctgacctcatctagttgcttttttaagtcctccaactgttcattcagcaactttgcttcgtcctcagagtttagcgccctgagtctcattctttcaagctatcatcagacattttcaaacagataagccaatatctagtaataaatcattatgcacaagagttcaacaatacagacctccgcatttagtttagaaatggataattttgtgtcgtcttgcaagtatgaaagcttcttcttaagggctttcttctccctttctgaattttcagataaacgctgcaaattcccctccaactccttgactgactcctttgcggatgctgacgatgattcagcagcaattcgagaatcaatctcttttttcagctgcgtctgcagcaccaagatcttcattagtcatgccaatagatgagcagatatacgattaaaaaaaggagctgaatgtttgcctcatcacttatgtgtcaagccaatgtcccagtgggtgtgtacgtccagacccactttattagggagttaatgaggccttttgcaaatattcagtggtgcagaaggaactaaccaaaagaaatggggggtgtacattaaaggcaagtcaccagctatgtgacgggatggaggtcatgtgccaaaggagatttgcatacctcaagttcccctatcttcttgatttgatcacagtagcgttcctgaaagtcacccacctcctttaataatcgctcttgcattgcactttcccgaccttttgttgctgccaattcttgctcgacataattcagtttgtcctggcatgttgccctctcatcctctgaagcagtaaaaaaatgtttattgattacctttaagtatgtgcatgcaattgcttcgaatgtaataagctaacacctatttctaacagtagattgcttagagcagtgaatctgattcaatactacgtgtccttcctactttctgcgcccggcaaatcaaactaaacacaactaggaagaaggtaggcccaaactccgtgcatgcttcaagtgatacataaatgtatcttgaccaacggatatagcaaatcgaacttaagaaggtacacatgcgaaaaaagaacagcataccactcttggataatcgttcctccatatcatcaagtgtggctcgatactcctgaacttgcttctctgcagtgtccaatgccaccataaattctgatttcacctacgagaattacatacaagaaaaaagaacacaccagtatgtatatatcaatatggtacactggcatgtaataacgcttactgcaacagccacacacaattattcgctccacgccatctatttccttacaaattgatcaatcaatcgataattgtctacatttttgatgtggcatgcgtggaatcaactgagctaagcatatcaaatatgagactacctggagctaaatgggagctcgaggctggagtaacaccgaaattactagacacgctatgcttccaccgaccattgggctaagacaacaatagcagtagaagataggggcgaagcgatctcaccatctgacggcagtggtacgtgcagaccatgtcatccatgggctccccggggacgccagcgggtacgagggcggtgggccggtcgtagagcacgaggcggcggtcggaaacggggctccgggtggtggcggtggcggcggcggcgtcgacgtcggagtccgcccgccgcttccgctgcggtggagtccggagaatcatctcgctggcttcgccgggggccgcggggggggggggggctcgggggttctagaaggttcctctagggttctaccgcagggagattggggaaggtgagaggggaaggctggaatgggtaacgacgagggatttgatttgaatccgcgcggatgcctgtagaaccagtggggaaagccggaaagggtgaaaggcgtccgttccgatctccgttaccccattcccacttttaccccaattcgtcggccctctgtttatagggttaattggatcatgccattacaaatatggcaaataaaaaaatgtcactcctatttatgaaatcgagttaatgccattgtaattttctaaaattagaaccataccactccgtcactatttccgtcctctctgtcataatttttgccgtctctgtcttcacctttcatcttggtctcaacggcggttgggcaacatggcgccggaggagagcagcacggcggcggatggggaaggagcggcgagaggcgtcgagatggggaaggagcggcgagaggacgagctcttctgccagaggagtgcagcacggcgacggatggggaaggagcgcccgcacccgcctccaagaccgtcctcggcggcgacagcgcgtgcgtccgcgccgtcgttggcggcggccatgcccgctccccgcgaccgtcctcgccggccgtggccgcagccgcgccagctcccgtcctcgccggcgacggccgcgcccgctccccaacctctgcgacctccccgcgaccgtcctcggcggcggacgcccgctcccctctggcgtatcacctaccaataccatagcagcttctggctcaccatggagcatgtcccttcttgctcattcttcaagatagaattgatggtcccatgaacgcgcggtgcaagttcaccttgctcgaccatacggggagtccagtgctgtcccatgcccaagacagcccagtcctcgactggtccgtcgacaggatttggtgctgctcggatctcgtcatggaggaggagctggatcggcggcgaccggagcttctcggggacgacgactgcctcgccgtccggcctgctccccgctcccgtcctcgccggcggcgcccgcgacctccgcgacctcccgtgaccgtactcgccagcggcaaccgcggccgcacctgctccccgcgctcgcgacgtcctcgccggcaaccgcctcgtcctcggaggatgacgccttgccctcgccgtgccatcgtgagagaggaggatgacgacgtgagagagaacgacggaaatagtaacgggagtggcatggttctaattttaaaaattttcagtggtacctggccgataacataaatagtagttgcatttttctgatttgtcacatttacagtggcattgatccaattaacccctgtttataccgtcgaaacgttcgagcgagtgcaaacttgtgacatgtgaacaaaaatacgaaactcatgtggtggtgtttgaatctcctgaagatgaaaataaatattaagtgtttcacgtaaaatgaggtggcactaacgtgtgattaattaagttttgattattagaaacttgaaaaataatttaatcttatattttagagcagcttttatatagaaagtttttacacgaaacacaccgtttattagtttgaaaaacgtgccacgagtattcaaaagtttatccaacttttgttggactaacgaacggggctgattagattaagatactcttcagttaaatgcacgatgtctttatcaccgacatgtgagcccatagatcattagagtaagaaagtcacgtgacttcaactgtagaggattctaatctgatttggttcacctcgaatttgaagtcgaagtcttaatacgtcaagtcaaactatacttggttgcattatatctcctttttagagagagatttttaactcacgcaaaacgagaaaacttattagcacataattaattaagtattaataattataaacttgaaaaatatatttatttgattttttaaaataacttttatatagatttttttttaaataacatatcatttaacagtttgaaaagcatactaacggaaaacgataaaattaaagtttgaagttgagaaaaataactaaccttaatctagcgagctgctcgaaattcttaaatagtgcttgatcatttaattacatctagactattttgtatataatgaattctttattagttaatatctattatttatgtttatgcatatgataaaattatagatttgaaattatgatacccctctcccttgatgtttctctaggtgaaaaccacatcttcttagatggatgatggtgacatccttgatgttgtgaccttcgtgggagcattgtttttagagtctcgttttggtggtgttgtcgtaagcctgaccgcgttcggtcacacttagcaggggttatttcggtgctagattccaccttcggttggttgtgtttgtgtggttagcacgtggctatctggtcatgtaccttggtgcacttccgacctcgatagtttttatcgtgttttgtttgtaactttatttattattaatatactcggatggcctcattcggtctttctcggcaaaaaaagaataataatagatatattaataaacctaacaagccaacttgcgagtcgagttgaatcaggcttttagctcgctaaggttttccgactcggttcatgagcttgcttttagcataacaaattgagctgcctcagtatccacacctatcataatggctctgaagtttctaacagggtttataaaaccacgcggataaaaccacgcggttatctctagattatcatggtagccatcttaacttttaaaatctctcaacattttttaggacccaagctgcctcacttgtgttatgagttgtgccaccgtcttctctcccgtataatctcctctcctgtagcaatcatggaaactagtaggaacaatatgaattgattcaagcaagatgaatttctagggatagctatgaattatatatgcttgcaaattaattcgattttatagcggtagaaaccataacaacattgtccgcgctaacagtaggacttaagagcttcatgtgataatggggcagaagttaactctcctagctactagtgtgctaggtgacttaataaggtattatgactttttagttgcctaaaaaatattaataaaatgagctgcaggaccaaatctaccagtaa

SEQ ID NO: 32237 - DNA, 2398 bp, Oryza sativa
agtaccagtcatgatccatatagtagccatgtgctgtaaggtatcaggtctggtaccttggttttttctagggtaccagacctgatacctaggttgtttctaagcaccagaccctggtacttgtattttgtgaggctggtacccctatcctgtgaggaatcatgtctggttcctaggttaagacatggtacctgggtttttttttgaggtaccaggtctggtaccttggttgtttctagacaccagaccctggtacctgtattgtattgtgtgaggctggtacccctatcctgtgaggaaccatgtctggttcctaggtttagacctggtacctgggttttatgtgaggtaccggtaccttggttgttgctaggcaccagaccctggtacctgtatttgtgaggttggtacccctatcctgtgaggtgccatgtttggttcctaggtttagacctgatacctgggttttcattgaggtacaaggtctggtacctagtttagacaaggtggtggtagcaggtaccgtgtgcctcacagtaaccctaggttcaggtgtggtacctggtactaggtaccaaatcccattgtgtgaggtaccaaggtaccatatcatggttccttcactggaaggtaccaatcaaagcatcggatgattgtaggtaccaaccccattttgtgaggttccaaggccttgatacctttcaaatacagtgatgatatattttaggtaccaacccccatatacatattgacattttgatttcatggtttatattcacggtatatatttttttagacaaatatcacacaacaagcataaaaaaagttgagtgttgcaaatgaaagataagtttggatgtatttcacatggtgacactgcagtagccattacatggtgacatttgttcacatattcacatgatttaaaacaaaaaaaatggtggtaccaccagatagttggtctggttgttgggggggggggaggtccgtacatggttcaaaagcactatggagttgcctttacattttaaaacaaacaccatcactatactttaaatgacgcgatgtggatgtaggttgttgaagcgatggtaaatcaacctatggccggagcacgacaggtaccagtggaaagaaacgaagggagccaaaagaagatgcagcactgccgacgtggaggatggaggaatcggccggagtggagtgcgccgagtggaggagccgattccgatcgaaggaaggatgtgatgggagtggcgccgcagcaccgccggcgtgggggacggagggaggaagaggagcggcggcgcaggctcgccggcgtggggaggcggagggagggaggggagcggctgcgcacgccggcgagcgctgtgaatagaggggaaaaacacagagagaggaagggagctgtgagtagctgcaagctgtaagccgtggcgtttcggacacattaagggcccatttgatttgtaggaaaaatgtaggaattttggaggatttcaatcctatggaaaaaaatcctatgaaggcctttgagacaaaggattgaatcctatccaatcctttaaaattcctatggaatgggtaatcctatgcacattttggaggaaagttagcaagatgtctaacttcttggaacatttcctctgagtctatctctctcatctgattcttgcgtttttcctgtggtccaatcaaacggccattcctgtgtttttcctgtgttttgtaatcctctgttttacaattgtattcctgtcagaatcctgtgtttttcctattactctgttttttcattcatacgattcaaagggaccctaaagctgtcccgtgaccgcccgcaccgccacgggatgccgtgcgatagattttctgttcgcaataaaaggcgaccttccgattctccactccaaaaccccaaccaaacccctctcgctctccccgccccctccgcatcccccgattcccccgccatggcttccggtgccctagcccgcctcctcctcggccgccgcgcggccgccacccctctcctcgcgcgccccttcgccgcgaaggcccgcgcgtcgcgccggccgcaggagccggccttcccgtcggaggacgaggacgacttcgccggcggcgaggtggccgcgcccgcgcccaccgaaggcatcagcaagccgctcgccgaggtcctcagggagctcggtaagagggtccccgaggccctcgtcaagacgcgcgtcgaagatggcttctccctgaagtacatcccatggtgagcccgctcgatcactttcgatggcctatcgaaatcctcccttcctacacaccaacacagggatcggcttatttagggagatttccctgttagtttttaacgcgttgcgcgtatttgcggatttttgat

SEQ ID NO: 32238 - DNA, 1244 bp, Oryza sativa
atgcatataaatatactaatgaaattctattccaaatggtaaggcgaggatcctggagatcactcagcattcctttgttaaatacaaactcatctcaactcgaagcgttgaaatgctaggctttaacatactaacattacatagttctgtttaattaacatatggtagaactgacctatttgggatatatttctttcagatctacagagaagccactggaacttcttctgctgatgatacaggctatggagatcctgtgcagaaggctgaagcaatggcttttcgccgagcttgtacccgtcttggtcttggacttcatctctatcatgaagatatgtcataaatgcttaatgtcaattgtctgcggtattaaactcttgcatgtctcatggtgcacagacccccttttgtgctggatacacttttcttgtgcatgttatgaacgtccagcatatgaagctaggtactttaggtggttgcgtagatcgctaaatgtaagctactaatgcaactactgttgaactattaccttattatgaaccagcctgctgttccaagatatatgtccctttttcgtatcaagaaattcctggttactgctggaattaaattatttcatatgaaattcctgcgattgaaaatatgcatatgctatttattccactgattcttatgggaatcggacttctattctttctgatctataacattcttttactatatatttcatttgcatgctcgctggaaggaaacatattgcatgttagcggttgttcccgtattaatggttttgcagggtgatcaggcaagtttttttgtacagttatgtttactatttgaatttcaatccaatagaattttttgatgacgcaactgttcttcaatatttatagcaccttcttttctcttgttaggtcaaatgatttatatgtacttacttgagtttgttctaagggatgctgagtcattctgacttccaaaatttccacgactgatgtagctaactagctatactaggcaataacttctgacaaaataacagtctaaactaaccttcatcagtattttgtatattacaaacaatctggttattgccatcttcgtatagaactggacatgcaaactgttggtttatatcgattgtagttggacctatgtgctgttttaccgtaataatttgagcaaattggttatttgtccacagcttaggtatgattcttaactcaggctcctctttggaattg

SEQ ID NO: 32239 - DNA, 44418 bp, Oryza sativa
attatacaataaactacaacatcaggaatggatgtggcagaaatgcaggattgaatagtaaacagttctgcttgactgcttgtcctaaaagtgtcacagtactactttattattacaatcaccatgtccgataatagtacattaaaaagcattaaggcttctctctgtacacacagagagagggaagagaggtggggaaggagggaagggagcagaaaggagtgatcctggacctaaccatggtagtgacattggggaagcaatggacatctagatgagtggccgacccaagacaataaaatatatctatgggtccattggggttaatgaatgaaatacataggcagtgtctggcatttccaaagccttctttggggtaccatcactatgttagaaatgacaggaggtagcactaagtgccaaaaacaaacattagcactcctctgaacctgtctctgacaaggggcacaggctctccttagagccttaaccacctagatgcaagctataaactggaagataaaaaaggaatgttagttggagcacctaatagttgcttactaaaggttaaaagttggttacacaagttaacacgtggtgttagataagttgctgggggctaatttgcatgggaagaggttaaagactggttacatgtcaaattgatttcctctaggtaacagcaagactagaagattagggtctgctaaatggtttgtgcttcatccagaagcacatggcctatgctaaatacaatatagattccactgacgaaattttgaagtggcattcttgctcgatcagttgtttagatgtcacttttgtccaattggcctgtatcagcatgaaccctccctgggttaatgcttgattgttagggttacttttgcccatagccttctctgctagggttgaaattaatccatgaagtccttccttggactgttgttaaattggttggtttgtgcttctctgttagtacagccccatccatgggggcattaagctttgagcccatcctggggctgaagcttatctccaatcaccacatgaccatgtgggatatggagtgtgcacttttagctgatgagcatgaggtcaacaatagtgccttctggtgttagagatggatgcatggactcaacatgtgggaaataaaaatgagagtgacgatgagaaaggagaccatggttaggccaagggttgctctggagcagcagacacagcaaagtgcgagggaatgagccggtaaggatgagcagcctgagttggagtcggcaaagtaggagctgtgagagccatagtcatgcctgtttaatggggacacacactgtgaatgtattagtgtcactactgagcaagaaagaaataatgtaactatattatgagaaaatgatagctttcttagcaaacaagcgtgaaaaagtaaaccatactttgtatcattctcattacatgtccactagttaggattctttatgcactgactgattgacaaatgcgtaaaagacagctaatttgtccttagaaatgtactggggcagactgaaaagttccatattgaaatgcaaccttttgttagggttgaaatgcaacctagtaacagctgctggattgcttttcttgttttaatattcatgcaaagtaacctctgaattgcatttttgtcaagtgaagagaaaaaaaaatctaatgtacttttgaaagctctatattttacctaggaaactaggatcatgcctacacagaggatttgaattatgatggaggtgcatatacaagagagctagtaatacctgcttgggcttgaggactcgctgcaagagacaatggccctccatattgctgtgcaaaacctgttacagcagcagctgtagaagccacagttgagaagtgaaacatctgtgggtattgcaagttgtagccttgtccacttgcatagttggttgtagtgcttcctgattcccaaactggaaatatggataaaaggggctgcttccagtcaccatgccagctgctgctgctgccgccgccgccgccgctccataaaatgggtattgagctcctccgtagatgttgtagtagttctaattaacagcacaaggagaagataagtcttgattccatgacgtttgttctttctgatataattctgtgatgtatgttaggaactctgttataattcagttcacattacattcaaaacatacctatatgcagcttgaatctgttaggtttgcaagagatgcattttagcatctgtaactttatgtaaaaagttgaattaagtgcttgcatattctgttaagttttcttgcttcttgttgaaaatttactaatgaatttgaatcagtgactctgatagtactatattaaggcggctaaggcgtaagtgcataaccgttagcaactgttaaagtaaaggcaacaatttggtttaattgtcattttaatattttggatatgccttttacagtacataaccaataatctaattctgggtatcacagtcactatgcagatgtacaatttacctacttttaaaaggtgttctgttgcattattctagaaaatatcctactatatccaaacaagtaacttattttgttttttcctcgctccaacactagtaaatggatggtgtcaaaatgcatggtttggaaattggaactgagagagagaggagggggagaagggggcaggctatagtcccgttattagagtggtatacctcaaatagttttttttttctagctcatgtaaactatcaaacagtattgaaataccaagtttctgtgcttcctatttgacttcatgaaaatcatgtgcctctgcaacagattacatgttagacagacacttgactgttcctgtcatatgcagtgcatcaatctgggacaaagctaaattggcgcactaactgcaaaaacctgtattctggactacatttaggtccatgcatcaaaggcccaataggtgacttaggtctttatggagccaaacagaggtatagctttgaatagaattgtggacccacgcatgtgctgtcactaagtttatttggctaacaaaggggtctagctgatgggaggatggacccagtgtttaacaggtttggtctggacaagctagggcccatgtcatgtgcgcctgtaccaggtaagatagaagctgctaggaccataaggcactatacttgatggaggctcaggatggataattgatgattttttttaatgcaggcatggacattgtttggactgggctcatctcatatgggacaactgtttgaggggggttggaaaacaacctcatatccattagcgaagctggactcagaaattcaacattataatacctgttacacgtgaagggaatggttttgaaaggatgcatggcttagggcctttcagcacaatagcacataatattgtcactgaacatggaggaagctaggcaggcgatggatattcttaagagctgctaactcatgccaactgacaggtaaaaactactggtaaaggaaaatctttatcagcctgtggtatttcaaatggttcaatgtattgaaattgctaggatttttggttttctagtagcaaaagtgattattttgatagcttttctttttgtatattcatgttattatatttatataggggtactggggtagtgctacacactaatgtttatttggtgtggggctgtgggcttgtattagctagttatgtgctttccattagtaacattttaatgggatctgtacatgatttacaagtttgagtgtttgacaagcatgctatgccagtttttaagtgacggtgcatgcaggatgtcagtttgtaagtaaaacctgtgtaggatttgctatgaagacagatttcatttagtacactagagtatggagacaaaccgtccaggttggcttgaaagctcgcggttgaagaggctaatatgcttagcatttctcaccttctttgggttactgtttgctatagcagtatagtatatgttcctgtagcagcatttaatttcgtgcaatgtcttgttttgctattagatgtttatgtgctactattttctatgcagcatgtatcatatcttgattgctattgcaaatgcatactacaaaactaatttctggtacacctataagcattgtcacaatggtatgttagcttaaaattgatatgcttaatatttgtccccgcacccacccccaacacacacagaaactgatctcagttaaataataagaacatcagcatcctattatattttttatccaactaatagtacttgctggatttgcaagaggaacttactgtgggataactgtagtctggagaatagggagagtacctgcagtagttaagggaaggagaagaaataatatcaattttgtatcaatcatggttatgaaatcatctactcgactaagcatctaatagcttgcgccagagggagagtagggcgtgcttgcagtctaagggagataacaagactgccctttcatgtgccactggatcagcatgcactgccagtgccagcctgccactgtgtgtgtgtgagagaggaggggttggggccttgggggtgcaagctaaaaagcttccatgccattcaccattgaccaaggcggcatgtcatgatgcacatgtcatgcatgtgataagccccccgtcatagttggtccttgggaactttaaggggggagagagagagagagagaacttacccatagacatggtaagggagaccttgtgggatagcataatgggggaaggtggcgtgagaaggaaaagctgcgcccagaccaccttggatccctgcctgctggctaaaggacttcatcaccctaaagctcctagcccctcctgtagcaacatcgtcaagaaaattagagcaaatttacccacattgccttgctagcattatctgcaaaaagacacttgaaagcagccttgcacttgttctgatgcaccactaatgagtttattcacagagatggtcaaaccattcttcggtcgctgaattgcaagacgacataatagaagtaaaagattctctgaatctgtcccgattaatttagggttaaggtttgatcctatagtttattatctgagcctaggatttataattagtatagcgcattatccgaaacaaggcacttatttcaaggataactaacatctttgtactgctaatgttgttcgtcctccttatctacttttccagtaactaaattccaagataatatcgtcaagactatggatttttttgctgctaggtaaaagggcagtcctgtcaaaatgtatgctctgtacttagtaaaaattagttagcactaagctaaaccaatgcatttaaaaggtcctcatctaacaaggcttagccaattagcaaagttaggcaaacttgatgtcgtgttctttaagctcttatttattctattggcaggaaggaacttttttgcgcataaaatcataacagctaagtttgcgatcatgaaactatatgtggaaatcatagaaaatgccagagttagtgcatctataatgattatcacttctctttttcaagagcttttggtgttgggctgttttcaactcataagaagttgtcatcgaaggctttcaagcaagctagctaactgtgtgttctatgttgcttttgttagctggtgagataatggcaaatgtctaaccatgctgtggggttggaggcctagatctctgaaccccaagggaagccagattacagttagcccttctcccgtcgatcaccggcgcgggatcaacgcaagccctcatcgccgcatccgggtcccggaaggtaacctacaatacgaatttgtggtgcataatttaataaaaattaagcattctttgcatattgcagcaaaccaaaaaggaaagaaaaaactcgtggactagaactgaaaggtttgcaaagtaaactgctgcaattaagtgcacgtaaaggaaagatagaactgtaaatgatcatacaaatccatagcccttggatctgccagtgttcttgtcagtgataacaactgcctccaggatctccccaaactgctcaaagtacttcctcatggtctccttctgggtctcccatgccagccctcctacaaacaccttggtgtaggttgtgtccccaaattgccctatcacactcggtggactcatgatactaacttcaactcagcagcaagaaatctagctcagaaaaggaacaagaaaaaccagcaactaaggatctgaatttagctaggacttgttaggggaagattaggagatggaagagaagagaagagaagagaagagaggagggaaagaaggagggaggcaggaaaagctaaaggttagaaggaaaagggggtaggagagaggggaagggagagtacagaagggcaatatatacaagtgtctgctataatgcaccactcttgtccttttggtccaaaccatgctcgtataataatactacacaccgggagacacacccaccccggccaaagcatcagtagaatgactcaactgtccttattggatgaacagtagttacagggtggcgttgagctgtccttgtctggatagtggcaaaaacggaacggagttagggagggattccgtcgggaattagggaacttaacagaatttcgtaagatgcaggccttgtgagcgtatcccgattttgtttgtttagattggaggtaggtcattatagataatcaagcgtaatcagtctagcgctgttcgtgctctgaatgcaattataacatagtagtttgattattatattctagcagaacagaggacataatggatttatggatgtactctcttgcgtaattggaggtttatggtggacagaatgggtttatgggcgcatcaacatatcttctggtcatacttggtacaatctaataccaagcagaatatgatgtgtagagatcattttgagtactgttttgcttcaaagtggtagataagcatgggttgaggaagtgggcagaaagagtttaaaggtaaaatcactgcaccactaatataggttattttgtgctatatttctaggtgagaataatttatgcctgataggactgcaattgcagataagttctattttataaagcccagggctttttttacctgaacaaatcctttgtgcaaatcttaggctagttgtttatccgagttatatctcatgccccatttccaacccatgttaaatatcctaattcctatctgagacgttttgccaacaattgtgaaggttatattacttcactcaataaatatatgctacattaaatgaactaatcagtagagcaatatagttagagattatcagcatcactctcactcgtgatcctaggctgctagccgctttgagttggagcaaagctgtggtggaggctttcttccttgtacatcaagcacgtagaaaaatatgccccaccaatggagggagagatatttgatgatgtgcactgcctggcaaactgagggaatgcatgatgtgccatcagatctgatctggagatggacggctggagttgccaccccaattggagtggttgggggagtactgaactgtttcgaggcttgacaaggacgcaggtgccaaagcttttgcctgtctctctagctcctcctaactctagatctctcttggcctgtaagccacctctgataacaacagcctcctccatcactttgtcatgtcccagacaacaacaatacaatctttggcgccccgtgtgtatgtacctatccatgcaatatcttgctgctgactaatagttgtccctttcttttcaagacgaaaataaagaatatgcggaaagtgtatatcatgtaacatgtgtctgcaactgcaaggttagatttattaacatagaaagcatatgttcgttcatacttgtgagtacaagtacttcaaacagtctgaagcacctttggaatctgacatggtagcgtaaatactaatataataaagtaggctagagtgggttctcatatataatagtgtctaagcgaggagactctccttagctttagatactcttgcatgagattaggagtacctgcaggagagattagtatattacagaaatccatgaagaaaagtgtaatgtgcataatccgagaacattcgcttaaattatatgaatatcagtgtgagggggctatcacctcgctttagctgactgaaaatggatgtctaatgtggaatttataatctcgtagtactagctggctagctgcaagtgcagtattcacatgaactagaaataagatgtatgttatgaatcattgaattacatatgctttgatattttatcacttttgtctctttcattccgatggatgttgtctactaatcatttggctacatgcttcattgcaaggggaatcttttttaacaaccaggggagtatttctctctggagaagggaggaatcttagcttggtccagtatacagcctgacgtttgtatcagactacagtatctgcgtcctagattaacttctccccaggccggctgtccttgttgactggtcgaggtggactgaccctggagcaagggggtcttggctaattggacatgtgaagcactgaggcgtcagtccattggtgcctggtcctgtatgcaagtgatcactgttcacatccaattctgctcttccaccagcgcactaaagtttggaactttggatactctctagtctgaaccagaatccagaaaacttggtaagctgctggcacatctcgtagtacaattggtaagttctactgcacgatgtttgaattatgggattgaatgggggaattatcggctagctcaatcactcaccagtgatatactgtagtagggtttttctgccttcctttacatgatttccatcatgccgcatttggtacgtatgtatttcgagggattttcactaacaaatcaaccattttttttcaggaacagtagaatctttgaaaagaaaagcgcaactgctgcttatctttgaaaagaatagtagtacttcgtatatctgttgtcagcgtgtcgtctttcgcccgatgaatatttgttgagacttgagaagggtacgtaaacggctgtgcccatactgcgcagcaattaggattccacatttccactacccaactgtccaagcttccaacctgtattattctggttaggagatattgggcggtgccactgacgtaggaagacctcgctaagtctttccacttgtaggaaaagattgacgtaaagagagaatcgtctggaattttggttggtggtgcaatgaatttttggctgctagtcgaacatagaacatgcccaattaaagcctcgtaggattagaatttttatcggtaacatacggcctcttgaaaaatctcatctaccaatatcttacaagatctttatacaactcaagttcatgagttatagtagtggtactatactgcggagtactctacaacttgggctgcatgcatgcatgattgcatggacctgactactgtccaaattaacgtaacgtgagcaggggactgatccgtttttcgttttgaccactggtccacggttcaaaccaacagggcacagcgtgaacatgactccggtactagtagtaggagtaggagtgcacaataggctaactatacctctgagcactctgtctgtgggccacgtcgtgtttttagccgcaataattcaggaaataattgggcagagagagagagagggagagaggaggggagagaagagctgaggctgtctgtcccacgtgactggacagagtgcccccctgccggggaggagaaaccagctgtaaagcggggccccctcctctatcgaggtcacttgcgcgcaaaaagccaccgcccactgcctccccccgcgggctcgccggcacgtgcggcccaggtacggcccgcgtgcaccgtgctggccgcgcggatcctcttcgccacgagaaaacccgctacgcgcacaaaccacacaacccaacgggaatgctatatataccacttgacacatttttgagcaggtacagtagcaggctataagccagctgtaaacatattttaaggagataagtgaggagagagaagaacagcgggctatatatttatagtcagctgtagcacggattccaaaacacagtgtgtgtatgacaggtggaaccaagtattaatagtgtagtatgtaaccattgtattaatgagctattagattagctatagatgaattggagctagtagttggctatactattaaacttgctcttagggtgaagatcactcgaattttgagccttcagatatgctctaagattcgtgcttcgtctgtctctgataagccctgaactacatactataatggtttcaaagttgagggtgagagagaaaatggggtttggaggcagggaagtgagaattgttccctagctaagaggaatggttaaggcggtgatagtctgatggtggacccacggtcatggttgggcggcgagacagtggtgttgtcgtctcgacgaaaaaaaaaaggtgattggtctatattggcgatggaagcatggatccaaagtggttaggtgaccgtggtgtctccggtggtctcgaaacagggagaaagcatggctgggggaatggaggagcttgatcggatgtatctcgtcacgtgttggtagtggctcctggcgctagcaaggtcgaggacggcacgctggtatgggaagacggttgcaatggagagggcatgaggatcgggagaagaagagcctgtcgcgatggtgtcgtgagtgaacgagaagaatataatgacgggttggggctagagaggtgttgaacagatcttaaagtagtctaaaacatccaaagtcgtgtgattttaaaaggggaaatgtgcccagcgatgtaggataggaccatttttaggttgttgtcaaaaaatatgtttgaatggtattagtgtatatttggattaaacccaaataattgataattccaacggtcagtttagcattaatttaaaaccttcctctccatatgatcaatatttggctttatactagtatcattccaaatatgtgtgatacatgcatatctatctaccaaaaatattattagtaccaaaacttaccaagaatagagtagtggcggacctatgcataaactgtggggtcagctgacctcacagctttttgaaaaataccactatagactttcattttcatatataaatccaaaataattaaataaatgacctcgtttaagtacaaactagtaattgaccccacagagttaaatttctacttcgccagttgggagagaaccaaaaatcccccgtaagagcaaggctaataatacagccgacctgttggttataaggttctttgtagtcttctttcaacctacccatatactcccttcgtcccataatataagggattttgagtttttgtttgcactgtttaaccactcgtcttattaaaaaaattgtgcaaatataaaaaacaaaaaaataggcttaaagtactttggaaaataaagtaagtcaaaaaaaataattctaattttttttgaataagacgagtggtcaaacagtgcaagcaaaaactcaaaatcccttatattataggacggagggagtaataattagctctttacaattaatacatgacccacttgtctctctcacagagctttttggttcttatgtctaagctgactgtaagtttatagcccacttctcttagccggcatatagcctactgctctaacgtatggacgtatggacgtatgcacagcaattccaggctcgaatggcaagcagtgcggcgttggccctaccacgcggcgaatcattgctggtgcagatctcgagggtgaggaggagggtccccaggccacttgtgacaagcgtcgcagattctgaggccgccgcccctccaaccctccctccctccctcgtcctcccgtagccggcagcggcagcggcagtggcgccgcgcggcgtaggtaggcctgcgcggctgcgccgcacgctgcatccatcgttcttgcccgccgatctcaccggaaaagccgagggggggtgaaagacatcatcgctttggctcagactgccccttctccggcggtccggcctgcacttccactccgtacagaggcacagccagttataattaactgaccaaaatattcctgcagcggcacatcgcagttggcagatggccggcttcttgtcaacgtcattttagatgattctgccgtagaaacgtgtcattttccacaggaaatcaggatctaagtacatggtcaaaatgggactacgtaccgtaccgtaccgtcaacgtgacgatcctggaggtaaatgcacgctgcatgcgctgtagttaagtccataaataaatactccctccgtcacatattacaacagagtttgaagagatatgatatatactaggacaacaaatctggacatactcctatccagattggttgtcctagtatatatcgcatccctccaaaatcccttagggcatgtacaatggtgtctaataacgggctctcttcattgttatgcaagtaaatttggtgacgtggaagaaaaagtggaaaggaatgagaaatattattgctacgcatgacaacggctcagagataactcttaacatttattaacagaaagtttattgcatgagggtagagaaaaggaaagaagtataataataacattatttatgcattaatggtttagaatttttattgtctctaatattgtaggagaatagtctctaattacattaattaatatagagagctcatattagtctctacctttgtacatgaccttatattatgagccagagggagtatgtgtcatggtgactgtggtacgagtttatttctttcatcatgtacaagacaaattttaggttgtgttcggtggtgggtggtgggtgatgggaaccggagcggtctattatcgcgtgattaattaagtattagctttttttttttcaaaaatgaatcaatatgatttttttaagcaactttcatatataaactttttacaaaaagcacaccgtttagtagtttaaaaagtgtacacgcggaaaacgagagggggagttgggaacggctggtatcgaacacggccttagtacagaatataacacatactaatacgggaggtttgttttttaggatgaagaaaatatgtgtatgtttggggaaacttctaagctagtactacaatttcttttagaatattcagctgtcagaaactatctaaataatccagatttttataatatgtaatcgtagaatttgaaaaaaaaaaataaaaagttaaaaactgaaaataaaaataagtttttttcagattttttaccggctgtttattttaagtgccgtctatgtgatgctagacgacagcagctggaatctacagccatgcaaagcacatggagtacatgattgatgattccgtctgtgaagacgactaacctgatctctatcatttgacgctaaaagataaacatgcatatatgcaggagattataaaaacggaacgaacccgacaactcgaagatccccgtcgtgacatagcgtatggtcgcgtggatgtatgtatgtatatgccgtcgccaacagtgcatcggtcgggcaccttttggcgttgcgtccgtagcggtgaaccgtgaaagatatgaatatgatgagccaacggctgggacctttttctccggaatgtgacaaattatgtacgttacgggctcgtcaaacagccacgttgcctctcatccgtacgtactgcatggcgatgttggagttggagacgatgaaggacgatacggctatgtgactttcatggataaattagtttttgcctggtcattttcattagcttaacaatctggtctttaatttggatttattagttggtgcgtgtaaatgaacagaaatggcaaagatatactcctttagtcaggtttgggtgaagcctgaaacagagctagcaatacttcctttagatctagggttaaaaggctgagtttcagagtgtttttcggattagctattctctcgtttatcattagcacatttttactaatatcttacgatgctatgaaaccaaagacaacaatttccagtgtaaaacaattttgcctttttacaaatacttcctatacagaatttttttaattaaataaatctatttttaaattgtaatactcaatgctcaaataataatttgctaatagctcgtctgatttcacgtgccgatgaaaatctagtccaagcagccatctcgaacgaagccaaaggatactctacggatacacggcctaaagaatgcataccaacttgcatataaaaaaaaattctgcaaaaggtatcgcctagagcatataagggtcggagacgcacccaattatgtaaggatttcatgacatatttgaactcaactagaatggcacgggtacatgacaaaaaatcatgagtctctcaagacaatggagcctacgagcataaataccatcgagatacaagcaaagaaagatcccagagactattccaacaatcacttttcaccaaaccccttcatcgagagcgtcaacaagttactactctaccaggtctaaaatatagtttgttgtactttgttgtacacatactttccgtaaaattaataggttgtagagttataatcttgaggtgtatgtgccttatagttacatataagaaaagggtaacacaataggaacacaaaataaacgaaactcccagcaatatatgagatgacgacacctttagctttaatatcataaacccgcaattcacactagttcattccatttgtactgaactttgatctgtttactgtcaactatttcgatggcttgaaagtatttcctaccaaatagggaaaagcctctccaagagtggctgaccggctgacgggtatatgggctatggtccatgcagaccatggagagtggacgctcgctcctcgtcccaagcaggaatataaattttggttcgaaatttcaggaatattcaaaattttgggaatttcatccctttccgacaagcaaatattctgatcgaaatttcagaccttttcaaatatttgtaaatttagtcataatttatttaaattcagtaaatatatgttaaaaattttaaaaaatcgttaggaatatccgaaattccggaattttgatgcccaccgaaattttcttcctttcctagagggaaaaccccggtcccaagtgctgtggaatcggtctcccaccggcactgcagggcagtaccagtactgcaccggtatacacaaaagaatgcaaaagagcaacagattaggagtaggagtacgtatgctaaaatagtcggtggcagctggctccaactgtaaggaaagagaggcttctttgaccggcgaatgtgacagcccatcgccccatccacccatcaacagcggtagagaagaacatgcggttaaaaaaagtttcagcgacacaaccaccacagcagactcctctccttccttgcttgcttgctgcccagttcggttcttcagttactggagtaccagtaccagtaccactggtagtactcatcactcactacactgttcacaatttcacgcgcacagcagcaaagccagccccgcagtaacagcaacagagagagaggatccgagaccattctcctggcacgtagcgtagcaaaacccatgacgttgctgcaagcccgcaacagctgcagacaggggcggagcccaataggcccggggggttcccaggaacccggcccaatttctgaaataccttgttacccccataaattcaccacatcagcaccccctcagcccaaaaccaggaacccctccttcgtctggcccaaaacaaggcccatcgatgtgtatctgttagagacagcccagctgagaggagaggaggagtcgcgcacgtggttggatccacacggcgcagcggcggcgtcgtttcatctcccaaaatcaagcgcgtgattatttctttctcctcgtccgtcgccgctgagcacctgctccacgcgactccacgaccggcgaccacgcctgacgtctccgactccatcccgtcgtgcgcccgtcaccgttcgcccatggaccgccacagccgtgctcgacgcggcgaccgcccggcgctcgcttgccgacgccgcccgtttcccacacactccgacgactccgcgacctatgacagcccctaaatcctatcatccaatctgccactctgtaagtcatgtactcctacttcttctctcttccaattttgctagtttaccattgatttaatcttaattttcttgcttgcttttgcgatgaacgcagccattcagggcagtctgggagtagaagtttaggacggccggcgggcagcggcagcagcaagctggccggcaatggctggatccatgagctcgccggcttgccctcattgactcgtcaaatccgcctagtgaccacaagtgcttctatcaaaaatcacatccgatagccaccacttacaacaagtggtttatcggttcatgaatataaccaccgcaaatatgataaagattaataggtaactgtttttatttatgtcaaatcatttcatgacttattgtttgttgataattaaactatgccttgttgcatggaggaatgaagatggtgacatcgcattttacatgatatattcatttgttttgggtatggagctcatgacacattattaacttcatatatattattatcagttggtttcttcattatggtacgtattttttttaattttttcatgcactttctcatatattgtcattaattaggaagatgatgcttatatgtattgagtatacaactatttagtataatatcgttccagagctgtacatgtcgatactacgtaaagaaagttaggaacccctcggtttttctctagctccgcccctggctgaagatgcagatgcagaggcgcagctgtttggtattgatcgtcgcatgtgatgcagagttgtgtgggtaaaggccgtgtcccgtactgcccgtttctgaacccgagcctgaaactggagcacgcatggtgtccatgccctgtactctctctctccctcttttgcaggaggaaatcgagggtgtcgcttgcattgcattgcaccgctcgagagacagagcatgccgtgttctgtgttttggtggcaaactggcaactggcaaagcaaatgcaagttcatgttggttcttctgatcttgccaaagaaaccactgcagattattcagaacggtgataggagtagcacacattacttccttttgtcgtggggagaaaagttttataatttagagatgtggatgcgtatgaattggttttacaacagaaaggctgccaaagctgtgctcctttcattttcgtacttctgtctttttatgagggaaatggttgggtgctagcgcaacaaagctgatcaagatattctgtccaaatcataggcgatatataggctcattttcatagactaatcaactcttatatattactctatttactatagtgtcttttattccaaggaattgttgtttacttgttttttttcctccctttcggttagggagagaaggataggtaggctgatcgccattcatcaactaccgcttcccaaccactgccttagaaaaatggcctcctggaggctgtcataatccgggcctgatttacatctgggccaaataaaactttactatgatgcaagtccaatagcccaaatcaaacaaaatgtgcagtcttcacactggtacattttgtcagtttgttttgcaattatccttcaaataccatttattatccagaaaattcatttacaaattcatccatcaaatgccatttattattcagaaaattcatttacaaattcccagtgtttatgtatgagtatgagtcggactatagctgctcaaaattgtactggcaacgtgaacgaccgattaggtttcttacagtgaaacatgtttatccgaatttaagttttaaatttagcatatgttttttatttacggctaattattttattatggtagatgacgtattattctacgagatgtcgtgtatatgggcgcatgcgtcggtaccgtgtttaggaaaaaaaaaaggaattgtacgggcaacgtggcatgcatatgacggcgagattttagaatagtgttttacagggctgccctgtttgtgaacacacatgatcagctcgagtccatgtttgaaacagctcccaccctgcaaattcttgtaccctgttgagtactgtttcttctgtaccgtagttcgtggtaactgacagatgctggcatagtggcattggtatgtttctcaaaccctgcattgggcataattgcattaccccaggattaactagcaagcaaaagcaatgtctctcatcttcggttacagcggtgaatgggcttatcgtcagggtttagtaacggaaataacctagctcctagcatatcaaccatcaacaattaaacaaagctttaatttttttttgttaaagtttgctcagttttgctaccgcggtaggaagaggtaacccccttaccatcgttaagaaaacccgctggcaagcgagcccaagttttttacatgaaaacaaaatcaaccagcaaagcctttcacagcaaatactccgtaaattgtactccatgttgctaagacaattacgatttaacaagacgggcaaggtttttcatggacagcacagcacgtagactaaaacaaactatacgtgtaaatgtaattacagttgcacaagcgatgtgccgctcatcgctggacacaattgaagcctttgcacacgatcatccacacgacgaacaggacgaggaacagcaccaactccacgccgatcacgaccttgctgtagcgccaccacgagcgccgcgttcgccgccgcgcgccgtccgccgcgacggccatcgcttcgccgccacgatcatcctcctcctcctcgtcgtccttgtcgccgtcggcgctcgacgcgtcacctccacctcgtgagtcgtcgccggggaacagcgctgccgtccctcttcccgcggaggcccgcagcgcccgcacgaactgccacacgacggcgtccacggcgtcgtcgcgctggttgcgccgcctggtcgcgccgccgccgccgccgccgccgcagctgccgaacgcgtcgcggacgcgctgcaggaaccggaccgtctcggcgctgccaggcgtcgggtccgccacggcaaagtacgtgcggccgtcgtccccggcgaggaacgcgaacgtgcgccgcccgacgacggtgtggtggtgccagtggtggtgctccggcgcgtggtcgaggcagagcgcggcggtggcgcgggccacctcctccgcgtcgtcgccgtccccttccgcctggaagtaggacagccggtccgtcctgcccctggacgtcaccgccacgcagaagaagacgccgccgccgccttcttcttcaccggcggccgccggctgcacccccgggctctccatcttcatcgcctcctctcttggctttgaccggcgagaaatcatacacactccaatggattcaataagagtcttacccagaaaagtccttgtacgtgcgttgcgtagtcttggtcttcgatgttgtcagcttgcaatgccgagagacagcgtcaaacgagcaagtgcagcagtacggcagatgcaaagtctgcaactgcaactggagcaacaagatccaaaacgtttttttgcagaggaaagatgccgcgctagcattggttatgcacaattggtttcagttttcatattgctctagttgcaacggaaaaatagcacaatgcagagatggcatgtgacttgtacatgctactactccaagaagtgaaggaaagaacccctggaggctaggtttagtagagcatcagaagtaacttacactagaggagatatgcaacgagaagcagcacctctgatacgtgtcttgaggtgtggttttcaccttgaagaaggttaatcgaggggacccaaagtgatgatcttttcagtagaattttcgtttcaggataggataccttttgggttaggtgagtcaaaatgggagtgttttagtgccatcctgtctacctgtgaagttttgtgtgtctgtcttatgtgttttttggtataggtggaacacaatggaactgcactagtagagaaatgatcaaaatttgcctagctccaacgtatgcatcacctcacctaacacataaaaaggaatgcaatgcccaagataagcctaaaatttactagctagcaatgacaggtgacaaacgaatagagaactgcaaagcgaaacatcagccaagccactaccacttaaccatcacaaaatagggttagttggcaatgccacattgcagcaacttgcctgtccctgacactgacagagactcatttctgtgatgtgcacggacaaagaagtaaagaacagttgacttgattcggttccataaaaaatctacagctgatgttgagacatcaacatcttctagtattacagagtaacggtcattcaagtacacgacaaagattgctttcaaggctttaagagtccacacgcacgcttcccgaactactcatcggtacgttttttgtaaaaaaattctataggaaagttgctttaaaaaatcatattaatccatttttgaagtttaaaatacttaatagtcaattaatcatgtgctaatggctcacctcgttttgcgtatcttcccaatctcctctatctcctctcctcaaatacagcctaagcgtgcatagctcattgtttcgagagttggaggaggcgtagtacagccttcgctgttgcagccctcccgtccccaaagaagagaaggatgagtgttgtactaagattttctaattaccattcataaaagagagccatattctgtacatgtatgacaatgatgtgcattaagagatgaaaatttcagggagctaatcccaaccagcctactctatcaacaactcaacataccagattcccttctttggtgcctagtaggacggatacaacattggttgcctcggagctccatggccagcagcattcaaaacataatctccatacctaccattaacaatagaaccaaatatgcatgtactgcaatcatacgtaccattgctgaaccctctgtagctatgcacgggtccaactggtaatgctggttagcaaaagaatagtaggattagattaagagtgacatatatgcagcgtacaacagtacatatagataggcccaggaaataatctcaccttggggattagcactataaggataatagtttgaaaagccataatctcttgtcccaccatttaccattggatccgctggggtatgcaatacatgcatatcactatgatgcacaaactgaggctgctttggtaatggtacaggattgagtttaggcattactggattattgccatttgatgagggtttgtcttgtccagagatctgcaaaagacaatgatataaattcagaaaactgaccctcttcatatccgcataaatatagataagtatgaactaaaacattatctaaaggatgtggaagaaattcgaaatcagaattatcaatcttttgggaaatcagaattatcaatcttttgcgaaattgtatggcacagaacacaagaacaactactagcactctaatttcgcaagctgtaatcatattggtacagtttaatcataagaagctgatgatcatatagaagtaacacatccaaacaaaaaaaaaacagataaaaaggaaacctaccgcaaatttgagtgttttaccataaagccgaacaagtcctgaaaaaagttgaacagcatactgtgcgatttcctctgtttcatactcagcaaaagcgtaacctttgggacaactagtttccttgtcacgaggtatgcataggtctactacacgacctggctgaataagaatctcatacaatattctttcagttaccttttcatccaagttacctattgtaggaaaaaattgcaatataattaatacaatactctgatacagagaaatgaagctgcttagactacataaaacactagatatacaatatacatacaaacaataccagatgacaccaggactgtccacaaaaaacattgcatttgcaggcaaataaattgacaaggttccgaataaattagcatagcccagagaattgctaagaaagctaacaactggagaaaagttcaatagactagagccgctacagattcactaatgcaacaaacagtaaaagactaaaagttcctcgcaaccaaaaaaaaaaagagagaaaagtggaagttcagtatctccatgccaggtaagtttaagaaacgtgtagaaattgaaatgctacttgtgaaacacagtccaacgttattatcaagtaaagttcatagcagcaacagtgcaatcacttgtcaagctttgatactagcatctagcagctctatttccaaatgcactcatcgttttagccagtaaaagaaatacaaggggaacaacaggaatcctttcaacgatacatttgcagttgcacccatcagaaatcagaggaacagcaaccacgctaaatccacaaatcacgcgtaaccacgctaaccgaggacaccacggaaacatcatacaacttaaccaacctaccaagtaccaaccaactaattgatcaatcaaatcaccgaggtgtacatcaatctactccaatccgaactaaaaccaaaatctgaagccaccgcgagcgccgcggggagggggaagaggagacagacgctcacctatgtagacggtgcgggtagggttcctcgccatggccgcccggatctgggcgtgaagctctctcgctcgcagtcgcgccgcaatcaagagggagaaaaaaagcccacgaaagtaagaaaccgcacggacaagttggggctttaaggctccgccgttcgatggcctcttgcgcctcgagattcggaaacgggttgggcccttgccccgaggcctcggtgcaaacggagacggagatgatgctgggctggttgtgtgggcccctttatcggtagttgaataaatgggcctccgccgcgctggtgaaaacacggcccatcgagtcaacgggttaactattattgacccgaggagagagagaagggaagacgtacagtgctactccttgagtccacgtggaggctcgctgttggctgacacgcgtggcgtgcaccctacgtgtaccaagcaagcacagctgtgacgtgtatgcttcaactccggaattgacgtggaaccatccaactacaactcgacaaaacctacaattgaagtagtactactagtactccgtatatttattggctgcaaaattcttttcttctagtacaaccatctttgtttgcgtaacatatcaaagtcggcttaaattattttatctaaagcatcatggttacacactcagtaccccatgtttttatatatgatgtataccgatgtttactcctactatataatcttgtagtaatataaatatataatgctacaatcacatgataatttagttttatttttgcacgggtgacatctgccgtagttagaaaaaaaaaaagataccaccactggccattaaacaaaatctacacatttgagactaaacaacttgattgtttggcactgatttttaacaatcaataaagcgttcgcgaaaaaaataacaatcaataaataatttataggtagaggaaaactctcacatatgcgttcttacggatttaaaagctaatgggagattgtttaaaatgagaaaaaaaatccttaaaatcaaatcaaaatttaacttttcgactgcggcaagtaaccaaaaagcaaacggtgagcctgaaatggacatgatttctctctctggcttttgaatttgaactagtccacccagcaaacggtaataagattgtactcctccacgctggacggaataaacaagggagccaaagagtccagaagaatccacctcaccaccacgcgcaccggtaacaaacaggttggcattggggattggacaggtctcacgatttcacaagtgcgaacgggggtggagaagccgacaagatctcgcggtacaaaagccatcaacgccttcctccccttcctccgatggagccacctcaaaagcccccgcccatccaccgccacgcggcgatccaacccccttccccttcgccggcgcagcatcggacctcgccgccgcggcggttcttctgagcggggccggggcggggcggcagctggggattcgtcccgtgccccgtgctcttcctctgcgtgggccggggcggagggagggaggggaagtcggtggtgaggtggcgtgttgtgtggcgcagatgtgagggcggaggaatgcagaggtcgcggagagcccttctgaagaggaaggcggcggcggcggcgaaggaggaggaggaggaggcaggggtgggcgtggctaccgcggcggccgccgggaggaggcggcggcggcggctgtacggcttctccgtctcgcttgtcgtcgcctgctgggtcgtcctgctcctgctcaaccccctcgtcggtcatgggaacggtcaacgaggtacgatttcgttttggccttcgcggaatcaatttttgatcgatcgtgcttggtgggtggttgcgtggtggtgcgaacggtggttggggaagatggtcgttcgctgaatcggccgaacgtgaatcgcaatattacgcggttacaacatagatctatatatgcgcgtttcatttctgaattctgaataaacatcatggttttttgatgtcctgatgaaatttccgctttaattttaccatttttgaaagatatcgcatgtcaataattttcaaattgacgttatgcgtatttctcggtgtcgattgggctcatgttcggtgctgtctgatttctgcagatgaagggatttttgcggatgaaggaagctctgatccctcgtttgattctgttgagcctaccttgagcgaaggctctgttgattcagttgtacagcaggagaatggggaaaatcatgcgttgccaggtgatagctgtgctaaacccgatgaaaatcatgtgctttctgaagagacactgctggagaaagatcagctttgctccaatgatgaggcacagggtgatagcatggatgctctgcccaaggataacgttgatcagggtgagaatcttccacggacagatgatgattctgtagttcatccagagggggaggtggagagcgaaggtgttccaagaccagcaaggttatcacgagttgtccctcctggtcttgatgaattcaagacacgagcgattgcggaaagaggaaagggtgtccctagtggtcaacctggaaatgtgatccacagaagggagcctagtgggaagttgtacaattatgcctcggcagctaaaggggctaaggtcctggaattcaacaaggaggccaagggtgcttctaacatcctagacaaggataaagacaagtatctccgcaatccttgctcagcagaggggaagtttgtcattatagagctgtctgaagaaaccttggtagatacaatcgcaattgcaaattttgagcactattcttctaacttgaaagaatttgaaatgctgagcagtctgaattatcccacagatagctgggaaacactcgggagattcactgttgcaaatgccaagattgctcagaattttacttttcctgagccaaagtgggctagatatctgaaactcaacttgcttagccattatggttccgaattctactgcacgctcagtatgcttgaagtgtatggaatggatgcggtggaaaagatgctggagaacttgattccagttgagaataaaaggctggaacctgatgacaaaatgaaggaaccagtcgatcagcaaacacaattgaaggagcccactgagggaaaagaatcctcacatgaacccctggatgaagatgagtttgaactagaagatgataaactaaacggtgattcatcaaagaatggtgctcatgatcaagttaccgagacaaggccaattcaggctggcaggattcctggagatacagttcttaaggtactaatgcagaaggtgcaatctcttgatgtgagcttttctgtcttggagcggtatctagaagaactaaatagcagatatgggcaaatttttaaggattttgatgctgatattgataccaaagatgcactcttggagaaaatcaaattggagctgaagcatcttgagagaagcaaagatgactttgtatgcttttctattcacatgtatttttctttcttcttttgttggcattactttctttgccttatcatatattcattcatttcaggcgaaagaaattgaagggattctctcatggaaactagttgcttcctcacagttaaaccagctactcttggataatgtcataatcaggtttgtatagttaccgttttcccttttgtgtttttactctattctcgtattcgagatataggtctatcccgagttggcttccgtgtttgcttgtcaaaaagtgttttccttaattcttttttctgttagctaattatagcttctaatcgtactattgagagttcagataaactacttgaactgctttggtattaatgaataattatgtcggcttgggatgattataactttgtgattcatgttatggtgtctctgcagatcagaacttgaaagatttcgggaaaagcaggctgacttggagaatagaagctttgctgtaatattcctgagttttgtttttggatgtttagcgattgctaagctgtctataggcatgatatttaatacctgtagattatataattttgaaaaattcgatagggtaaaatctggatggcttgtgttgctgttcagcagttgcattatagcctccattttgataatacagtgatgtacctatcaactccatataattgcggctgcgctttgtaattgcctgaggtgtctaattcaaaatctattacaatgcatctttgagatcttacacaagggagtgtagttattataactcgtcggcgatctcagtttggagggtagaaaaggaaaaggctgtggtacccaggtcatttttaagttgcagcaagctaccagtgctagattatttttgtcagctgcatggtcctctccagtggaatgtagaagcaaatctacctggaaagcatgtgcatgcacctggagccaggcaatttcttttataagttcagaaccatgacaggcctccatgtgcttccttgtatattccaagaagagatggagtaatatatatcttggcatgatcgctgtgcactcgatgttcttaatctgagtggccttcctgcctggtgcacatggcctcaacatcatgttgctttacaaggcagtactccgtttgcttccagcttgagaggccgcattgataactgctaacggtactgaatgaagtcaatgacctcaaacatgtactacaaatgtacagctcttttagttgaaacagtactttgcactggtttgctgtaaatttgttggttgcttccagttccagatctcttgatagccatttttgcacatatctataaattataggagacttttgcacatatctataaattaaagtaagtaggcttccatgatgtctgacatttattttagggactacctattgcacgatacagtacttatttgtgatccctggttactggtcaacttgtttcatagaatatacattcatctgctttcattagcaaactgttggctttcttgcccccatggatatcccagttatccacagttttgtacgacattctcttatgtcaacttcagcattacttttgcttgcttcttttgttattcccttaaataccactcttccgtctggagcaacttgatacggtgggctggtggctaaaaaaacaacctataatagcttcctttttttttacgcaaaaggtgcttccatttttcaagcttgcttctgttatctctatctcaagtttacttgtaaatgttcaaaaaaaaagtttacttgtattatcaacaaagcatgctgcagatttagcctcctagctgggtaatcattcataatctaattgcttgggagtaaattactcatcgtatcttttgaccactttgttcctgcgaatgaagtccgtacgggactatgccttacatcttaattgccatcttggctttggattgctataaacagcagactggttgccaggttgggcattggtgcctgcatttgtgctatggtttcgataatttatttaggggtatccgggtatggttggggaattggtgcctgatgggaagtgatgggaagagccgagcatcagaagatctgagcccacctgcttagattataactcacttggcccacccaatcaaggcagggctacgtatcagcccagaggccagagcccccagaccactactgactcttgaagcccaatgtaaggccttatttccattcctcaatgtatgaacatcacacttagaaatgttttttgtttttcaaaaatgaaaacatgaaaacaaacagaatttccacttatgaataatgaattcaggggtatgctcattaatggtacagtactagataaaatatcatacactttaaacactactacatgagtctccctcagaatcggcatatgcctacacgttttccttcagatgacacgtctctctctctctctcttcgatgccatcgatcatcagcaaagtgatgaacataacttagctcctgcactgtacgatgattggaacttccaagcacaagaatggcccaggcagagaatccaagttgcacactccaagaaacgttgcaaacacacagcttgcaccggcccgtgacccgtcgttacccaaccagagacaagaacaataggcaggtcgctgtcagcgtcggtgtgtttgcaccaattaaactctggacgacgcaagatcaaagatgaaactttgagtggcatccacacaaaattcatagaccatggtaaaactcgtgccctggacaagcgccggattcctctcctggattcaggaaatcatcgacgacttgagagctcgagatatagtgcgacaaagctgtgatttgcatggcgtccaagtaacagatatcccagccttgaagcctgaaacagaagggtctttcgatgtgcatcattgcatcttgctgtttgtttttatgtaaataaagaaaaggattgggttggaagatatacgtgtatgctagctagttttgtaggtaggcaccgctcggcgtgatggatatctgacgagagatgtgtacgccaaatggcagcttgcgataagccccaactgttaacgtggccgtctgaccatggttccattatgtgttcacttgcttggagacaagtccaagaagaaagaaagttcttctgcccctttataaaaacgaacatataagattttttttcaaagaagatgagtgttcttctgtatctgttaaagactctgaagatcgaccgtgttgttttgccacacaatcacaccaactttctttttttcaaaaaaagatctctcaacattttcttattcttttccttccttttttggccacttcatttaccgactaccggtcacactgtcacagttcactgcacgcaatccccttcagtaacatacaagtataatactaaagtactctctgaaacaacaacggaagcaagacatgcacacctaacttcagatgtctccttctcagtttatcaaattctcatgatgaaaattaaccgtccatttttgttagacgcgctagtggaacatccatctttctctttctgaacaacagtgcggcgcgcattttcctttttgaacccaaaaggacgcgtaagcaacgctgcagacgcagcaatcctcgcgtcccgccacaacactcaataaaaaacgaagcagaaacccgacgatatatcccaaatccgaatggcgtacgcagatatatatgtccagcgcggaacggcaaggcatcgactcagttctccgcattcgcaagcagcagcatccattttgagtacagataatactcatgctgttcttgtgcaccactcggaagctgcataatctcttgatttttagcccaacggctttgctaatatatgtgcgtcgcttgcgttgccattaattcttggatgttgttgctactgttgttttggaagcgatagcttggagttgtaaggtgaggtgaggtgcagggtggtcgatcagtaggtggaaaggaggaatcgaggagatggacggcgagattggggaggacatgctcacggagattctggtgaggctgccgtacaagtcgctggcgaggttccagtgcgtggccacgtcgtggcggcgcctcatctccggcgactacctccgccggaggctgccgctcatcacctccggtgtgctgtaccaggaaggccggggcggcggcggcggcggcggcggcgaagggaggaggaggcaggcgtacacgtacgcgtgcgcgtcggggggtggtgaccacggcggcggcgtggcggaggccgacatgggattcttccccgggcacgagacgtccaccatcatcgacgggtgcaacggcatgctgctgtactacgcatcgcaaccggcggcggcgttccacgtcgtgaacccgacgacgcggcggtgggcgaggctgccgccgccgcgcgggaagacgctgctgtccgtgctggcgttcgacccctccgcgtccccgcactacagggtggtgtgcttcaccgggtggctcccccgcggcgcgtccgtcgaggtgttcgactccgagggcggcgcgtggcgcgaccacgagctcgacttcgggctcgacaccgacgccatgtcggccaccatgcactacttcgacggcgcgatccacgtgctggcctactcgggccacgtcgtccgcatcgacctcgggaccatggcgtgcgcggtgaccgcgctcccggccccggtcagctgccgggcgcgcgccgggcactgccgtggccgcctccggtacgcgtccagcgacggcacgcgcctcaagttctgggagctcaagaacgcggccacatcggagtgggcactgaagcacgagctgggggtcaatgacctcgtcgccggcgaggcgagcggagcttgccaggccgtcaccttcttgttcatggcgttccacccggacagggagatggtgtacctgtggacgccatggaagctcgtggcgttcgacatggagaagaggcgcgtcgaggaggagtgggaggtcgggccgagaaggagaaggaaggcgcgcatctcattcagatttggctgtttccgtctcgcgccatctggccaacagcttggcctgattggtctatgtggctgataggctggccggcgatgttgacaatggcatgtgggcccaatgcttgtctgcaacattgggcacaatgccgttccgttcgagtgtccaactgtacaaagaaggtacaagacaatcaaaagaaaaaaaagggaaaaaatatatgctattcgtttgttctatggagtaaaattcatctctaatcccatcaggatagtggacagttcttctgtttccataagaaaattgatttgtttttttttacaaaattcaaaattgaattgtttcttgcaaaatttatgtaaaattcttgaatttcaaatgaatactcggtgtttccgctcgttggttgttgtgtactcccttccttccatattataagattttagatttcgactagttttataaataaaaaaaatactaacattcacaacaccaaccctttcataaattcaagcaaattattcataaatccaagcaaactttttataaattcaaacaaccttttcacaaaaccaaacattaatatattaatttccttataaatgtaaatattgctatatttttttaaaaaaaattgacttactagagacctaaacgatctacaatttagaacagataggagcagcttcggctaacaagatatgacagttttgtgtacgaagtgctagatacaccaattaaattgtcttagcttcggctagaatatgagcggttagcagtgacaaatcactgcaattgaccgattgccatttcacaacggtagcgacaacggcgtccgctgatgatgataccagcaaagccactgcatgcgtttgagagtgattacgccaagactattccattcacataattacaccaacaaattgactgaaatcaaattcattatcggcatcatcgacgagttgttttttcgaaaagatcatcagttaattacaaagctccattaaacctatgacatttaattctcacctcatatagctgaactctcactctcaggctttgcgagttcatagaattttgcagccaccgctcgttcacttgggtgctaattaaacatcaaatctaagctaatctactccagttggtaataaggtccaaaagcagaaaaaaaagatatgtgcaaaagaattcgttcgcgcgctcgccatggccgctactcacggaggacgttcggaaacaacccgcggatgtaacccggcatgaagtcgtgtcgcgtcaggatcccgaccaccggcggcctctgcaaaatcatcatcaagattcagatgcaaaaatggcggaaaagcatgtaggattcagctaagttggtaagctctattacccccggcgtcctcggcacgacgcacatgtggcggaggccgagctggcggaagagcacggcggccttggccagcgacatgttctccactacggtgtacggcgagcggttggcgatcgggtggaggtcgacgtacatggccatctcctcctcggtgaggtccaggtcgtcgacggtgaggcccttgcccgacccgggcttggcgaagtcgaacggcgcgagcttgcggaacacctcggcggcgccggtcttgacgcggtcggcggtgaaggtcttggcgcggaggagcacgaggaggtgggagcgcagcacgaggccgcacagctccggctccggcgcgaacggcgcgtcctcgatcaccgggaacccgttgtgccccgtgcggcgcagcgtgtccacgacggtgccgacgctctcgacgctggagaaggcgatgagcggcgcggacacgacgtcgccggcgaccaggctgcgcatgcacggctcggcgtgcgcctccaggtaagggagccccttcatgcgcaccatctgctcgtacacgcccttgttgaagcagtcggccaccgtcttggagacgagcagcaccagcatgatgagcggcagcagcaggaggtcgttggtgagctccaggaggatgacgcacaccgacaccgtcatccgcatcgtcccgccgaggaaggacgccgcgccgagcagcgcgaagagccccgtgtcgaggccggtgagcacgccgagcagcttcccgagcagccggccgaacgacgcgccggagaggatcacggggatgaagaggcccgacggcacggccacgccgtaggtgaccaggccgagcgagtagacggcggtgaagaacgcgagcagcatgggcacgccgaactcgctctccgtgccgccgctgaagaggttgcggatggcgtcgtcgttggtgttgaggaacagcgacgccatggcgttgtactgccccggcggacaccggaagttcttgaagttgccggagcggccgatggtcgggcagtggccgctggcggccagctccggcgggcatggcgtgcacgccgtcagccacggcaagccgaaggagcagcacgaggtgaccagcgagatgaccaccgtaagaatgatcttgtacggcgcgcctttcctgcaaaattaacccaaatgcatgcaaagctcagtgatcatcttgccgaagttgcaacagatgattgaaaattttgaaatgcattgattcgggtgaagattactcgttgatgtagctatacacacgaaggatccgattgaggaggaagttgaagagtgctccaagtagcccgccgacgatggcgagcagcacaaccgcggcgagatccatggtggtgtatgatgtcacctgtgaacttacgtcgaacatgatcagccctcctttcccgaacaggccacagttgccgctgcggcagtactctattagggaccttagcaccattgccgccactgctgtcgtggagaatgtcctccagagaagcgcgctccgccacctgagaaagcgcaaaggttaatagtttcaattgagtaattgggatgtggattttcaattgacaatgtgcaaagattacaattgacaattcaaaagacatgctgggtgtactgtagcatatctggcaaaatggtatttcagatgcaacttggtttttattttggggaattaccaggatgttgcttcttcaagtgcgaagaggacaccgccgacaggggcgcggaaggctgctgtaactcctgctgcagctccacaggtgatcagatccctgcggtccaaatcattcttgaagtacctgagccaattccaagtgaagccatacttgcgcgacccgccttgtcctagaaaggaggcaacacaagccccagtgtgcaccataggaccttccttgcccagcacaaacccagcagacaccccaaatatagacccaacaatctgcaagtacaaagctcaccaacatgatccaatgcacatcgaaaatcggtgtcgtgatgatcaaattagagttagaaagattgaatgtttcaatcaggatcatacataccttgacgaagagggtactgggcgctaagatggacggcgcgtcgacaccattcagataggccttcacctcaggtatgccagatccggcagccgctgggccaaagtaagcgcacaatgctgcagcggctgctgccaacattgcattgcagctgataaaccatagaaaggccgccttgtacctaaagtaccaagaaatgttgagctcaaaaaaaatttttgactggttttgttcatcaattgcaatgaaccgcattggaagggtggactctacctgttctggagcattagattggtcgtcaggagcagcttgaacccggctatgttttcgacggcaatgttgttgaagaatcctattaggccaactattaatccaacaagaagtgctaggacccatttaaggatctgatagtggaagatttgcaatttcccccttgatctccagtcctgcttgtacacttcattctccacaagtctgtgtcatcattagtcaatatggaaaatccattaattaccacacttacattgatcacctcacttgtaaaattgtagtcaaactcaaactagtgttcataataacatactttgggttgtcccttgtaaaattatcctatctctagtcataagatttaagtaaaacttttgacagtcactgacttctcaaatgcttagttaattagtttataaacaaaaataatggcgtatgcactatcattgtataaaaaaattattatacgtccgctccaaaaaaaaacttattatactttataagacaaattttacgtctttcagaaagtgcatgtaaataccaaatttactatattttataaagctactaaattggtattgacggtcaaagttaaaaagttcaaccattttgggaagtagtcaaaccaaatatagtattccatcattagcatgaagcgcgtctataataaaaaatagatattaaaacatacatgaaacatcgaaacaaatctaatcgaaaataaataccggtaccatgaatctctaagggcttgttcggtttaaaggagattgaaaagtattggagagaattgagggggaataattccacaccgcgataggtgtggaataaatcccctccaatcctccctcgcggattaactgaacaaggcctaaagaaaaaaaaaactcgcgagagttagagaggaaggcagagatgtcacgattgacacacgtactcgtaatcgaggctctcgatggggcagacgttggcgccgacgatggccatctgcgacgtggtgttggtgccgcggcggcgcagcagcggccgctccagcccgccgcctccctcctcgatgtccggcatgtcgctctcccacctcaccgacctcgccgatatgggcgttgttgtcattgccgacattggcgtcgagggggcgctctcggctacgccgcccgagccactctctgttcctacagccatcgtcgtactggattccccgcttatggatagcttatttcagttatttacctggcactttaggtagtcgcatcgaaatccatgcagatacaagatcttttacatgttcttcgttagacagctggattttgcaaactatacaagatcttgcactgtatatgtaagattaagacaagagttagttaacgagagatatattaagaaaaatattctgtagtaaaattgtttggataatgtgttatacggaaaaaaacatacaagtacatgtatatgattcggaatactccgtatgatattttttcaacaaaaatatattcaggatatgttatgttgaacttgcatgggaacaacccgcattagcttgtgattgaatttgtcaattcatctccgagaacaaattaggaaaagaattaactattaataatgcagttaaaactcatcgatcaaggcaatgctgcaagggagtacaccaatcaaactaacagcaacatttaccatgaatcaatcaacaaggcgtcaacaaccctaaaaaaaaaagaaaaacaaggcgtcaacagaatcaacgagcttacacggtaggttcgatcttcaatcgtcgtcagggaggccggctaggtcgatctcacaccgaagcgcgggcattgaattgcggtgcgatgcgagcgctcggagaagaggaagaagagaagggatacggcggcgaagcgatgtggttgcaggcccagaattgcgaaggcaaaagggtgattcggtggtgaggcgcgagaggaacggcggttaattagggacgggctctctctctcgccaccgttttttatccacaatgatccgcatactatgttaggttcggcagatgtttttattaggtttttttagaagaatttcgattccgacaagaactctaaactcaaatacataaatcgctagaattcggaataaaatataataacatagtagtagtaataaaagaagagtccgtgtaaactccaattaattaaaattcaaaattaaaaatataactaggaatttgattctaatacgaatctcaaacttaaatgaatatgaatatgataaaaacatgatacaatattaattaaaattcagctaaataatagcaagcagcgtgcttatgaatagaaccggtaatcctgatttgcttgacgtgacatggaccggcgcgagcgcgccagagttacggctcgcaccatctcaccaataggtgggctgtgggcttcgtcgcctatcaacttcgtctcggaataagtctgttcagcctccctcaactcatgcccctggctgaatcacatccctcaaccgcaaaactgggtataacccgcccctaatttccaaaaccgttgcaaatatactccctgagcagtttcgtaggtggttttgtctgacgtggcagtcggctcgctgagtcacaggtgggacccacttgccagtaggcctccacctcatctccccgcctctctctctttcatctagtcctcttctctcctcttccattagcacagacgatgccgccggccatgccacgtgtagggaggacctagccggaaggccgcgccacccgcaggggaggaccttgccggccggccgcgccacacattggggaggacctcatcggccgggaaagccgcgtgcgtgggaagacctcgtcggccaatggctgtgcatggggaggatctcactggtcggctgcgtgaggggtggagctcacaggccggctcctactttggcacccatcatccacgcagggagtagcaggacggcatgaggggtggggtgacaggaatctcgccgtggcgtatctctcctcgccgacgcctcctctgacctcgccatcgctgcctcatctgcgccagagctcagcagtagggcaacagggcggcgaggctcgaggcagcaagatggtgggagctgcggcacctcctctccccaccaccacctcctcatccgcgccctcgccgcagcctcctatcctcccttcccgccgcgttgatggcagcgtcaatggtgttggtgtcggtgcggttcaaggcagcaggaatggtgggagcggaggcgtctcatctcatcgtcggtgcctcctccaaccttgtcggcgccgccttccctccctcgcccatcctctgccgcctcatccccaccctcccctcctctaacctcgccaccgcctcatctcctttctctgcaccgccgcctccctggcctcctcatcccaggcctcccctcctccgaccttgccgccacctcctctcctccctccccgccgtgttaagggtggcggtcaggttgatggcgacgtcgacggtgttggggtcggcagctaagctgttggcagcgtcggcagcgttggggtcctagtcgagggcatctccgtcggccggtttgatggcggcggccggtgggtggtggaggaggtgaggtgaggtgagggcgttgggcgtgggcggtgcaagccgcgcggcggtgactgcctcctcctccctcggtgagttttcaccggccacaccttgcactgacatgtggggctcacgtgttgactcagcatgtcaacagagtctcaaagacgctacgtaggacaaaatcgtctcccaaaccgtccaaggagtcaatttggaatggttttgtgagttggaggatagattatacccggttttgcggttgaagatgcaattcaaccatgcgcatgagttaagagaggtaaagtagacttattccacttggtctctgcgtctcctgaaaggctggcctgctaccaagcaggccactacaaatctggccctaatactgactcgtactctttcaactgctaccaagcctcgaagacaccgagagtccagcttgccatgggagattggaagtctcgaaagcacattggtattggtcagaatccacgatttcttggggcgtagatcaagctggctttattcgtttttgtagattgcgactgcgatgctgcatgatccggacattctgcactgtttttagtggatttctatgcttgctttgtcctcgaaactaactgccattctgcgacaacatggacgtacagcttctcttgtacattatcaaggagagagatgccttgggaaaatgaaatcattcctcgagggatatcctctcgttttgtgcatgtcacctaaatagttataaaaaaataaaaaaaaattggcaacatagattaatatgaaatatatcactccacaaacatgcaagtttaaattcaacttctacaagttgtaacaaaaataacaaatatagttacgaatgtgcgataattattttcagtttaatttgttatttttgttgcaacttatagaagttcaattggtcttgcatgtttgtggagtgatatatttcatattaatctatgttgtcaattgtttttaaaaaaaatgataactatttagatgacatacaaacaacaggggatgtcccctcgagggatgaaaatccacatccatatgccttatcgtaaacaaaatcaccatgtcttatatgtagcaatagtagtagtacttcccatggtccttgaaagaacaaacatgcagtcctagaagcgcaacttccttttccttgaatcctcctctctttttggcatttttctctgcgtatattcatgcctttcttaaattgatctcaaagtatatatacctttctcgttctatgtccgtgtctcgtgttcttgaagctccagatggaagaatcaggaattggagattggagtgcggcctagttcatcttggtatcttatgctagctagtcttccaagctatggatcatctatggcgtcgttaaaatctcctctccttgttcatccatgtcaagcagaagcagctgtactttgaactggccatagtgtagtttgattcactctttgatagcttttgccgtttagctaattgtacagtgttgtacgtctgcattttgttgcattccactgtgacaagcatgaaggccgccatggctgatgaattcaagattgtgctcacgaggaaggagaggttcctctacctcgccaaagccgtcgtgttccttgtgatcttcgcgctcggcgtggtcgccggcctatggacggccaccgggcctcgccggtgctgcagcacatacaccaacattcttttcccgagcaccaccgtgtaccgctaccgcggcggcggcggcggtagcttctcggagttcgtggctccgacgcggctcatgcacgatatgacggacgagcagctgttctggcgcgctacgatggcgccggcgtcgtccggtggcgcgtacccgttccagcgcgtgcccaaggtggccttcatgttcctcgccggccgcggcgtcctgccgctggcgccgctctgggagcgattcttccgtggacacgagggcctcttctccatctacgtccacgcgccgcccgggatggtgctcaacgtgtccgacgactcgccgttctacggccggcagatccccagccaggtgcacgagcacgacacaaacacaatgccgaacaacagcgcgacgccatcattcgcagcaaagcatcatgatctgatcctcgcgatttcatggcttgcttgcaggaaacctcatggggatccataacactcatggacgccgagaagcggctgctggcgaacgcgctgctggacttctccaacgatcggttcgtcctcctctccgagagctgcataccggtgcagagcttcccggtggcgtacggctacctcaccggctcgcgccacagcttcgtggaggtctactaccacaagggcaagacgtgccgcggccggtacagccgccgcatggagccggacatcacgctgccgcagtggaggaagggctcccagtggttcgagctcaggcgagacctcgccgtggccgccctgacggacgccaggtactacccgctcttccggcggcactgccggccgtcgtgctaccccgacgagcactacctcccgacgttcgtcgccatgctccacggcgcggacaactcgaaccgcaccgtgacgtacgtcgactggtccagaggcggcgcgcacccggcgacgtacaccgccggcgacgtcacgccggagctgatcctgagcatcaggaggagcgaggtgccctgcatgtacaactcccggccgaccacggcgtgcttcctgttcgcgaggaagttctccgccgacgcgctggagccgctgctcaacatctcatcgacggtgatgcagtactagttctcctcgccgccaactattgtttgtaacataggatttcacacaacatattcaggtaccaattgtacctgtcaagcaaaaggggaaaaagaagaagaaagtgttcattttgcgggaattttgtcgaatttcctacagtgcgatgcgacaatgcaaaatggaggttggttaggcacagtgcagcagcacaccggcctcattgactgaccaagccccagcctgtctacttgtctcgtggtatcagtgcatcaccccaacttgcagagtcgcagcatcaacagcttgttgccgctgccgcctaaccaaaggtgcattggctaattggcattgaaacaacaaccaaccactgcgtctgcgtgctgcaacaggggacgatttggttgtgctttctaatcaaggaacacgcaggggcccaacattctgatgggggagcctgcactgcaccaacaaccattccagctcttttctcaactttgtgatccaacaactagatcatcgcattcaatttcttcgcacttcactcgagtatgaacgatcgatctattcatggctgtggtccagttcgtcgattttctcggatcggccgatgcttcgctggcccaagaaatggcccattggcaacatatcatatgtaagcagtgtgatgacccttgaatcccttggggtttcagcaactgcagcctgtcaactagtgcagcaaaagcaggggggaaaagcacaaagtaaagctgcagttcatcagccaaggaagggattaggcaaagctgttaccagcacgtccgttgtaactgacgagaacaatcgacaattaggcgaatgattgttagtgcttttcgcaaaagacaatgagcctggagaacaggtggacatagcaggtgggagtggcattgggtacggtagtagaatgatagtatgaagcttcacttttagatacttaaataaatgaagtggggttagtaattaattaaatgggccattatatatggacaaaaagaagagggcgagatctcatcaaaataaacccatacagctcatctggaaaggcatgtactatccacagaagacttggttttcatcatatattatacctgtatatacaagggcatctctctttatgtactcattctgattgtttaacacaaggctgagaaaatttgatacacttggaccttgcatttcaatctcatcaatcccatgcacatcctctcagaatttgagcaagaccgtcgcgttgctcgtcagtaagctgcttcgggaacgcgatctcaaacttcacccttagatcaccccgtgctcctttctgatcggcaattggcatcccttcccctttgatgatcttctcatatcctgggcagatgatctcatcctgaaatgagcagctcaccttcttgccactcaggagcctgaatgagaaggaccagccggtgagcgcgctcaccaatggcacctcggctttcagcaccaggtcgttgcctaccctcttgaagacagggtgtttcttctccgatatgacgaagacggcatcggccggtaggcaccctggcctctcatcccccatgccttcaaatgtgatcttgttccctttcttccaccctggtttcaccagcaccatctggctcacctccttcttgactattgacctgtccaagattgtaaatccattgaaggtgattagtccagcaacactgaaagagagaatccaaggaggaaaggtgcttaatagtcactgtcactgaaccttcctagactaccaccaccatcaacatgcaaaagaaaatgtggatagtgcttattgcccaaatggtccactttgctagatgctagatccaaaactactgtattctaagccctcgacaaacacgtatacgcataagtggcaacgaaagcaacttgagttgagattttatctcctcaagattggatcttaacatgtactaaaccctgatcaacactgctgttattatgctttgtgttaggtaggataatgttgcaagaataggatagataccccggaagagaaaaggtacacaccaaagggaacttgtgtaaaaaggttttcatgtgttccaaagtaagctaaatattccactgacaaatgcaggctataataaagcagtcaccctccactgtaaaaaagaagtgcgccatagcctggaaaggaaggaagtggtcgtgctgtttcactgttcatggatcattttgttccgaacagtgcagagaattggggaggcacaaagcggaatggatgtcgccatcagaacaaattctgaattcttgcctactctgaagtttccaagcatcgatccattaaaattggcatgcaagtgagcgaatcacatcagggttgttccggttgcatcgaattgttagttttaaaagaggaaaatggatggatggatgacaagcgattgctcgccagaattcaggtgaaagctccaatcaatcttggctcacggattaggtggaggaagaaaggggtatacccgttcttggtgacgacgtcgcgggtgaacttgacctccttcttgcagccgtggcagagctcctcgagggtgcagtcgagcttgcgctccagcggcggcgccttgcgcatgattgagctggagaactcggcgaacgcgcgccgcccgccggagttgccggagctgtacaccttcttgaactccctcgccggcgtgccgggcgccatcctcgcgccgaagtcgtcgctgcgcgtcctcgcgatgtgtgcccctccgccgccgaccacgccgcacgccatggccttctcgcccgcgcggccgtcgttgcagcacaccccgaacaccgccctgttctcctgctggtcaaggagcgcctgcgcaaccaagaatcgcccaacatcacgacacgacgccgtcgcaatctacaggctgcaggaatt

SEQ ID NO: 32240 - DNA, 21085 bp, Oryza sativa
cagctcgggagggttccccattggagagggaagagaagacacggtggatggatggatcggtggtggtcgcggaggaggaagaagaagaagaagaagaagaagagcaagggaggggagcgaaatgaggagtttgttacggagggaggtggttaagcggcagaggagaaacacagcgagtgtggctgtgtgggtgagtgagtgagtgagagagaagagtggcttttatgtaggggcatttatttgaactggtgtttagagagagggagggaaaaaattgcatgtggggacatagcggcatgaggggtgaattggcaatggacaaggactggagtggagtggactgcctaccatctacttctccagtggaggagaaaaagaattttgatggttacaaccctataaaaaaattcaattctgagcattatttgaataagtgcatgtctatttcgtaattaggattgtgtttttttttacaaaaagagtatgttctaagctatgggctacaagaaataaaaaattagcagattcattagtttgtttagttacaaaaattggaatacacaaactgatctaggggtactactagtactacaaatataattttagaaccaaatccatcattaacggatttttgccgtaagacggaatcgtaaaaagccgtcgtaatgttttttataatatatagtcctgaagaaaggtgccaactacagagggagaaggcgccaaagacttactgcgtgtacggccgacgagagctggagtgttctgtgtgttgcagtagtgcatgattacaagatggttttatctgatggaggtgaatgattggggaataagaacggcacggttagcaattattgccttgtccgtaccggcccaaatgaaaatgctttgctcgtgcatatgatgtgtgtgtgtgtgtctctacttgatccccccattcagatcaagtggctctcctcgcactgtgctgcctgtcagcctatcacgctggctgagtcaccacaacacatataaaattttctttgtacactatcagacagattgtcatataaaattatatgagctactacgcgtactcgattggattttagaaactgcgagcggggcacgtacgcttctagtcaatggccatgcaaacgccttggattcttctgttcccgagcgcgtcgtctcgtcacggccgtgtgcgcatgtgcgaagctggtggtggagatggcgatcgatcggtcggtcgatggccatcgccacctggtccatctctgtgcagacgcgacgccacgtatacggacgtgtaggcgggtacacatacacgtaccgatcttgatcgtccgggccgatggaaattgaatgagcacgttgtgtagtaagggtggcaacaaaatttgccagcggtgcgtacgtattctgtcgcagggtctggagccaaggtgcgtgacgaactgaccaccagtggccactggggcgttggacatgctgtagttgttggtgtagtggtagttgcagtaacttcttcggatctggagcgatgcgatctcacgtggtagattaattttggagttggttgtaaacttgtagtaaaaaatatactgatctctcgattgatggggtgattgcgaggatgcctgcgatcgacgaacacgtgcagtacagtagagggaaaccgaaaaccggatcgattcgcgattcgagggacaaactgtccgttattagcttctcgaatctcgattggggtgggtgatcaggatcaggattcaggatgcaatccccggcgaattaacaagccgccacgagcatatggtgaaccccccaccgaatcgtccgtgcggcgggcgccgcagcgcgagcccaaagatgtttgtcccacgtactactacgtagtgtaatacagtcgcacacgccgcgctccgcaccgcacaccgggttcgtcctgcggacaccgcgcggggcgagacgttttgcgccccccgcttgcgcgcgcgagattcgcccaatccatcgcggcccggcgggttgtgtgggcttgtgagagcacggcgatccccgcgtttgccgtcgcgcgctgcggctgcctcgcgggcctggatgtgggaaaaggctatacgtactaactttttcttattaaattcttactaacactgatctgtttgtaattttatctacttaattgctcatggatgtgttacgcatcgggtggatttcaccacgtacgcgcggggtgcgcgcgggtggcggctaggctcggcgcgcgcgaggagccacaggtaggtcgcgcgtacgcggcggttgctcgtccacgctgtgtcgcgatctttgtcacgtactacgtctcggctcggcgccgctagtttgggtcggttccgttctgttcgatgggctatcctcgtttctcgtttctcatgttcccttcccggagcgtaattggacatgtggcatcgaaacaaaccccgatccgtaactcatggaagccaatgccgaacagaacggacgtagtaaacgatccgtaactcaaccggacgtagtaaacgatcgcagttacaatactttgacgcgcccgatctacctgccaagaaatccttgtacatatatacagagatcgagcaaggagggtaccaggagactcactcactccactatgttcagtagtaatcgcctcactagggacagtcacgtgaaggtccaagaagccataacgttgcttgcagttggggggtcacttttggccgacaatcctgccgaattaagaccatattactacccaacgattcaatgcaacgcattccttggaaaataaatcatcggctagctcacgctagcttcacccagcaaagcagacatccacaacaaacctacagaaaacagaaatgagtcaatcataccagaaagactattcgacaggggtagtagtagcgacgaagtgacagcgagagaggctgcaacatgggcgtccctgtggctgagtgaaacatgaaaggtgaactggtttgacccccatatgacaagtctaaatcagatcaacatttttagataatgaaaatggattacatctacggcttctgttataagacacacagctataagtttaatagtaataaaaatataagataaaagtaaatcaaaatgagaaataaggtgataggacaaatccccaactcccctttaattattgactagcgttaaaccacataaaatattttagctagcaattcttatggaactacgccacccatagtggaataagagacccttggctaccgattccaagagtgtagcaccattgcgcatagtatcctgctcctcctgtagtagcattgtagaccaaaagtggagccagtaggaagacatgaagataacctgcatagggttagataattgtttaccattaaaaactttatcattgcgacaacgccaaattgaccaacatacagcactagctccaattacaatcatcttcttaatggacctagatacccctctaagccaattaccgaaaatgtttctggcgttacggggtgggggatattaaaagcaaaaaacacacatctccaaacaaactgagcgacatgacactcaaagaaaagatgttggattgtctcttgtgcatagcagaaagaacaatgtttgtctccccccattttcttttagccaggttatctttcgttagaattactttctcgtgaagaaaccacataaagaccttgatctttagtggaattttcaagtcccacagaattctctttttgatccgaacattacagttcatgattgcggtatacatagatttgacggaaaattgaccattcttatggagcgaccatacaaagcagtcattttcatttgacagagttatattagctagcctgaggatcaaatcgtcccactcgattagcttttggtcaacaatagctcttctaaaagagatatttagcggcgttgtgctcatgacctctgccacagtagactgcttctttcgagccacattagataatgtagggtattgatctttgaaagcacgcgatcccaaccacgtgtcttcccaaaatcttatgtttgtcccattgccacatctaaaagaaccaaacctaagaaattggtctttgactttcattaaaccggctcagaactgagaaatacctatcttgctagacataccagaaagagctttaccctttaagtatttatttcgcaaaaggtcttgccataggccttcaccattaaacagctggaaaagccatttgcttaataagcagctattttttatatcaaggttatggacacctagtccaccttgatcttttggtcgacatatgttttcccacttagttagtctatattttcttttccggtcatcattactccaaaaaaaaacgtgacccaaagtaatccagtctttgaagcacacctcgtgaaatttcaaaagaaggataacataaacaagggaaggctcgaaagaactgagtttagaagggccaatctcccaccatatgacatgtttttgcctttccatgtgctgagtttcctctcaaatctatcttcaactcctttccaatcaacattccagagtttccgataatgaataggaataccaagatatctaaacgggaaagatccagaattacagccaaatagttatctatattgatcctccacttccttggctttcccaaagcaaaaaaatcttacttttatgaaagtttattttcagccctgagagctgttcgaatacacataggatggctttcatatcagatcaacatttaattcgtgatttggacactcaaacgaatgttagttacagaagggggaagttggggtgaaattgtgtagacccagtggaaaagaagatccgaatcgcttagctctgtcagcggtgagtgagcaatcatgtgctatgtatctttgttagttgtgatgggatcagcatttgcatccatgctatttcactcgaagaaatactgggagtaatgtcgagacaagaacatgggggatccaatgataaattgaagccaaaagaatccaatgatttggtcattttctctttagcaatttcgttcttagcatttgaaaacgatatacccaggatcatatatagttgatgatattccccgcaagaaaatatatttaattgatgatatattttttatttgtcaaaattagatctcttcaacctaggaaaaacactggaccatactgaaataatcctatttgaggatttttttagatggagcgaaataagtgtagctcaattaactagttagactagtggaacctattcacttgagttcaagttttaggcttgtcacttgatcgggagaaactgagcaaagagggaaacaacaatgaaatttctagctctcaaacaagtagatgaataaataaattgtttttaattaaatttgttcataggttaacttgaacatttgatatctccatttttcagaattggtacattttctttctttttttttccgaactatcggtggtacaatcatggaaaagttgtgtatgcaatgaagaatagtattttatacttaccaaggacttaccaaaaatgctaaagttgtggctattggctagacaggggacccccccccccccccctccgaaaatatacagatatctctcaagaaaaaagttcacaatatgatatatatatttcgtttggcaaatcattggcctgtatattacaagttgttggagcctatctaggtgcgtagtattttcatctcctttgggcttgccttttcctgatagaaaattaagatatgtctccctagctgatgatgacttcgattttgtcctttgccctcctactggaaactgtataatagtaaatgttgcttagaatacagtcacttgacaatgatattgtaggtcggactcgaagccaggagagcatgattagattcttcgttacgtcatctcttcaaactattaggattatcacaaaagaggattagagcaatgtgatgacagtttggcacgcacactgctggcgtccaaatcacaaataatccatgagctccaaggtaaaccgagcaattaactattggaatcattttctttcttcctttcccttaacttggttttccttcatgtctttgttggtacctgtgaaacgacctgatgcaacatcagtatacgacatcatagttaacagaggtgtctcccactcaagtgtcggcagattggggaaagatatctagctgcctttttgcctagacggctatagaacctccaaactatgcagaagcagaaccactaatttttcttttgttcaaatattgtatgcattccatcagattatctttacaaaagaggctctgattgatctgtgatatattgtttgattgaagttttgaacaagtggcataaacaagaaacttctgccccccccccccccccccccaatcttcaaggatgtgattgctaaagttgccaatctttcttgctacaagggggagccttatcttgtcgccgggccggctttgccggccaaactttgtattaagaagaagaaaaattcagagtctgtacagaaaaaagaaaaagagagcccgaggctctcacaccacaggggcaaagcccaaaacatggagaatcacccacgcaccgaaccggacacactggttcaccacagggagccttatctttacttgcatcaatcttcagatgagaggcttgtgttaaaagatagcacaaatcattcatgtcccgggccctgcatatttacaccaaatcatgcaatgcccgctgctattacaatatatatgtacgacacgcttggtctgcaattagtatatcctaatattgctcagagcggagaaatggctgggcctgccttgcaatctattctggatattcttccaatgcgctagtacagtccttagtattcaatacacacctgtatgcattatctcacaagtcataatactgcttaatgtctgaaattaataagtggatgacagatgaacagccgggctaatcttagcaaaaacaaattagttggctagtcttcagaaatacaatgttgaagacttaccttacaaggctctaaatggataaaatcttttgcaagaactttaaattttgcacaagatggttttcgagcctgaaacttattgggaaatgctttttcggcaaatactcttttatctttctggaatgaacttgccggagtaagagaaaagattctgttcgctgagatgtcaccgatcattactcgaatgagtcaatgatggaaaaacaagagagcaatgtgtttaaatacgctctgcctctgctttcttaaatacttgtatgtttcacaaatgatgattccacaaggtacttttctaaattatccacatttaactatacaaaaccatacgcatgtcataatgtcagtgtatgtacacaatatttggagggtattttcgttacgttttactgaaaatataacgtgtctctctccatgacatgaaccactttgcatatatttccaacccaattatccaaacctcgagtccatttttctctaggaaaccaaacatatgatggttactgagtgcccgctggtgcacgtacacgaagtaccaagcgtttcaaaccggtatatggggctttcaaaaattgacaccaacctctcaaacctaacatccgaatattgttcccaacaaccaatgttgtctagtatcctaattcttacatgtccattgacgaacttttcgcgcttcaaatttcaactagccatctatcgatgaattccaatagaaactgtgatttcctattcttcaccagccaaaggggatgcggtttccctgttgttcctgttccgatccatgtcccgtagttgatcaacggcagatatcatcagtggtgggccctacatgtcatattcaatcttcttgattggtttcctcatctcgttgttcatatactatacacccttattgcctcctctctctcatgacattataaacaccaagggatcaatcaaatcaaaatggaataattgtatgaaaaccatcgttcaatcatagttttatgtgatttcacgatcaaaccatattatttaaagcggagttgagattactgaaaccaatctggaatcatttttctctctgaattgctttgcggtgtactttcggcggctttggttcacgaaccttactgaaacggcagacaaaaatcactcaaactgaagcactcaacagaaatcactctcatgattgcaagagattggaacaagggagaatgaaatctctgttttccttttcgatggagatgattcctccaatatttatttattccctgatactgtacaagtaccatggcctatcaatggagtcatgaaaccactacggaagaagggagaagaggaagggaacaggctgtgggtgattaggacttaattcgagggcccctaaataatactcacatgacaaggaaaacatgaagcggcatccagtcaaaggccccggctccttaatccatggctaatcaaagatttaataacatccattccgtacgccatggaatggaatgcagatcttacttaatcttatccagaatctacggccaatggagccacaagctagtggtttcttccgcactgtgatcttagcaacatcacagtacccgcacagtgagcaacttatttttgtctccccaatcataacgagagatgaactactgtgttgaccacctgctgcctcaaccatagattcattcacaggttaatccagaaatatcatgacgcgacacaacatgaagagagcaatccaagaactttctccagtgcgatctggtgtctacatatcagcaagtctaaacacgaagaaaatgacaattatgaaatgtttcatgggcatcgcaatatatcatattatattatatcccattccttttgggctcatagaagctcgttcatgccttcatgtttctgaatcatacagtagtccattgcaaacctgggaatgcagtgcaattaattcctttgctcgggtggatggttagcatccacaatggcgacccgtcaagggtacctggacatattgttgagcaaaagagaagtcaaagaaacaaagtgccaaatcatgctcataacaggtcgtaatctaaatctaggtaggatttcacttcgaagttgttgtagtatgctactgtaccaagcactataagcttcaagttgatgagcgaatctgtagcgatggatctcattgctgagttaaactccttaagagcagtctgcctcaatcgcaagtgttttggtgaccccagggcataaatcttctccaaatccctcgtctgacaaggagacggtacagccattcatgttcagacaggcctgccaagataaagtaaacaacagttcagcacaattataaagtttgatggtcagtaatatcaagatctccatataacttcagtccagaaatagttattggacaactcatagggaactcatggctcctttgaaatggaaagtttttaccctcctatgtgcccaacccagtgttccctggtttggaacagtaaaaacataatataattccagttgctctatggctacaagtcagaactgatggatctaaatccacatgcatcgacgtatatcagaaagtcagaatcaaaggctctcaagttttagattagatgtgcactttttgtgcaagaactgtgcatattaccttctcaacaacagatattgagttcggatggtggcagcttccttgttggtaagatctgcaggttccactggggtttccaaaactcacaaacttaacagaagagatacttttacccttggggcaagacaactgtacttttgctgcgtctctaccatcattttgggtattcctatcccaggattccaagtcaatggaagggtagtgctctgacacgaaggagcacacacttgccacagttcttcttgagaatgtgatctttgtaggatcccctcccttctcctcaaaaatcacaagggtgtttcctgatggatgaaaccatgaccgtgggacatggtaccttgaccaaatgcaaacagaaatgtgaaatgtgagaagtatgaaaaaaaaggtattgtgagctgtgccaaaaatcgtcacataccatctttgagttggctgcccacatcctctcctgcacttatttggagaaaacgttcctctatagtcacaactggaagtacacctgtcactgacaggacttatcctgggccaatacctcccaatggcatttccattcaaccaagccaggcctttccccatagactgcatatctaatccaactggatcatctccttggggaacatcaacgtttacctagaagtatgttgcattagtagtttaccgcaagtagtacgatgagaaaaacacgtatggaaaatatagaccgaagaaggctaccttgtaccatgtcattggttgattttttggtggctcagactgtggcatccaccttatgtccttccccttatcagccttgaacaaactataatattccccttccaatccaatctaccaacaaatacataagattcacataaacattacacctcaccttgccccaaatactggatatgtcatcatagaaagcaaacccaagtacatagaaagagaggagaaaaattatagaatggctttgaaggaacagtatactactttatcatcaattgagttcattacacaaatatctgaacaaattcaacaatcttgtaccttgtattcccatttattggaagacaagtcaattattctgttttccattcctgagatcttcacacttgtaatgccggctcctgcccattcgtacatgggtcctccattcttaaaaggcacacagtttttatcaatcagatgattcaagcatttttaacttgaagctaaaatagcaggcttaacaaactatagggtacagttagaactttcttttgacaaaagtgggtacaattgacatgccataaatagcaatttgcatgtaaaggatatgcctcaagtttagtcatacactcgtatgtaaaactcagtaaacgtaggcacttacttgcaaaccaacagtcatactcaatagggaaagtttgttcttcccagccctcaaattgacgggcatttccacgctgaaatttgattttgagccattaccatatgcactacctaagaaagatttgcaagtagtaatgacattaaacagaagaactcaataattgaagagaactgtaaagtgtatatatgcaaagaaagtgctgctgaagatatatatggttgtctttttggggaaaaaaagatgaagaagaagaggtgacaattatataaaactctcatttcagggatatattttgattatatggaaatgattgggcattcagaagattcggctgaactgaaaatggtattggatggtgatttgatgatggtctctcagcaaagtaagggtaagcaacaaacctataagctcattgttcaggaaagcctgaacagcatggcctttggattcaatatgaagaacatggttgccacctgccagatgacttccatctacgtcaaaactgcatattccacaaagaataaagaccacataattaactgaaagttcatagttaaaaaaacttataatatggacaatactaagatctcttttttggattgttacatgcatatctatttgcaatagaagtagtatatatgaaacagactgcagtataccaaccttgttgtgtaccataggtagtcagtagagtcttttgttgtattaatatggtctacaaatccatttcggactaagtcgatattaccccaaatcccatatttctctctgaaaatgctccacccatcaacttttgatgattccaaatttgcagggaccatatccatcatcagagtttgagatcgcacctaaagatgaagagccaggagctacaattatttgggagaaaagaacttcgtgcaatatggcactttttatataactcggattaagcataaaatattctgatatttgccatttattttgctcctttttaattcctttgctatccatgttccatttgttgagaagggtgctatccgttttgttttgacaaggctttttttcttttaagaaaaacattttttgcagcaatgcatgttgtaattcagaagaccattgacatagaaaatcaaatacctttgcagtgttgaacgccacattcttgcagtcaggcaggatactgaccgaccaagcaggaagatcatacgaccggctctggaaagtaacaactttgtccttttctgaatcaacattagaaaggaatgcaacacatcctcctgattgatcagtgtaaacatcagcctgcaagcaaaaatgggacactatcaattccataagttggtagaagaaaataatgatttaatcaggggataaatacaggagcaaaaagtgaatagcagtgtgcattaaaacaccaatgggttacagtatggtagacataagcagcatttaaatgtacaatgctccttacagcagagatgggttgaagttaatatccataagaagttttgatgcaagctttcatataatattgaaaccagatttaggtcaaaggttataacgataaaacctacctcttgttgaggccccagagaaacaaatgacgaattaccatacaacagggtatgctcgcccaatttgatagatttgtgaaggtcccttagatgagcccatttcggaagtctcctaaggcctgcatttcagatcaactaatactactaagaactctttaggcttaatagtttgatggaattaataacagcaataaatccaaaccatattcatcgatcggtgcatcatagtcatagctagtagtaatgaatggccctccagtagtgcgaccgaaatttgttccaccatggtacttcaaaaggatagagaaaacttgattcaactttcagaaatatggagcttccactagttattcatactgacaaattgtattcaaatgactaaaaatgtatcaagatgcttgaacttgactgtaaatctttggtagtgcaatcaacagaaaacaattatcagtgtgcctttatcaaattaaaatgtaacttctgcaacagcaattaccacatagtaattctgaaggctgccacctttcccaaaaaaacgtgcaacagaaaatgcaacatcttcagggggcctgtggggattactttcgccaaaggtctggaacctaaattcaaataggaagaaacaagcagcagcacatcaattagcttctcttttaaaacatctacaatattaactccatattgtgctataaagacatgagaagtactagatggagtctgttgctaatatgtcaaaatcgttaccatcctggccaattctcagtccaaaattttggcttggttggtgaatttggcttgaattgatcacagtagaatgaattgcaagtgtttatctgcaaaagtaaatttgaatgcgtgagtgtaaccgcaaaagaaaagttactgcatatgcaaaaactttatttacatcagtatcaatcacatgaatatgccaagatgttatgaatcacacaatgacgggaagaatacttgaagacgttatggaaagacaatcctgatagctatagcagtacaaaaacaccaattgcgaggttacgatttcaagtgccacagattatctgctgttcactgttcagtttgcctaccacaatctctcagattttgaaaaaacttttcaaaggattttataccatacactgtcagtgacaaaatatagcagatgtgctggtctttcaaagaattttacaccatacactgactgccagtatgtttcatggagcaattcatggttgaaatgtttcattaagcaaaatgtgttgaatgttagaaactaaccactggatcaggcgcatcatactgctggcacatgatccaagggacaccagtattctgagccagagccatactagctgcccacattgcatatggcttggcaccagctccgtacgcttgttccatatctccgtattcattttcaacctacagtgcaccaattctgccgtcaattgtgaagtacacctatctcaaagttgatagaaacagattgatgtttcagcgccccaattaggattagtatgacaatgtccagacctgagctaggatgatgtgcccaccctgcgaagcgaagaattgttctttcttcatcatatccacaatgtacgtcgtgaatctcttcatgtgagactgcgtaagtaaatgtcagtataaccatcaccaaacttgcaaactccccaaataaaacgccacgaaattcacaagcccgccacaccttgaacggctcattgttcgtccggaacaccgtcccgggcgcgtaatgcagccacaccggcacgcccctgtacatccacgcacacataaacggataaacccatcaacccagagaaatcgaatcaccataattctgcacaactacaaccaatcgtgacactgcatcagtataacgaagaggcaaacccgaaggtccattctgcggcgacgaacggcccaatgcgcaggatcatgtacagcccggcgtccttgacgatcttcgcgaatcgcaccaaatcgaaccgctcctcgaagtagtactgcaatcagcattcaccaatcgcacacaaaacacacaggtttatcacggatcgaacatgctaaatccatcacaaattttggagaggcggcccggacctggccctgggcgggctcgtggccgttccagaacacgtaggtctcgacgcagtcggcgccgccgtccttggcctcggccaccagcttcggccacatctgcgagcacgagcagcgaggttaccggtagtaccaccgcaatgcgcgcgtgctggcgttcggggtggggtgcatacctcggggacgctgcgggggtagtggatggaggtggagatgaggaggcggcggcggccggagatgatgagggagcggtggtcatacgtgacgctcgagttggcgcccgctgcggcggcggtggtggcgccgatcaacggtaccagcggcagcagcaggaggagtagcctccgcaacgagaagtaggaggaggcgcccgccatggccgccgtcgagggtggtggtcgatacggcgtatgagcaagtaccacgcggtggtggtggtggtggtataaaatagcgtggggagggagacgccgcgccgggggagtggggacagtggagtgcagttgtttggattggatgcggcacctctctcggtgtgccgcgccgtgcccacagtcccgacgacggtgtggacgccccatctctcccgccgttccgcgcaagcaaacgcaacgcgacacacgcgatgggcacgcacgcagtgtcactcgcggcttgggttgggcagccggcgcgaggacggtgcgtgcgtgcgctgcagctggccgtggccgatgggttcgggggatagcggacgcagcggattggggatggatatgccgtacgcgacgcgacgcggggagggaggggaagccggggaaccgtggatcgcgtcggcgtcgcggagtcgcggggcgcatccgcgcatgtgaccttggtcgggcctcgggtgacgatgagtccatgagagcgaccgctgcttcggcggtggacccccgtcccgtctcctggacgagtgccacgttttcgtgacgacccccgtgtgatgcacagcctgtacaggggtagtggagtgaagatgcgttcaggatctgtgtccagcgaacggcgctctgtcacagctttcaacaagtttgatcctaacttctcaactcaaacttgtactaccagaaatcgacttcaattagggttccacatctactttccaacttcaacatacaaacaaaatccccgaaggaaaaaaaaaacagctttcgatcacaaaaatgaacaatcaccacttttcacatatctagtgttttatttaaatttcactttggatacttttaggaagctccagggcaggggcatgttgaagccaacctcagacatgcaaaatataaatatttgccattatcacattttgacaaggtagggtgtagagtcaagtgtttgttacatttccgaatttcaaggggaaattatagtattgcgtaggtttgaatttgttgctgcgtatttttttggtaagatagtggtatttttaaagcatgtatggtttgttatcttaccaaaatcagatggtgccaaaatctaatagtgttagaaattgcagcgaaccaaatatgccattggaatttgttttgttccagatttaggcgctacaaattttagcaaactaacaaatcatgttgtttagcccttctaacgcgttgaattgtgttaaaaattgatttagttttattataataatatatttattgttatgaatacaattctctctatttaaaattattttagctaggtcgaatattcttacctttgaccgtattttcttttaaaaaatcatataatttaacatcataagatttaggtttatgttttcaaattcattagagaaagcaattttatgatatatgattcacatgtcgttaagctatataaatttctagtaattaatggtcaaaattgaaaatatttgacttagaacaaatctcagataataagtagttcaaaacgaagggagtgacatcataacaaaatcaatgttgaagatacaagtggttgatggttactcaaatgcacaacgtctagattacagtcgcaaatgcaagtactcaggattccatcaaaaaaaaaataatacacaatatttaaaatttatcctaaaagtagtaacatttttttcacctacattctaatttcaatcaatcacaacatctctttgttcaccagacatacagagcacaatctaatttagagcccagtcatcgagccaagcgttgttgggacttaggagaggagaggagcgtggttaggagggagagagaggagtttatgtgaatgatcgatcgggtaagagtgtgtttagttcacgccaaaattgaaagtttagttgaaattggaacgatgtgatggaaaagttgaaagtttatgtgtgtaggaaagttttgatgtgatggaaaagttaaaagtttgaataaaaagtttggaactaaacaaggcctaaattgggtcaaccacatcagttagtcacttataatgcccttataacctatttgataacactctagctaactccaagagcgaaatctcaagtatagctttggagtagtctgaatcccgcttcatctttttagtttatcttttcagatcactctaacatgctcggctctttttaaaggtagagttaaagcctaaaatcgcatggttggactgcagctatagatgatacttttttcgtcaataaaaaacaaacataatacgacatttgagtatatccaaatctatagtactaaaatgtgttacatctaggtgacacttttttcatcccataaaaaacaaacataatatgataatccattctccgtagtattctcgtattaggtttgtttttttataaaatttgtactaaatatgatctgatggcttaaaattgttgatgatgtggcttcttgcatgtcttactttatagaagtaaatgtctcttaatgggtaccaactatataagaagataggatggagggagtatggatctccaataacagtgcaggcagtggcggagccaaagcccggcttgaacaggcaatggccctggctccaccagctgcacgcaacaattcaccagtaaattagtgcctaattatcttagtaatcacctttcttagtcaccggcaagacagtacaatgcaactagtacaacagtaaacgcgctcaacacaaacttttaaaacaaatgttcatactaaagttatctatgaattatataggcttgtatatacctcatttgttgttagacttgcccgactcataaaaatttttgaatccgccactgagtgcaggttagcccatccgttcgctatcttcgatctgctgttcaacaattccgcttccgccttccagtggcggttacgtaaacgcctggcctcctgttattctccgccccgtacagaaggaacagtagagctgtagagcacacatcattctcgttctcctcccccaaaacctccacttgtttcttcagaccccaagccgatggcggaggcgtcctcgtcctcggcggcggcggtcccgccgctggacccggaggcgattgccgccgtggcggaggcagcgccaccggaggagatgacgctggtggcgaagtggaaagggaacgactacacggtgcgggtggtcggggacgacacgctgggggagctgaagcggcgcatctgcgaggtcacgggggttctccctaaacggcagaagctgctctaccccaagttcaagctcaacgagtgcaaggactccgagctcatctcctccatccccttcaagcccaacgtcaagatcaacatgatcgggtaagcgcaataccctccttcctcctcgaaccctacacctccatgtgccgtcccgtgtctactctcgctcgtgttctgcagatacctgactgcgaaaacatttggttactcgtcgttgaactggatgattagctcgtaattcgggggaatgttggatttcggttggtgattcgaccgatctattcgatccagtggcatcgcgttgttcatgatttgaaattgttgtttatttcctatgggttctcagatgctgggaacggtatttgaagtttgggattgacatccagtagcagtatgtggagacgtttgtctattagattagtttcacgaatggacgtggagtaacgtggagtgactgaggttatgtggtgttcatctgagaggaaggaataaccttctcaaaccttgattcctcacagtttgaacacattcgggagtgctgtagttgcaatggaatcatccgtggagcatgtgaatttattgttaaattgatgcattagtgttaccaatggctgcaaaatgattatggattagtgggttttttaaatagaaaaacagcaggatgttgtttttcttaaatctctagaggcccgttatcgtttcttttctgatgtgtttctgatagtgatgcgaaattggatggtggttgatgttatatgttcagttggcatgtttttggtggtgattgaagaacctgaatgatgatccaggggcaaactagttagtctgtttgtacagtaccatttaagcctatgatctgtgttgatgtgttctaatctgaaagtgtgctttgttgaacttgaactttaaagaaagtctgtttcgagtttggacaataccatttaggccgggagatcagatcatttaccgtttagatggaaaattgaggatttaccctcctatgccaatgacatgtttgagtcatctaaggtcatttacatgtgggtcagcagggtgaatcctcaatttcaatcaaaacggagggtatatggtcaaaattttcgtttagggtatagatctgtgtcctattctgaaagtttgctttgttgaacttgaaaccctacctatggacataattcgattagcttccttttattctgttttataatgtgaagttactcattatgctttgccacttatgtgaatgttatttcttggtaaaatttgcaaactaatttatatgtcagtatgttcttgactgttaaatgcttatgtgctatgtggtttgagccactgatgtaatccgatattctgcacatggttggatcatgattcgttattgctaactaaactcatgctttgcaacagatctcaagtaaatataccagaagagctaaacatgaaaagttgtatatgtttctcagagaacatatatacttccaaccataaatcaatgagataaccctattacagcacatgtgcacaaatgagctatccacaaaaacccaattagttcaagaggttccttattatccgcatgaatcgcaccaactcaaggaatagtattgtgatggcagactcaccaccaccaccactaatatgtcccttttatgtagtagagatcttaattatacacagtaaggttgtatagctggcaaattgtaaattgggtgtagattgattattattgttcattcatgtgataaccttctaatggtgtagaagactaggaggatcttatgctatttatattgggacggctgttacaaagaactttcatttgacacacctttttgtttctaatattttgtccactccatagtacttccatttgtaggatcagtagtggatgcttggatggtgagaaaaatgcatgtaattgcgctaattatgaacacttgtaatgtagtattcctctttagggaaaaaaacatgccttatggagggcttgcagaggaagtttgtgaagcatttaccttgaatatactttggtgtgacacttgtggtttttctagtgaggcactgtgaggtgagagctttgatcctttcctgattcagatctgtttttatcatttccaagatgaaccatgggagatggacctcctcttaatattgatttagcactctggctttactcaacagtcaacagcagcatattcaagttttcagggttttttttttcaatggttcaaatcactcttttgctgcgttacatctcaaagataatggttctgtttgaaaatttgaatttgtacaccatgtacttatgtcccatttgaaggtgctttctatttactttgcattaattttgtatatctttcagcactgttgaagatgaaatatttgtggaccaagaagatgatccagagatactcaatgattatgaaataggccagaatgaagttactgctatcaaggataaagatgtctacaagcaaaaactaaaacggcgtgcaagtcaatataaggtatattcccgtgtcattttcgtttcctgtcatatgcttcttccttatccatgcttttatggttccacaatatcctgtttgttctgacagcctgagccacatcttagtgcttgttcctttgacctacatgaagttggtaatatttcctagcgtggttcaggttgttagtatgtcagcatgtcgattctagaaatattttgtggtttcacttgctcatagaccaaagccataacagtgacgaggggttattctctct

SEQ ID NO: 32241 - DNA, 1473 bp, Oryza sativa
ttatagaaaaattcagcaccatttaaaatatcaaattagtttcattaaatctaggattgaatatatttagataatatgtttgttttgtgttgaaaatactattatatttttctataaacttggtcaaacttaaagaagtttgattagaaaaaaagttaaccgacttataatatgaaatggagggagtattttttatctgactctggcgtgtgtcttctacttaatgtaataatctactactcatacaagtatagtgctttttgatgctgttggttgtgaaagcaggtcactgatctaattgctatcttgttaaatgtacatagacgtcgaatttatcatttatcttttcttcttcctatttctgtagatcaagatattgatccatgccgcaaagggaaaaaactgcttgtcttagacattgattatactctattcgaccataggtccgctgctgagaaccctatcgaattgatgcgtccatgtaagggcatctcccatcaccactattatgttttccaatgagctgtcatgaggattgatgccatattcctcttcacagatctacacgagttcctctctgctgcatattcagaatatgatatcatgatatggtcagcaactaggtaagcgttttgtgatcctgatctatcagttaactggttatggttgtgctgtgaaacaagtaaagaaaaatacaattggcctttgaatgcagcatgaaatgggtggggatgaagatggaccaacttggagttcttggcaaccccaactacaaaattactgctcttatggatcacttggcgatgataactgtgcaatctgaaaacctgtcagaaaagaaaacttttgattgcaagcctcttggtgtcatttgggctcagttccccgaggttagtagtggcgtggtactgtgaatttgtgactgattctcattgaattatttgctcattgcttctgtttctttcatatgcagtacaatgaaacaaacacaatcatgtttgatgacctcagaaggaactttgtcatgaatccacagaatggtcttgtgatcaaaccatacaagaggacccattcaaacagaggcactgatcaagagctggtgaagcttacacaatacctgcttaccattgcagagctagaagatttgagcaagcttgaccatagtgcatgggaatccttcacagaagaaaatgccaagagacgcagacacaggtagttttttctcagtgtattgatcagcaggaaagaaaagttcgccctcctttttgatcactgctattaactgcatagactagaatatcttggattgaccatgacaaccacaatgctacttagaatactctacatatatccctgcgttcgatctgcacaaaaacatttccaaactgcaacagttattttttaaccttcctgtgtgcatttcaacgttaaacctagaagctttgcactatgctcatttttcatttacatatg

SEQ ID NO: 32242 - DNA, 1546 bp, Oryza sativa
  unsure (1)..(1546): unsure at all n locations
nnnnnnnnnnnnnnnnnnnnnnnnnnnnnnnnnnnnnnnatccaacttaaaaaaaatggacactaactcataatatttttattgagttcttaaaaaaactcataatatcgcaacgaaacccggacgctttacatgtgcatcacgttggaccgccgtgatcttagaaacagggccaaagttcttctgtacagtactaccggtctactccacggtgtcactgtcaccccagaaacctagtaaaagggaagaactgccttgttttagtttagtgctattctaactttgtcatttttgtattaaaaaaattgtcatttttagtagctatagaaagaatttggttattgccagaacttttggcaaaaaaaaaaaaaagattagcccttcgtttcgttactaccaaagctatacgttatagaatcaaataagtcaaataattagcaatgccaatgtcttagctaaccaagcagacggctaatatttggaaattatctatgaatttacctagtttcatcgtccaaaaataacttcgtagcaatacaaagataaaataataagaatgttttctactttgttcataggggtgagggtacgttcgttgtgagtgtctacgttgtactgtgtaattaatacaaagataaaataataagaatgttttctactttgtttataggggtgagggtacgttcgtgtgagtgtctacgttgtactgtgtaattttttttaaaaatatactatattaaaattacaattgatcccactgtatcgagtttaatttatccttcatttttactaacttttttttcttgtcatgtaacaaattttacctgcagtatgtcggaagtcaatcgtcgattcgtcgacacggcccagaaaaagggcccagcccacacggggtagcccgaccggcacgtgtcggcggcaggtgcgtcgaccacctcccagccggtttcccgtccaggttcttccccccgtcgtccgtgctccatgctccaagccgcatccgcgtctctcgtcacgcccacaccaccacccaccaaccctccccttccgtcttcatcaatagtagtacgcctcccctaaaaacaaaacaaagagaagtccaccacacatccccccccccccttcccctcctcaccttcccttctccggttctcagattccacccaatccgccgctgcgtcgcgtgtgctgttcggcgaaattccaagccccaattccccacatctcatggttctctctcccatcgcctccgccgacgtcgaccgcctcctttgctgctgtcgccggtgttgttgctgtcgccggtgttgttgttgttgagggggtaacggtggtggtggtggtggtggtgaggggttagaggggctagggttgcggatttgcggccaattggttgggggattttgaagggggaatggatctctcgcggccggaatcgtcggacctgtcgctgggattccactcgctcggccacgcccgcgggcacgcggtcacggggccgctgcggctgttagatgacatggaggacgccaagccggagaagagc

SEQ ID NO: 32243 - DNA, 13227 bp, Oryza sativa
ggacgtgcacgcgctgatggagttcgagcgcgaccgccaggtgcgcgggatcgagctgatcgcgtcggagaacttcgtctgccgcgcggtgctcgaggcgctcggcagccacctcaccaacaagtactctgagggccatcccggggctcggtactatggcgggaaccagcacatcgacggcatcgagcgcctctgccatgagcgcgccctcgccgccttcggtctcgaccccgcctgctggggggtcaacgtccagccatactcctgcacctctgcaaacctagctgtttacacaggtctcctcctgcccaaggaccgtatcatggggctcgagccgccttccggtggccatgtcagccacgggtactacacaccaagtggtaagaaggtgtctggagcatccatattcttcgagagcttgtcgtacaaggtgaatccgcagactgggtatattgattacgacaagcttgaggagcgggcaatggatttccaccctaagattctcatatgtggtgggagctcataccccagggagtgggattttgcacggatgaggctcattgctgataagtgcggtgcggtgctcatgtgcgatatggcacatatcagcgggcttgttgcggccaaggtaaataactaccataaaggatcatttatttatgttgtatgaaatgtagcagaattactcaaatcacgactgaaaagcctagttgttagtatggtttgctgctagctgcccagaaacgtgttgaagaagagtttcaatctttggctaccttcattacctggctatctgttaagtcctgttgatttgaaccattcaacatcacaatgcaagattttctttatcatgtttctaatgtgacgattaggctgatactatagtcctgatgaaactattttgcagtcagttatcaatgtatcgtattcaaactgagtttgagcatagtaatcatagaacatttttatttttagagaacctaaggttacatttctagtcatgttcacataagttaaagataactactacagaattatattttctgtgagtcaacgttgatccatgctagttctgggattttcccctggtgatggaaatcatgctgatgaactaagttactagcacatgttatcgctattaaccacaatattcaaactgagttgatactgtagtcctgaagaaactattttgcagctagttatgtatcatattcaaactgagtttgaacatagtttatcatagaacattttgatctttagggaacctaaggcaggagtaacatttctagtcatgtttacatctgttaaagataactatataactatattttctgcgagtccacatcgattcgtgctagcttatggggttttcccctggtgatggaaatcatgctgatgaactaagttactagcatgtgttatcgttattaaccgcaatatcttatcaatattcattccattaagaaactgcagtctccatgtacgtcttactgctgttttaatattaatacacaatataatattttcaaagcatttttcaatgtcatttttatatggcaacttgagatagtttcacatatatgttatgtcaaactttgagaatgatgactaggttatacatttagaaacatatagaatagcttttgttagaattatccttaatcagtttgttgcatttttcatgtttgcttagatgctacctacacttgctactcttcagaaatgttttatttccttaatgtgtggcatcattgtgtgaagccgggggtctgccccctgaatcaaaataaataactacaaaagttcttagttggttctactgctaaatctagctagttcaatgttcttgatgttcatattgtaatagtgatattgttgcatgctccttactgttgcgagattcttatttatacaagatgctcatactgtggttgctgagcatttattgactactgacagtttatttcttgttaacttttgcaggaatgccgtagtccctttgattactgtgatgtggttacatcaactactcacaagaatctgagaggtcctagaggtggtataatatttttcaggagagggaaaaacttaaggaggcgtactggatctttttctcaagcggatgagaatgattatgacttcgaggacaggataaattttgcagttttcccttcaatgcaaggaggaccccataataatcatattgcagccttggcgataactctgaagcaagtagcaacacctgaatacaaagcatacatcatacaagttaagaaaaatgcccaagctttggcatcagccttactcagaagaaaatgcagattggttactggtggcaccgataaccacttggtactttgggacctcagaaatttaggcttgactggtataattctgcctactgttttcttaattaatctgtttgtaaacttgtgatcagggggtgtgttaatttcatagtgggtgcctggaaactgaaatatctctgctatgctaatgtagcttagcacttagtttttggaaaaaaagtctatacgtacttagtttttcttattaaattcttactaactctgacgtgtgtcatgctatgagtacatctagttatgttataacttccatctagataaacgaaacggttgatatcatcgtttgtaagagttttgtaaaaaaaaatccattctttaattgcttaaagtcatgtctctagtactattgctctttgacactttatttctacaatttagatgtggaaatgcatgtggtttctaatgtattgtgttcaaatttttacaggaaagaactttgagaaggtctgtgaggcatgccacatctccataaataagatgccgatatatggggataatggctcaatatctcctgggggtgttcggattggttagtgcatacaccatggctgttttttcttactgttttgtcatttctacataaaacatagactattgtattctacttactgtcatgttacatacaggaacacctgcaatgactactagaggttgcttggaagatgactttgaggtgatcgcagatttcctcatcagagccacccaaatagctagtaatcttatgaaagaacatggaaaaatgcagaaggaattcctgagaggcctacagaacaataaagatatcatagaactccgtaaccaggttgagaattttgcatcgcagtttgcaatgccaggttttgatgtatgagtgtgcatgtatgtgtacatatcttggtgaggttgtccagattcatcaggaattagcaaccgtttcactctttgccgaagtgtttctttcaacaggagcagaatagggaaagatcgttttttcttttgttggaaattggtcttgactgaagctgtacatgcatacttctgagttgtcatttatgtaacgtattgaaccttcatataacggctttgtataggagataattttcctccatgcgtaaggatcttaaatctattttgtgtttatgtctagcctgaactgtattgatccagatgttacagggtagttgtgatatcagtagctgacttacgtgcgccctgcctgcatgttgttgttgataaccagaagccctgaacaaccaagacattacagtgagactagtagtaacactatcagtatagcactgacgcattgacaataatggctgtcaagatctgactatttgttgtactggagtactcctactcgctaaacgctgtaagccaagcacagtgcaggttgcatcatggtactcccctgttcgctgtatagggagaaacccatcatgaagatttggtatagctggcatgttaggtaggagtaggagtaggagtagtagcagcctaattccggttgcagctgagatgggttatcatctcctcttttgacccttgcctgccgcctccctcgctcggttttgtttttgcccgtacttgaccattgatacgcttcttttcggccatgatttgcttcgctccggtttgttgccgatccatggacatcacatcggtttgctccgtttttcctccgtgcaaatgatggtgtgcggcgtccgatccatcgatcgatcgcccgatccggggggcttaaggcgaagaaagccacgacacaggtccttttcttcaatgcggagcagaaagcggcgcagcttccagctgccgttccagaacccctttaatcattgcgaccatctgctctgcttcttgggacatcaatccaatcagacaaacaccaaaagccggaggagtagactagcaggtcgcagctgcagtcgcagtgtgtgttgtgttttacactgatggtgttcagttgctcatctctctgactctcaatcactcctcccgaatcccttttatctttctgggtgtgtttagttcacgccaaaattgaaggttggttgaaattgaaatgatgcgacggaaaagttggaagtttgtatgtgtaggaaagttttagtgtgatgaaaaagttggaagtttgaaggagtttgaaactaaactcggcctctgtctagcatctctcctgattagagacaatgaaacattagttaagctttccttttgttgccttttcttttctcattgagggggatataaggaatctaaaccccttttctccccctattcttgttctagtggagtccttaatgatgacttatgaggaagtgagctcgccactaccagtaaagaactgatcactaggtataagggacaaaaacaattgagagagaaaagagggcgagatcttggcatttcacacttccttttaaggtcttctcgtttctcagtatcaagtttcacagtgattgattaatcacctaacctagaaaaagaagttgctgatagcaaatggatgtgtcttagcatagattcatcagtcatcacaagggctttttaaggtttttggttcaagcctatcccaattcatgatagctgacagttctaatatgaacaagagacaattagacatactcacataccatgtcattttagtatctattttaaaatgagagacataataaattactccctcctttataaattgatcatcatataatagaatctaaaatttctcaaattgatcattgtataactatatggacaaggattttataggaatacaattaatgcagtatgagagaacgtgtgcgtgctagggtatactcttaattgacatggagttttaatcgatgcatacattatgagagaatgtatgcataatatctttattgatgtgatttaaattatacttagttttggtgtataaacttatacgatgatcaatttataaaggagaaagtagtatggtagacgtaattctcatgcagatgcttcatgcttcccatgagaaagaaagaatgggactcttgatgctgaagctggaagctacggtctactgggcgtaggagagaaccaaagtttcggccatttttcgcattatggtagaactctgatagtagcccgacctacggcacgtctgcctccccaggcgaacaaacaaaaggcgaccccttccgtcgtgcaactgcaactgcctgtgctactcctgcaatgcaacaagaaagatttcctttctctctcatccccatcatgcctctcctttcatggcacctttcatggcagagacgcagcaacaggatggaaacaacagcagcagcagcaacaacaacatcatgagcaaaatgctgtgacagcgacacactctgtctcatcgagtaccactaactactactcgtactcgctactgaagattatgcttgctactactacgtacagtacgagtactctaccacgcgaagcatgaagcatttcatgccatcatccatggcgatgatgatggtgttgcagtcgatcgatcagtggctgcaaaggtcggagagctccttcctgccctcgacaatgtcgtcgaggaagtcgtcgagctggcagacgaggccgtcggtgccggtccggagcacgtcgagccacgccttgagctcgtcgaccttgtccttgacgccgccgtcgccgtcctcgcactgctgcttgcgggggcccgccgccacggcgcgctccacctcctcgtgcgccgcctccacggcggcgcgcgcgcaccggaactcgtacatccggatgcccccccgcgccgcgccggcgctaccgtcggcgtcggcctcctccgccatcctctgctgcagcattgcgatggacgccacgaacccgccggcgtccgcggcgccatccgcggagcacggccccgctgcggcggcggcgcaggagacggcgccggaggcgaggacgaggagcagcagcgagctggcgttgtgcagcgcgtagagcaggccgcggaagccgttgaagccgctcaacctggcgtccgcggcgcgcagcagcagccgctcgtcgagctgcagcgacagcggcgcgatcctcgcctccgacagcgcacggttctcctcctccgccgccatggcctccctcctcgacgcagagatcgccctcatcacctgcaccgatcaaacaaatctccataaacacaaaaaaacagagcatccaacaaagaacacatagtagcgatcaatcgatcaaacacacaaacagagcaagaaccactaatggcgtgtcgcagcacagaaacaaacacgtttcgcaaccaaccaacctggcgagtggagagaggggaagggtcctggagccagtcatccatggcggccgcagcacaagacgcggcagcgcaataccgctcgacggcggcaaggccgaccttgacggcgaggcaagcctcccagagccgcgcggtctcgtccatgtactcgtcgagccaccgcccaccgggcggcaggtggagctgccccaccagcagcgtgagctgcgagtgcagccccctgagcagcgccgccgcccgcagcagcgccggcagcgacgacagcccgccgccgctgctcaggtcgtccagccctctcgccagcgacgtgaagaaggcgttcatggcgaaatccccacagcaagaaagatcgaacaccggtcgatcgatgcgtctggaaggtcgagctccgcctggctatatatagcgcgcggtgcaagaagggcaaggagcagacgatcggggaggaagaggaggaggcggggggcgtggaggggcaatgatgggtgtctatacgagggggagaagggtgatgatgaggttggggggaggcagaggcacagccatggctgatgtctcgctcgctcgctcgctgctgctcgctgtgctgtgtgcggtgctctggtctggtctgtggctccgcgcgcggcgtacgagcggggcgcgtttaatggctgcctcctcgcgacaccgcgcgttgccgggtttccggaggaggttaggcttaaccgccgtctttcttcggtttcactgcggatgttgtgggaaacaattttaatttctagagggcatcctcgtatttttaaaacacaacagaaacataggtaatcataaaacacgcatactcatcgctataaataaacacgcacacaatacatctataaacattttttaaaaaagttactgtatatacgattatgtagcgttacacaaccaaatcccatggtattttctagccgtttctaacgaagtaacacgtgacattcactatctgttagcaatcgtataattatcgtacatataaatcgtatacatagcattttcgatttttgaaacactagaccgacatatcctcgtcaatcatgaacgtctcactatcgatgattacgtcgcctgcaccgaaagaatatcacccatcttaagcctagaactttaatgggtgatttggttccgtcacaagaaaactaactagttaaactacgtttagttcgctagttatttacatattatcaaaataattaggaaaagtataaaaatttaacgagatcaaactccataagcctacaatattaatcaagttaaattttagagtggcatatcacatattaatatatcttgtcagttttaaaaaatattttataatgcaaacataatgttactagtagagttcaagatccattccccatgtgtttttagccatttctagcgcgtaccgcaggggggcgttggtgggggaggttgttgctccatggggtggcccgcctacggtaggggggaaaaacatacctaccagattatcagcttttggtgaaatttctccaccggaatattgcgctttctgcatagttcagcggtcaaaatggcatggcatggaacgtccagtccttgactacggaaacaaaacaatcgagcactagaaacagtcttggagagggacttggtcgtgtgtggtttgtatggttcactgaacttggagagtatagtagtagtagacttttttttttggcattgaatatttgcaaatagttcagctgctctagcgatgccattgagtggttatgttggctaaaatgtcaaaccaactgcacattgtagccacctctagttacagttaccaaggattctctcatccatcctttagatttttttgttattctttcaacatttgttcatttaaaaatttgaaaataaatcgtccataccaaccaaatttaaggccaaatgtcatgccaaagaatttttgtagcgcaaaaagccaagatgtggcgatggtgatttactatactattgtggagtaaccaaatcattaccacaccatagtttttaacccatgtggtaacattgtcttgtcatgccactaaatattgtcactttgattatgttgccacctactgacttgactcttagcatctgcagccccatcgtttggctttttccctataaaaataaatttatattttatatatgtgttattggtggcctaaaagctaatactgaaaaagaaactataataaaaaaaatctcaaaattaagtttaaaaatttaaaaattgcctttttttggctgattaggccatccgataggagcctatttgttggtttgcgcagccaagatttaaattttaaacttaattttaagttgaatttgggatgttttctatcattgtctatttttcaataccgtcttttagtctgtgaataacataatttttatctataaatcatttctgattgcttcgttcatacttctataacaaccaatggcatggaccaggataacaaataagcaaaagccactatatgaagcggcaaaatagaaatatcctttttaacattatacaaaaacatcaattttttttaaaaaggctcttttccatagaggaaaaatatattattgctgtgaggaatatagagttttcagttctctcagtaaaaaaaactgtttttctatagcttggtaggattaacttattttagccacagggacagatatgatgagtgatggtgcaatttaattaatgagttaattttactttgggctatgttttattgccaaagttttattttggaccaccatttatctaatcttttcactttggactaggtaactttacctttgtcgcataatggaccaccccaaaacacattttcatttcttcgatgacttcgagcaaattgttaacgacataccagcaaactttcatatctatatgcatgatatactttgtcgaaagagacgctagacatcacaagcgaaaagagttagggttgtccattgtgcaacaaagataaagttaactagttcaaagtgaaaagattacgtacagggtggtacaaaataaaactttgataataaagtacaattcagtcttaatcttatttgtcacaacaacgcagatagtacaaagtagaggcaacttgttctgcttgcgaattgtgaactgcatcagtattctgcctggtactacaaatatcatcagaaaaagcagtttcctttttgtaggttgtggatcacgctccgacaacacagcgtagggttaaattaagctatgcgatatttagtaccatcaatcccatcagtccatttgacatcccaagcatgcgttattcgattcaatcttatacctccctttcctccccctttattccctttccaactcagagatgcaaatcttatcctgccaaagccactacatatcatagctcactcgaattctcttctacagttcatcccaactcccattagcaaggagctaaagatcttcactacttttacaccaacgaaaaacaattatactcattctgtatcttcagacaagatcacaagagtccagagacatctagtcgaaattattgcaatacacgaacagttacctaggtaaggctattttgtacttttatagaattccagtagaaaacatcctgagctttaaatcatgcactattctcctgtttattcgggttgtcaaattgaccccttttttgtttcccctcctttacatgaacagtggctaatacttcctccgtctcagattacaagacgttttaactttagtcaaagtcgatcaaattgtttcaagtttgattaagtttataaataaatatagtaatatttataatactaaattagtttcatcaaatcaataattaaatatattttcataataaatttgtcttgagttgaaaatgttactatttttttctataaatttgattaagtttaaagcagtttgattttgaccaaactcaaaacttcttataacatgaaatggagcgagtagcaaattaactggcgccattgtgtggcatgatttcagcgttgtctgcttgccatttggccgtctcagtaagtttcagacgaagagttaactgtcagggctagtgtactcagatcaccactccctgctcagagagggacaattacccgacatgcatgggattagcatggttttcggtctgagcagcgaacttcttgtgatgcgcctttgcgcctttgtgttcccatcttgtcaagcactgaaagatgatcaatcctaatcctgctctttgtgcgcgtaaagcctgtggagacacggcaaaacagcctcgtcgagcagggacatgaatgatgataccagccatggaaggtggtcatggcagctcccaagcaagaggacaaaaacggaaggctttttcttcagaaatgagaactctgaactctgaatgtctgaatggaacttctttgtatgctgcataatttcttttggaaacatctgaaagcagggttgtggttaattaaaaaaccggtctactagaccatgaacatggaacaggagcccctagctactatgcttaccgtaaacgcatgcaagaaacacttttgtattgtcacctgctgtaatgagacatctttgcaataactacagcaatttgagctaaaattggtcaacactatcatgcttagggtccccaaattaaactgcacttttgactaagaattggcagaagctagcggcagcaaattgttcctttccattggacatattccccaactcattatttaacgacgcttttccattccacttgatacgctagaagaaccgtgtggtttatcatatctgcaaaccaaacggatgcaatcgctaatcacatggataaatcttcgcaaaagggagagatttcgggtgtgtgcgtgcgcatgcgttgttagagctgctactcgtgggatcttggagaatgtgatgcttgtagaaagaaacagttaaggggtataaacaaatgctggagaagcaaacaggatcctaaaccgtgatctcgcgtaatctaatcacggtctattgtatcgccaacatgtgataggtgtctagaagcttgcattttaatactaccggcaaagcttgatttgcctctgctaatgtgatccaaacatgataaaccggttttgtatccatccctgaattaggtattctcttgccttctgacagtgtgatccaaacatgattatccggtctgtatccatccccgaattaggtactgtcaaatacagtgaatacactattgtcatgtgtatgcattctgaatataaaatagcccaaaatgtcatgtgtgaccaagttttttatgaagaacacatgagcaaatcagcgtgcattatacagtggagtacacttaatcctgcatttattttgtttgctaaggagacagggagacgatggagttggaaggcatgagatttgcgctgcaccaacccacatggatgaaggattcaagggggacaaagactgctgctgagcctcttgagtgagtcccatcatggtcactcatggcagtaattatggccgcaattatgcctgcccaaaagcccacagggcgggcagggccaaatgcaagtatgcaaccgaccctaatggaggggattagcaataatttcctcgtttgatgcttttgaccaccgatgatatcagcactaatcacaggggtggattgtacacaacacactacacaaaggccaaagggatccatgcatgatggtgctgcgtttgtagggcactcggcctagacagaacccccgaaaaggctgcaaaatctgctgcagctgcaatgtgagctgagagtgaggccgatcgagctcgagctcgagctcgagctctcctctccccttcgattctttttggacagtgcgtgagctaatggccccggcctaagctctcctctccccttcgattctttttggacagtgcgtgagctaatggccccggcctaattcaatagggccagtatttaatagtacgggcagtctctttttccctgcagggcttgtcttggccggtgggtaacacaatctcagaatcagtactgctaatgatccgcttggtttttaataccgctacaactactagcactactattcctagttgcagaacggagagttgagctaggctgtaaagatcgcggagcacgagtaattcttgcttggatgcatggacagatggatgcgtgtgtgcatgggtgcagctgcagtggcgccgtcatcatgtggttcaatattggggcgagcgaaatctatcatttgtcgggccgacacgccagcatggacggatcgacggacgctggctggtctcagccgttgctcctgcagcctccgcgtcgacggggcggaggaagacgagaacgagacagcgagtgtgtgcgcagccagccggccaggcaaggcatgattcggtccggtctggctgctccgatcggcagcgcgcgcgcgcggcgctgtcaaccatgtggcgctgcgcctcgcggggaaacgacacggcgcgcgcgcgcgctgcgtgacgcgttcgtttcggttgcatgcgaatcgcggggcggatcgatcgtgccggatttgagtcatttggcgggggggggggggggg

SEQ ID NO: 32244 - DNA, 6190 bp, Oryza sativa
ccggggggggttggggtgctggttatggctgcccgctcggcgccggcgttggtggattcctcgtgtgcttctttcggattgatcgatcttgttggctgcccgctcgggaaatggcttggtgcgtttgcgtcaggagtggtcgccggctcggccgggtgggtcgatcgagttgtaggggccgccggccgcagcatcacatgctcgcctgctgctttgctttcatctgctgcgcagaggtaaaggggttattagtgaacggacaagatctacaagttttcagtcatgccggcacggactttccatcgggcctggtccagtaaaaaaccaaaaaaccgcgggcctaaccgcctaagtcatgtatgcaatcgttgtgtgggctagaaccaaactcctgcgctttcgaagcccaataccaaccgaatagcagcgacgacgtaacgcggcccgtacgcatgcggtccgctctcacagtcacagcgtacgcgagcggagcacctcgcggcgcggcccaaaccaaccaagtgcacgttctgcctgcgtcgcgtctcctacacgttgccccagctgtagattggcggcccacacgcaaccggcggccgattcggtgtcacccgccagttcgccaccgaggaggcgtcacgagttgcaatgaacgatgcaatggatgttgacgttgcaggctcagaagatgcaacgagttttgaagttttccggtcgcgttgcagctgctccggctttgctgacgcttttcttttgctactcgcctgatgatagaaccttataggttgacaacaacgagagcgaaacaaggtgcattgttgtcggttgtccgcttccggttgtctacgacgaacaggcgctgaaccgtggtggattcatcaacacgactacagtaccatctcacttcccttacgcactgcacagtggactctgccggcgctctctcgcaaagctggactttgcaacagtcgcaaactcgagtacaaatctggacttcagctggtgcaccgctgccgctagatctgtgaatgcaagtctgcaaccacaacactttaaggccctagctatcggtctgaaacagagagacgctcattcaactataccctgttactattactatatgtctcaactctcaaacttgcgtaaacttatcaaggatgtgcccacaggtgaacaggccacagtctacagattcttgtctttgtccggttaacaggccccgtatcacaaacgggtcccggtggggacaccgccgcagccgtcgatgggagcggatgaacggctaaaatgcatcgtgatccggatctcggccgggaccgctgctgctgctgcgagagttgtagtaaaatccagcggtcaggagctcaagaagcgaaatacccgggcagcattcaattccgctgtacgcccgcttggcagcgccgctgctgcaccaccccgcatccatccgctgcggccacgagactcggtggcattgcttgctggctcgcgcgcagatctggtccggtacgacgcgtgcacggtggtgggggcgacgcgtctgcacggtcgcgcgggctcccccaccacgacgcgcgcccgcgcccctgcccgatcgagcgccgggacggggacggagacgcgattggctcgtacgcgcgcggggggcatgcgtgtgcccggcgccccggcgcgcacggacgcggagacgcaacattttgtcccggggttcgggacgtgacgtgctccaccgatcggggttcttgtcgctgaatatcggtgaagtgtcggctcggttggagacgagtagccccggtgtcgagttactgttcctctctttggatttactctactggctatatataccgtgttggctgtttacccgccggtaattggaggtttgctacgatgcgtacaactactcaagcgagtaaaaacaaattcttttaccagtggctgcatccatggttgcactgcatcaaacgttcgtgcataaagctgagctcaaatcattacgtactccctccattcaaaattgatctacatatttcataggtacactaagaccaaaaaaactaataactctctcatactatatttattctagcaacaaactctatgcaccatccctactattttcctagacaatagcaaatcaatatattgcatgtgttataaatacttataaatacttgtgtgcatagatgcatgtatcaatgttcatttactccaatgcacaaataacgaatagacttaatgaatgaacacaaatatatagatcatttagtaataacctcaaaaaaaactatatgtagatcaatttggaatggagggagtagtatgtaccgctgtgaaactgtgaccactcctcatcccgagaggcgagagtcacggtcatcgtagggtacaaaaccacaaatcacgatgaaaaatgcgtgtgcatgtccgatgaaaaggaaagaaggaaaaaagaacgaaaatgatatacatatgaccctgttgtccggctactgtgtatgactctggtcacatggaaagacacagacggtaaaagtctcactccgtaatagaatctgacatacgtagtgatgccataacggagtcggacgctagtcgaacgctggattcgtatgtatagcagcgttcaacaaagaaatgcgtgtgcacgttcgattttaatcagcgaattattggtgtggaatttccgtgcctgaaacatgggcacgcatctgttaaataattaatcgactctcgggctcaccgctcacgcgaatgcaatcaagcgccaggtgattaacaccgtacaggggcagttagcacagcggagtacgtcacgattttaattcagggcttaaatgaggttctgactgccagcgtggaatagtactccgtgcttgtgagttttgacgtggagatggaagcttcacaagctagccttcgattgcttgtgcctggaagagaaaaaacaatttcagggccctttgaatcgtaggaatgaaaaaacagaggaataggaaaaacacaggattctgataggaatacaattgtaaaacagaggattgcaaaacacaggaaaaacacaggaatggcagtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggattttttttcataggattgaaatcctccaaaattcctacatttttcctacaaatcaaagtggcctcattttttggccttcaacctcacaagagccacagttacgtgacatttcctgcccactctctgccttgatttgatgttttattcgttcttggccttttcttaatagtactagaaacggttcctttaatggagtagtatagggtgtgttcagttgacgctaaaattagaagttttgttgaaattgaaacgatgtgacgaaaaaattaaaaatttatatgtttagaaaagttttgatgtgataaaaaaaattaaaagtttgaagaaatagtttgtaactaaactcggccacagccgatcgatcaaacaaggatctcgtgtagtagtgttgaatctaattatacattctatacacgccaagtaggaatattgtatagtgtagatccacggctcaataatgtctccatacacatatataaaaatcgattagtagtactaggtgcaacgaatttccacggcgcaacatttacacctgatgttcatttgtaacattttcccggtccacagagcagtaaaaactcaggctatgcacttcatggcttctttatttccttgctccatttgggttgccctcgcagcaaaaccggcaagtagcaacagtaacctagacgagagcagcatgtctccctgtaataaattctgcaagcaaactaagcacaatatgggctctctcgcagtagatgagctctgtggcttgcatgcagtagtatatttgccaattgcaatgcaagcctgcccatggcatgcgatcatcttgtgcagatgacacaaacaatatcaggtcgcccttgaagcaattgcgtgtactaaaaaatggcaaggctgttccgtcgaggagcgaggaatacgtaagaatctactcctacgtacccagctgccatgctgctgcagccatgcagagcaacagaggggctagttgtctcgtccatccatattcactgagcggccatgaagtactattcacttctcacgataaattacacagaccgtagagatatgcgtgttcatccagctagccttgcgtgcgtgagaattgtcagagacatatagtagtactattaagttatttaagtgtgtttttaggtgttaataacttgcagactggtcccaggaaatctatatggttttagggtgtgtcttagcagtattgaaaacagtgcgcttcttcttcttctcttcttggctgaccctaagctagcttcaaaaacaaaacagtggaaaggggcagtagggctagcatagcacatgcatgtataaaaacaggagtttaatttgtatcattttccaaaggaaaaaaatgcatttggaatgcttacggtgcatgatacgtatatgtggatgtcctgccaagaatcccgcacattacgattgatgccgtattgaccaatccatctcttggtttttggagctaacaataatgccaacgaaaaccggcagattctttttgcgcgcccgggcatgcacgaaacatatccgtaagcatgtgaaagggtatagtataggccaccggatcaacaacagtagatagtacacatacgtatatacgtcgattcgattattactgtggcattaatttaccacttcagcctcagtgtactgcaacagtgagtaaaaataatctcttcacactgagatgatcaaaggcccaagattaattaataaacacgagcatatgcactttgaggatttgaaaagtctggattttcagtttgttttccttctagttcattatttggatataattatgggctctttgaatctaagtaagaatatactagctagtagattatttaggttgtgttcttttattgaagttaccaactcaacaactctcgcctttcttgtacacgctttttaaactactaaacggtgtgtgtttttataaaaaaaaaatacgtaaattgcttttaaaaaatcatattaatctattcttaaaaataactaatacttaattaattatgcactaatgagtcggtccgttttaacgtgcatgaaagattagttcccaacgccttaaaacgaatacagccttaaagagctaaaattctaggagaatttgaggctgccagagcctagaatccctctggacacggcctatgtacttcaggaacatatcctatcctatatgtacacaagcattctcgtgcacactaactaataaattcccaaaaattctttaaaaaacacatatgtatttttatagtattacatctacgtgtaaagtttcatctttaaattcatcatacataaaatagacttatagtcttaaaattgtcagtttttcttaggactaaaatataataaatttaatgttaacatattttacacgtaagtataatattattgaaagtatatgcacatatttttctaaatttttcgataatatttattagttgatgtacgcgtgaagcttatgtatacatgatatattatcgtgtcactctgcacagatatgcagcagtactcttttgtctgcattaagtttttttctgcacgtatatactactccctccgtttcaaaatgtttgacgccattgacattttagtacatgtttgaccgttcgtcttatttaaaaaaattaagtaattattaattcttttcctatcatttgattcattgttaaatatatttttatgtaggcatataattttacatatttcataaaagtttttgaataagacgaatggtcaaatatgtgctaaaaagtcaacggtgtcaaacatttcgaaacggagggagtataccactaggagattactgtgccgagctagaaccttaaagatgagctagagtaagtaatcagtggaggagtattcactaatcagctagcacgggtgcaacacgctctcgtgaccacccccccatcccctctccttg

SEQ ID NO: 32245 - DNA, 3266 bp, Oryza sativa
ggcaggaggaggggctcgaagcggtggtcgaagaagagggcggggaggggcgggtacggcggcggcggcggggggaagggggacgcggccgcggccgcggcggcggcggcggcggtggccgggaggaagcgggtgatggtggtggtggacgacacctccggggccaagcacgccatgatgtgggcgctcacccacgtcgccaacaagggggacttcctcacgctgctccacgtcctcccgtacgccggcgccggcagaggcgaggagaccccctccctcgccaactccctcggcacgctctgcaaggcctgcaggccagaggtagcgtatacgcgtatacgtacatcatacgtgcatgatgtttctttttttttctttattttttttagagggatgcatgtcattttgtgtgctgtttttacttttgtgctctaatatgtgttttcaaattacaaaattttaggcgcttcgattagagaatcatgtgtctgatctctgctgtctagctttggtcattctggatttggaagcatctgcttggaggcaatgcacgagggaattattactgctagctcacaaagaattagaaaaaaaagcttttgttagtgtactggctcatgagaacttgactaaactgaaggataaaaataaagtataatttactgtacggtttgtagagttatcaatcctgaaggtcacctgagagggatagttgtaaagtattatttgttgggggacaatcatacagtagatcagatcagatatcagaacatacatgaaaaggggatcgtattccacttttcatggatgaacggatcttgcatcttggcaggccaaaaaggttcgagtctttgataaaagttaaaaagtactacctccgttccataataagtgcataagtgcagctccgttccataataagtgcagccataagtttccgcgctcaactttaatcgtccgttttatttgaattttttttataattagcatttttgttgttatgagatgataaaacatgaatagtactttacttgtgacttatgtttttaaattttttcaaaaattttttaataagacgaacggtcaaagttgggcgcggaaaaccatggctacacttattttgggacggaggaagtaattagaaaagaacaatttgtggggctcatgctcatcccaggttctaaaaccattagtaaaatgcatcagtaaaatcctacctaaaccggccgtaaacaatggcattatgagatcatatcatcattccttccttgatttgcttgcattgcttgaatcaaaagtcagcacttcaatgtagtagtgtactactagtagtacatccctgcgtaagagcaacagtaccgtgcatgaagccatgaactattcctttgtcctactatagcatgtgcaaaggagggctcatacgaaatgggtgtgaatgtggtaggtggaggttgaagcacttgtgatccaaggaccaaagctggccactgtcctcagccaagtgaagaaattggaggcgtctgtgcttgtgctcagccaatccaagccatcccatttctgttggttgagttggtaagcattttcacctcctaccactgtagctctatctttctcatccctattggagtgttaaaaatgtgaggctcaggtcaactatgaatggaaactggcggggagaatatagtatcatggtgtcagtcagtccctagtgttattttaaaacaatgcccagattaatgcatatggctaggttccaatagaaacctttagttgtacatcattttttatatcgtacaagtatcagtttatcaggatacataattaccactagatctaaatttatggggagagatctggtcatcttttatgataagcaggcccactaacaagcaatgagtaaactgtttgggaaataatcctccttcaccaccgttcaatagcagggtcccctgcctttcgggaaaataacaccaggcagcagcctccatgtgctatccataaatcacagatgctttccttgtccttttttggtcacaactcaaccaaatgaaagcaagactcctacacttcactcacctaatttttgctacgttcacgtggacaatgtaacaatcaccatcaccaacacattgaagttgagtcaggaaaagttacttttcatcttgtcgtaaactatagctatggtccttgttgagcaaatgcaaatgtctgcctgcgattttacagcatcctgcggagcagcagcgaggagttcgtcgagcaatgcatcaaccaggctgagtgcctgacgttggcagtgaggaagcagagcagggcgtcggcgggtacctcatcagcacacggtggcagaagaacttctggtcctggcttgacaaagccaaggactattcaattttctgccaaggctttcaagtctctacataatcatatttttacccccgtatatctgccattctgttttaactgagtgcgccataaaagcctccccgctgccatgttgcgtcaccgtgcaagtgttaccatccgttgtaaagcccaaaggagccctagatctgaccaaaccctacttcccatcttcttttcaagttcagtttgtgtaatcttgtgctgtactattgtgtaatgttgcataaatggccgttttctgttgtcacgtgttttacacttttactttcataacaactcctcaacttaacactactgctacaaaccaagaaatcaagagcaacatcaggttattttccataactgaaggtcgcatttccaatgcaacagctagaaacatgaagatctaacagctagtaacatttttagttcaaatcttgaactggagtgtggctactgaggggggacctcgcttagctctctctcacttaggagcaggagaggacgagaggtgcagttgcattggttggtttcaggcttgggcgtggtcctctttaccgctattctctgaatcctagcacacacctgcccgtggggcaccgccttcaatggtcgtgggcctagggggcaaacaaccaggcaaggatcaagatccccagtttgccaccaatagcctgatggcaaaaccaacctcctcaaaatattgcagctaatgcttatggtagctcatactagtcatactacatctcacacttctcacttaaggactggtaactcacaatttatgcacagattgttatacaatagatagtagatcattttttttaagaaaatggaaatggtttacatctccagattctaccataaggcgcacggccaat

SEQ ID NO: 32246 - DNA, 2380 bp, Oryza sativa
  unsure (1)..(2380): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgacgactcgatacgcagcctcggtgacgctgaccctcagtggtgatggtggctagggttgcggctcagtgacaatggtggcaacgactacctctactgcgagcacacgtccacatccggcggtggtgggcatgcaagacgacgccagattggcaactaccagtcggccatgctattcctcacgagcatggatctaaagatgacgacctacgctctctctcgccaactacaacgatgaccacagtgcaaggactgtatgtgatgggggattttgagaatttgtgattctgtactggctgttttggatcctgattttcaattctttttttttttgctttgaaaaatattttcgatggcaggtctctttacgcagttgtcagctaaaatcgtattttgtcggtgaccatcttagcttggttatctatgaaagtcgattttcactagtggccgaccggccactagtgaatatgtattattttcattggccttaggtcgctggtggcaccaccgcccgctagcaaaaaaaaacctggcagccagctatttgccttttttagtagtgagtaatttgttcagaaaatataggaaacttaaatgatttcggaatattttcttggaaactgaaattgacatggtaatgctactacctgtcggaaaccgaaattgatgagaaactttctagaaacgaatttagaatttttttttctcggaactggaaacaaattgcttttaatatacagctgattagctttacccttctcttccggatgttcagatttgcaccgagtgttgatgtggttagttgaatggagatgttttttatagtttggtgctttagatctatttctcttttgcctaatgactattaatttattttcttttattaggcaatgccagatgaatatagttttgcttattgcacttttttagggaagtgaagtgtacgtgtgtattattatttaattgataaaaatagaaatgctgatttattgtgataaaaaaataatggccttcatctcttcgttgattttagaatcttagttagaattattttttattccgataaatattcgttaccgtatacgctccgattcatatttactccatatttatgtttgataatattctatgtaattttcgtatctggggtttccactttcgattctagttaaaaaagaaaacaaaaatagtagatctgatttccattcatttccaagccgttttcatcccgacctacgaccatacatacaactaaaagatgcaacttggcaccaccgccttcatcttcatacaacttgaacggatcaatcttcttataaagcttcacttacactttgttggtattttttaacgacattaataggatcaatcttcttataaagcttcacttacactttgttggtatttcttaacgacattaatagaaatataattttcagcaatggcgtagaaatactcctggtatattatagttaaagagtttatccacaagcgcacggatatatcattataacatttcacccgagagtattccaagggtatcttatttattttatctcgtggaaagatcatgttgagagaacttgactaataatttaaatattacctgtaataatcatattttaagcaggtgttaagataatcaagggtagagtgacacataagcattagctactcattctcataatatattatctaagctaagtggaaagaaaagagaaagacaatctattcctatacttctaatatacatagtatacatatattctagttaaccgatatactagttaataccctttatccgatgccctcctggtacttcgagaagccacccctgactgctgagttccttacgacagcccgtcatgtctatacaactagggctaaatacggaggagtaccatccccaggaaattaacttaggattatatacaggcgcagaggaatacccgtactgagctgtcaccatcagcggcccacatctcatccgcagcatataaccccaaataacgatatctcgtaatctagacaccacgtctaaactaccagatactactctaatatcatcgtcatgacatagagtaattgcataagcaaacattata

SEQ ID NO: 32247 - DNA, 62427 bp, Oryza sativa
atttcaggccttttcctcattaaattcaaatgttccattaagagacttctcataccactaattaggattcactcatagacatatctcctttaatcaggagcatagtatattcaaatacagtaccactctgcagcgtttgccttatccatacgatacccacagcccgatcgaggttgggacaacgagaatgaacacaagcccgaacatacatatcttcacggtgatgcttgccattggaccaatttctgcctacctcgaggggtgttacctagaggtacctacactccataaaagaaataggagcatcttatgtttgatctttccaaagataaaaagaataagaacttccgcttacattgcccatagtacattgtgccactatggtcattcctcacggcatgtccatcgagttattcttgatgtacaacattgactaatcggctcaagtgcaaggcaatgtggatgaaaaggtcacattttcaaccaaattatgactccgtaaagtcaaccgttgatgattgtgcataatcagaagcaattaataagcacaaaatattttatggtatttctgaattcattgttctactgtggaccatgtggctttttaagtgtacttagaccattctcaacctatgacactagacataatttccataaactccccatcatcaagaaaatagtgttagacaccactcttctaatgcaaacaccactattccatacttcaatttaatgctacttatctcacatgatgtcttggatgttgtgtagaaaccatgtctcaagacatggttttcttctctttcctcatttatttacttgacatatcattttttatcctaggtggcagcttatttaatgctatggacactatcctagtcattggattgggaatgaccttatatcatgatgatataaactattattcttggactcgatgaattagtacagatactatccttgttgtttttacttgattcgttgtactataatgtgtcacatccagtacaagtttgctatattttaggatgaagggagtacttagatgatgcttttacaggcttttttaatgtttttttcatacatatatattaaaatttttataactacattacacacgaacgatccgctgcaacactggaggtttcatatagtatccgctccacacaaaacattaaagaattttacaactatcccctgccccactctcactcactcatctagtatatattttttgagtgaattgcatttcgagccatattttattgccaaagttttactttaaactaccctataaccaatattcttactttgaactatgtaactttacctttgttacataatgaaccaacctaattctatttgctagtcatgtctagcgtctccttgggtaaagggataacatgcatatagatataaaagtttgccggcatgtctttaacaatttactcgaagtcattgaagtgatgaagatgcggtttgggggtgatcaattgtgcaacaaagataaaattacctagtccaaattgaaaaatttaaacaaagaatgattttaagtgaaacctaaagaaaaagtatcatccaaaatgaaattaactctatatttttttttaccatcggactgtatctcccttcccaggcccggccccccggtaagcttactcgctaccgatcttgttctctcgccccctcccggcgcgtgattcccggacgcgactcgactcgacatcccaattcccaatacaccaccacgacccccctccgtcctcatctgtcccgcggcctcgaccacgccgggaggagccgcagccagtccgggagacgctcgtacgcctgcctcgaccgatccagcgccgccacggcgaccgtggccaaggagatccgccccctcgtcggtccgccgccaacgatctccgatcgagacaaaccctagccacgcccattgccttctcccgtcgccatgtccgccgcgcatctcctccgccactctcgcaaggttcgtctctctccctctctctctctttctctctctgcctcctctctctgtggctgcctgcgcatccgtctcccatcccaacgtgtcggaaaagccatcggatctgttctgatctgccttcccgctgcgtggagcctgcgtgccgcatgtggttgaattttcgatcgttcctggatttccttgtgctcccgtctgtgcgaattgactagtaattcacctgatttcggtcgatcgggagatctattgcctactgcagcgggaaagaaatgtttctgcgctagtaatgttacgccatcgtcaatcaattcccggtgacatttcaatctgctttactgcagttgcggagtttacacaatgctctagactgtgagcgttctggcctcgtgcgctacttctccactgcttctggttcgttccccaccaagggaaatggtatgtgctacccatcttttatcattttattttgattgtgtgtatttgtcaactaattgaccacggtacgcaagcaacctgtttgtccaactcaactggagatgtccttccacatgactaattgctgtgatagttagcaaatacctttatttctttcataagtgtctgctgcttttaatcatgcagttctgttctgttccaataactttttatttctgtattatgggtttgtttgtttcctaccataccaaaatattagcaataccaaaacctaggtgaattttagccttttttttcttggcaacctatgtgtgttattggcatattttggtagcaaaccaaacactagccaaagtactattcgaagggtcaacaatttggtagggcacattttggcgtcaaaccaaaatggtcctgccatcataactgaaaccaatatagagccttacataggcaatttagttataaaacgtttggtttcacaggtgttggtaatcctggatcctccagaggcattcattgattgtgtgttggtggtctgtagtctaatatagacagattgtcaattgattacaaacatctgtacaaaaaaaatatgttgcaacagaagtacaatccaatatgttcattttttcatttcttgacacattacctctccactaatttttgtacctttggctaagcatgggttggcttcctgagctgatactataatttttaattaaggcgtgatttctcattgacatagtataggcacactcattttgtcttgagatagtagttatttggttcctttgggaatttatttgtacagtgagaattcaccttcttgattgaatgtcctcattaagcaattttcaccattgaagttttagtgcttttggtttccacaggtgctgagaaaagaattggaggtgccagatttcctcagcgcaagcaacctggaaaagagcttgagacctccaaggttatgtccttgaaatatatcccactttattgagaccattattgtcttgtcctgactttctagtttgtcattttctctttcagttgtcactaggacttaatggaagctacacttgcaggagatcacctaacaactttatcccaaatactattactggtctcaatggttcattgtcatggtatgtgtcattttctgctatgatattgttagcttatgtggcagtgtcgggacatattgtatgagagaaccacccttacaagagaatatgaaccagcgatatttgatcactgcgtctcatgttgttggctaagatacaccataaaaaaaatcgctggcatattttgcaaggcccctgaatcatgcctatctggctccctgctttttagtacatgtctaaatgataatctcctttacttaagaacaaactccaatcctgggaatgagatttgaatctgattgtcctattctaaatttctaatagtgttctcctaacgcctgatagctgttctgtacttctgtttaccatggcgtctttataatgttcccttttctttccctgtttcttttccagtggacagatagcttcagcaagatctttctcaagcagtgcaggtactttacttacgtgttttatgccctttaattgcgataacttcataaaataaccaggatattgcaaagtagctgttcagtccttttggttgtcatgtttttgcaagagggtttcttataaacatatttggttgacgatagattactaatttggttattttggttgcggatctttttcttttttactatctattttatttactgtaccctgtcttcccacgtacttatttttacatgcatgtgatgctgtattccactatttttggatatttttctccacgcctatttctttttttaaaaaaatcagaacaactttctttttttaatgatatctaagcatctagtttatccgcttcaaaaagaaaagtctatttgaaattcagtccacatcttcccattgctctggttactatgttaaaattgtctactgcctccgtcccataataattgtatttctaggattcacatttgtcccaaaatagttgtcacaatagagtactaattgtcccataatcacttctcattcaaatttattcctattttacccttaattaccttcccactcttatgtatacaccatttgatgagggatatcatagtcttttatctcaaatcttaatatatgctaatcaaactagaattacaattattttgggatggaggtagtacataactccagtcaatgattccataatccatatagcactctgttaattgtcttatttcttaagttttgccataatttctttattccagacctgccaccacatcaggaaatagggatgccatcactctctcctacaatgaccgaggtatatctcaccaattttttttattatgaatcatgaatatcataatgtcctcttgtgtttttccttgaattgcatgtatcctatatacttatatagttcatccccactaagtgtagttaatgctatttctctcttctctcattaagccacatcaccacaattatttctagcctttggatgatagatctatggtccaaattgtctcttttttcttctctcttaaaaacatgcaatctcaattactttcaagctcaaaattgtatcaaattgttttagttttgtacatattatgcaacttaattttccgcagcaacgcggcggggtattcatctagttagtattacaccttatacttgtattgtctgtaggggaacattgcaaggtggctgaagaaggaaggagataaggtctcacctggtgaagttctttgtgaggtggagactgtaagttttctgatctctaaggcagcaatatcttagttagtacttatttttagtggtgctcaattattttcttttatttaagctgcaagagaatctaaatatcctttgaatgcatttctgctgactaggataaagccaccgtagaaatggagtgcatggaagagggctatcttgctaagatcattcatggagatggttccaaagagatcaaagttggtgaggtacatatttgaacaatcatttattatcctctgtttactaatacagttattacaaatacctcagtctttaagtttcgctgacataatcttggttgaattatgtccatgctattcattttagattattgctgtaaccgtggaagaagagggtgacatcaagaagtttaaggattataaaccttcaactttggctgcacctgtagccccttctgaactgaaggctcagtctgagcctacagaaccaaaggtggaggaaagagagccttccaaagcatctgagctaaaggccccaaggactgaagaaccttcgcggtcaggagatcgaatattctccagccctcttgctagaaaattggcggaagataacaatgtaagttttctgatgttagctgtctaggttgttacttgccaactgttgttgtaacatacttaatgaacacaaggattgtgctgcctaaaacaggttccactgtcgagtgtaaagggaactggtcctgatgggcgcattttgaaggcagacattgaagattacttgggtatgtcactttctcctatagttcccccccccccccccaaaaaaaataaaataaaattaaaataaataaataaataaataaaataaatgatgaactctataggaatttagaattttgtagttgagtaacttagaattcaacaatgaccattatattaatttatatttaacaagatcgctttgaagctataatgtgtgctcctttgacatatcatgctagttctgaatttgatgaactcttgatgtcaaattttattgtgatgtttttcctttgctgctcgttgcttgtttaatatatgaagtgttacagttgctagggattttatagaacacttgaatcatgcatgcacttgtactcgcaagagcagttaggtttttggttatgactgtgtccctgtaatacacactttatatatacttctctcaccattcaattttaatcctaatggccaagtggaaaagatgttaggcgaggaaaacatgttaaaacttccttgtaactagtatgtactatggcactccccttatataaatctactttcttcccatgcaattccttgtttctgcccttctctggtcaggttcctgcataatagcaatctgttagtgtcaatgataagaaagcaccagtatactggtgatctgaatcctcttgcttaatgttaagctgtaccactgatctttgtgctttactgtcttattatccattctaaagtaatcatattcagacatatgttgatgcgtattatgtactccattttgtggtgtatggtatttgatcacttgatttgaacatccagtcacccatatatcaagttatcagaagaaaaaaaaaatctgtttttgcttgctttgttcactcaactctgttagtttacttgttcctgtgtgcctgaatttctaaataattttgttgttttagtagcaccatcctggttgatccaaatgaaatattattaatgtaatttgcttgaactctgtatgttcaaatgtgtggttttatgctttcctttatatttgccagatttattttgtgttatgctattattctatctgtgagaattcaattgataatttttttcttaaacaaacttctgtagctaagggttgcagaaaggaagctcttgcggctccagggctaagttacaccgatgttcccaatgcacaaataagaaaggtaatttcaatcatacgttctttctgttaagtcgttttttatgcgatgttattgatctgatagtgttttaacttcaattctgtccaggttactgcgaaccgcctgctaagctctaagcaaacaattccacattattacctgacagttgacacacgtgttgataatctcatcaagtatgttgaatgctaattgtgttattaaatcactatattttgtaggaaacatatgtgatggatcaccttcaaagtccatctctctggattttgtagcttttcttttaaaagtagttctttttttttaatctaatgcaggttgcgaggggaactgaatccattgcaggagtcctccggtggtaagaagatatctattaatgatctagttataaaggtaattaccagtttctcgtgttaccgtggtttcttatgtctaccaagtgccaaccactggattgttgcagattcagcctatttatgttcgtggactgtccattttcttctgacctccaattctgaatttatcttaatttgatgtacaggctgcagctctggctcttcgaaaggtccctcagtgtaatagctcctggatgaatgattttatccgccagtaagttctgaccaggcatatcttgggactaaagttttggcaagaaaggagataatgaaaatttcatttcgcatgcagataccacaacgtgaacatcaatgttgctgtacagactgagcatggactgtttgttccagtaatcagggttagtaatctaaacttgtctaatctgtgtaagaaaatgtttctaacttttgcttgttgcaggatgcagacaagaaaggacttggtatgattgcggaggaggtgaagcagttggctcaaagagcaagggataacagtttgaaaccagatgattatgaggtatatggattgtatggtagttaatttttgcatgaaacaacagcatttttccatgagaacttttatgtggtgttttcagggaggcacattcaccatatcaaacttgggaggtccttttggaattaagcaattttgtgccatcataaatcctcctcagtcggcaatcttggccattggttctggtaataagtcatgttgcacttttactttgtttccactaattcgttgccacttagcttactctgtaaaaataattgtagcattatatatttatctgcattattttagtgtattttgaaaagtatattttccaagtccctgatctagtacttaaactcagaagtcatgcacataggaccagctgtttatagtagtatttagttgtttttcgtaaaagggctagtagtgccttttgttaatgtattctatttgctaggcaggctcattcacttagtcatgctgttttagtccgtacatagggattcatttttaactcaactgcttttttgcttgggcagctgagaggagggtgatacctggcagcgccaatggtcaatacgagtttggttccttcatgtcggcaacaatgagctgtgatcacagggttattgatggtatactctttagatcttatcggaataaatgatggcttcatggatcatgggcaagaaattaacttttgttcttgtgcgcttactctaggtgcaatcggggcagaatttctgaaagcattcaagggctatatcgagaatccaacctcaatgttactgtgaagctaaagatcatcaaaactattcttcccttgttctcgaatgatgcacagaacggtgctgtctcattttgtatatttccatcatgatttcgaggaggacctgaaaaccaagagcacagagccaagggcaggatgacctggtttttggattaatttttctttttcctgtttgtttcgttccagttacactgggaattaggatcaatttacaagccttcttttagcccgtttttatgggtttactccgcaagttcgttgacagcagagtaaattcccgggaaaccatgcaggatagcctttatacgatttgccccctttttactttttttttcatctttgtgcaaaaccaagaggcgcagaggtaataagttgcaaatcttggggagtttggtttataccctttctccgcaaaattctaacgagaaattcacaattgttcagagtaaatgatgcattgcttaatccattttgatgcttggtgtgtgcttgttttcctttggccccttcatctcgttgatatctgacgttaaagctggtttatactagcataaataaagaaaagaatgttgttaataaaacatgtgctgtgttctccaaatcatcattttcccgtacgttgtaaagaggtcgtgcattgtctgtttgtttggtcgatgcatttgttattcttaacaagtgatgggcagtagggatccaaataagctactccatctatctcaaaatataagtatttttagctatgaatttagacaactaggtgtttagatttatagctaaaagttgttatatttaagtattttttagttatgaatcttgataactgggtttgataactgggtgtgggtgttcagatttatagctaaaagtagttatattttgggacggagataatagttcccttcactgcttaattcttgtggttagcgactctaagcagtctatactaatttgttcaaagatttttatgattatgtgttaatgtagctgcaaattaagatgaagagagagcaataatgtgtttattctaatcatatgcacatctaggtttgatcggaaaatattgagttgatacatttttattcgccaccgattaactttgcttgcttttttttatggcaaataaatagccaatcttaattttatcaaaagtgcaagcaataatgggatttttgtagcgaagcacgagcttcatgattccccatgtaacatccctttatatttagttttttttttcagtggttaacacctaatgtggctcatatagagtactttgcattcttttgcagcacgttgttgaatacgaaaaggttaaaaaatagtgaaatctgcaattagtttttctatgattccatttggcacccttgttaagcacgtgtgtactaaaaacattttttattgttccaattgaagaaagagaaaattgctctgtgcaagcaaacattttctccctatgcatctttgttttgctccctccaataaaaacacaaacaagtattgtttcgaatcttgtagttgaactttgctataaaacaacatgaataattatgtttgacatgtgagaatgataattttctaaatagagcaaatttatgtgctacatgttaagttttccaaaaggagcaatttctatgttatatcatgtctggtcttgaaaaataattttctgttaggtaatcttttaaaagtagggagaatttgaattttgaattttgataaacgttattttgaatagttatgggtataattttataaaataaatagttaagaaatccatatccgtcggttagcacgataagttggcataacatgaatttctatatgttaggtggctttaggccctcctcacgtctatatctatacctaattaaaaaatatgcaaggtttctgtaaaaaaaattttcgtccgtccttttttctgactcagttttacccgtaatttttcgctgtttttcttttttttccgttttcgtgttgttttgtccgtctctcttttttatttgcccaattcatttttttctcgtggcttctcgctccgttttttcccgctgttttctttttttttttccgattcgtttttttcgtgttttttttgttttttcatctggtttttacctaactaaaaaatacacaaggtttccgtaaaaaaaaattttcgtccgtcctttttttccgattcagtttttcccgtaattttttgcttcatttttttggctatttttctttttttttccattttcgtgttttttttgtccgtctcttttttgcccaattcagtttttcccgtggcttctcgctctgttttttcccgctgtttttccctttttttccgattcgttttttttcgtgttttttttgttggtattttcatccggtttttatcttatccaatctgttgcgcacttgtacttcaagctacttcctcttgtgttttctcctcccattgattgtaaaaatcgataccccactccactcttattatttttttttcacgatttcctcttttaattcactggatttaatctcattggttgatgatgctcggctggccatttttatcccaatcccaaattttatggatccgttccgattttggaaaaaacagaaagactagaccgagtggataaaacccctcaaccggtcaaaaaagatttagatttgatggagaggatcagctccgcatacgggcaaggtactacgccaccggatctacacgcgggtagccgccggatatgccgccgccgtcgtagccgacgtgggaagccaccatcgccggcggatcggtccgcgaaccagatctacacacggatagccgccggatccgccgcggggagccgtcggcgccatcggatccaccgcagaaaggcgccgccaccaccggatcaagccataggaagcgaccggtgccgtcggttccgctggatctacccacgggaagccaccacactccgccccccctctctccttatccgctcgtgaatagagtcgtgccctcgtcgtcttcacgccgcgccagcgtgacaggagggagaggaggagagggactggcgacgccggtgaggggaagggaagggggagcgggagcggcagagagagggaagggggaggaggttctcacgatggtggaatgggatgggaaagtgtgattagggttagtgtttttagcactgacggtttgatggatatagaatcgatccgacccgtccatcaaaatgaatggcacagatcgatcccacgtcaggccgacctccatctcgggccaccgcactgctgggccacgcatgcttcatgggcaaggagcgcaatagcaggccgatagggtccaatggaccttttctttttttttctttttttagcacttttttatttctaaggaatatatttttttgaaggctcatatcatgaaaaactaaaccgtaatcgtctaatatttttatatttattataatttcagtttacccgttgcaacgtacgggcattttttctagttaactctgaaaatgctacctgatgatcggtcactggaattaggcccacgtgatcggttcctgtttccctttttggcgtaggtgttttttttttcaaaaatccctgattcgtcacgcatcgtttgtttttttgtttttaggaaacgtggtcaggggcatttcgatttaattctaaacaatacgatttatcaccaaattttattgcataataaactttgtatgtataaacttttttcgaacacgcgtgaaatcattgtatcatttcaataagcaaagaataaaaggtcggacttacgaaaacaaaaacacgccaacacacccactggaaaacacacacacacacacccataaacacacctcccctcctcctagggcacaagagctattgtgttggccaacaactcttggaacctagaagctcctgccatacactatagtgtgccctcattactaatggatagaaccacacttgtcacgctaggagtaacaccattgaaaacataagcattttagtgtttccagatttcccacgcgactaagataataagagagttaagccctttttctcgttcttttgcaaccctttactgcctttgaccaccaacacgaaaacttgcgcgtgtcatgatttcggtagagtggagaaatagccaagcctttggagaactagtgacaaaccttgtctgctgaaaacacaagaaaccaaaatgtgttgcattgtctccttggcttgatcacaaaggggcaagcggctggatgaggcaagtaacgcttggcaagatgatcagccgtccaacaacagttgtgtattgccagccaccgaagaaacttgcatttaagatgtgcccaactcttccaaatccttctccaaggagcaaacttgactgcccccatgaagaaggtctcatatgcggatttggaagtgtaaactcctgactttgagaacttccaatagtgctggtctagaattccttcttgcagcaccaccctcatggactgcttcccaaatcctgatgtattctgcaagcacctgcaccgtcaaaggtcctctaatgtccatgatccacttttagttgtccaatgcttgagccactgtacaatgcttgattatccttttcaattcacataagttaggggccatttccaaaataattcttccatgcacccatctgtccacccaaaacaaattagattgcccattcccaatttgcgacaacaccgccgaactaaaaaggtcatgagaaacacggggaacttggacgagcaatccttgccaaacacgactattgtctatcttttggagccataaccaaccaatccaaagggcccaactcatatattccaaattaagaatactaaggccaccataagctagaggtcggcgcactctatcctaggccattaagcaattaccaccattggtgttttcttgtcctgaccaaagaaaccccctccttcttttgtcaattgcttttgcaacccactttggtagatccatagcaatcataagatatataggaatggcgaatagaacaacccgcaccgagatgagacgaccgatccgattcatgagggaagctttccacatggggagatcatccgctaccttgtcaaccaaagcatgcaagtcggtcttagacagtttcttaacatttaaaggaagacccaaataggaacaaggaaaatccttgatctcacacggtaacacattcacgatcacttccaactcttcttcattgcacctaattggagttattgagctcttttgcatgttggtcattaggcccaatgcatggacaaaaatatccaaaacattcttgataatggagagatcattcaccgttggtcttgaaaacataataacatcatcggcataaaaagaacacctttgctacatttgccgaacatcaagagtctgaatccaaccctcccgagctgcccggtccataagagagttgagaacgtccataacaagaataaactttcattgcaaaactttttgtatagaaacttttattgcataaacttttctcctgagaaacttttgttgcatcaactctctctagaaacttccattgcataaactctcttttgattttttttatagaaacttttacatacatatttttgtagagatgaagccataaacttttgggtacagataaacttttatagacatgagatttcaaaccaattaaaaaactcaaaaaacttcatattcaaaatcaagcattctcaatatctcaggaactattcactctaaattggaaactttccacaatcctactccaaatcatcaacattcaacttagcatggaaccgtgcagctcacccgagggcaatagcccacctccaaccccatcgtcaccaacgctcgcaaccgcaacaaggcacccacttcgccattcgctgcaccggcgctgacggcctttgccatgcatacaccatctgccttgctagggaagagaagaaataggggagggggagtggagggctcggcgcgttagtgaggatgatggtgcgcactgttgctcgttgatgcatcaaggagaagagacgacgtgaggggcagaggcgacattgcgtggttgaggcgtgagatgtggaggaatactcgatgaatcaatctatggtgggtggaaggcataagatgtggataaggtgttcgctagcttccactgcatatgatcggtcgcgaaataagccccctcgatcttgcccatttattaaaagagaatcttggtttcccatctctcctgcatatgtagaaaaatgttaagttggtaaggaaaatatatagtagaaacttaaaaataatcatatatataaaattctaggacaatggtagaaaattaaaacacaacgaagaaaaaacacaattcctttttttttctatctccttcttcactgttttgtcatttttatgtagtatcgtcttagttatatatttatataagtgttattttttaaattccccaaataactttttatgccgtgatttacatggtaaaccacacctaataatgaattttacatagagtcggtgtgcacatgacaatggctattgataggggagtgctattacaaaaatgcatatgacaatggttagtgatacatttggggagtgctattacaaaaatgcaaggtaatttagttggtaagggtaagaccatatatatagcttgtaattaattaggggcacacgacgccatagctgctttcaaaatcaaaaactcctccaaagagtctacctttttattctgattctgagaactatagttataaaatgtagaaaataaactagaatcgagatgctaggtgattctcaaaagctaactaataaatagttgcttcttagaagcataaactcccccaatcaggaccttagcctagtagcaataccaataacaagatcaaccaaacatggaaaatgaaaattaacagcaaacaaagtgacaccggaaaaataacatatgcaaaatacgtcgatcacaactttcagttaaacacacatgcaattaaacatggtgaatccgtactgtccccttggaaggttggattttaagcacatgaaaagaaattatatattactattccgactaaacaaagagacaattgatttgtgaacatgttatgaatatttcatattactcaccataccatgctaaatccaaaagtttacatgatgtgatgataattactacgaatatgaatactagcagtgttcatattaaaggtcaaagagatcaaaccgccgttcatgttccgaaattagattcggtcacctgcagtagtattgacttcaaacggccaccaaatgtccatacgagctctgtgctggatccatgagtacttgatgaaaagctcttggagttctctttccaacggatccagctcatcttcaaagtccacctcgatcatttgcagttgaagaaataaagagttgtgccacccgtcataggtctctggacttataactttgtttgtgaccccggtctaagtggatcccaagtgggatgcatcccaagctagtgtagcacgtccctagggactccttggtcatcctcccatcaacttaaatagctatgtaccccttcagggtttttgagtttttttaattaaagtctagctattgctacttttctagataaagccgtgatcggttagatcattgttttctcgctacgagacccaacttatcatgtatatttaattcctatttgcaatatcagattatttttattttttacttgttttttcgatttgcttgtataaataaggttgatctacacccgcaagatcaacaatccacggagagatgtggcgatcgctaaggcgcaacacaacaactcctcgtacagttgtagtcgggtcattaacttttctctcaaattgtagttattatcaacttaccgaaatattgaattaatcgtagctatgagcatatcgaggaagctcaaagcttatcaggtggtacagagcttatcattacaattgcatggtcaattgtctttttatgaaaaaaaataagaataccacaggaggctcatttcccttaaaattgcaacattggagggtatatctgcaaaatatattactcaactactccttccgttccaaaaaaaaaggcaaactctgggtttccgtgccaacgtttgactgtccgttttatatgaaatttttttataattagtatttttattattgttagatgataaaatatgattaatactttatgcgtgacttatatttttaatttttttttataatttttttaaataagatgaatggttaaacgttgggtacggaaattaggtttgtcttttttttttttttacggagagttagaaaactactacccccgcgtggccgcgtgtggccgccggaccagttcgcgtcctgtgccttttcctgcccatttcccaccaccaccacgtcacgtcgtcacccccacatccaaagctaccccaccgtcagccccacccactcccccaccgtctcgtaggacccacatccactggcccccacgtgtcatcagcataagaccgccaagcgcggtaaaggattcacgcccctttggtcccaccatttcttattacccttatattattaaaaaggaagaaggcgacgacgacatcggtgaggtctcctcactcctctcctctctctctctctgctctgctttgaccccaattcccaacacccctcccccttcgcttcgctgctcccgattccggcagcctcgcgccgccgccacattgatggtaatagttggatccgccgcctccgccgcagccgacgacgatgggactctgctcctcctccagcgcccgccgggacgccggcacacccggcggcggtaacggcgcggggaacaaggataacgcggggaggaaggggatcgtggcgtgcgggaagcggacggacttcgggtacgacaaggacttcgaggcgcggtacgcgctcgggaagctgctgggccacggccagttcggctacaccttcgccgccgtcgaccgccgctccagcgagcgcgtcgccgtcaagcgcatcgacaagaacaaggtatgggcccaaacgagcgtggtggtgtgcggctgacgcgtgggggccatgtgcccatgtgttgctcgattcgatcggccagttgggctagcctggacgacgaccacctttgcggggggcgtcgcgttttgcacgtggggttgggttgccgaggaaatgtgaaatgtgaatccggggcgatactgtagtggtagtggtacaaatcaaaaatgcactgccactacctaatgctgctgcatgttagtactagcgcaacttgcagattgccatggaggtgatccatctaaaccatcgaatctggtgggatgactccattcctcatttcttcactcagtatatgtacttttcagggatgaggtccattcctcaaaccaaggaaactattttggatcaagtggtcaatggacatctcaatcctcaaaccaaaataccaaactattttgggatgtttaaatcttcattcttgagcaaaataggaaccagtcaggatggaggcaacaagtggataatggactatacacatacgtaatggacacatgtggcgtatacaaatttgtttagttccaaaaccagtataaagactgcacaaatgcctcctaacagatacggcaaggcaattcctgaaagacactgatatgtactgaaacgtaacacattcgtatatgaccctacttctcctgtacatgaaggtcataaattcatgagcagagaaatgtaatatgtgtattcagaaaataggacgcactgattttctggactctgcattattgtaaagccttgtcagcatgtgctatgctgaattgaagcatcaacagaagtagagaactagcctctattttgaaaagaaatgatactgctctaacttctcaaatgggatgttttcgttgcagatggttcttcctgttgccgttgaagacgtaaagcgagaagttaaaatactgaaggccttacaaggccatgaaaatgttgtacatttttacaatgcatttgaagatgataattatgtgtatattgttatggagtaagtcatggaaaaactctcaaatgtttatgaaatcagtagaagtatatctaagtataaccataaaatgtctaagtgaacttttcatggccttagccaagttgaaggaaggttcatatgtgtgtttatgcttttttttagaaaccacccatattttaagtaattgatcttactgaggtctagtattttagtttgtgcccctccaaacaggactttggcaattcaggatctaattacatggaaaagaaacaccacatgcaaactggcataatattaataccctcgtaaaaatctagaaattgtaccgggtaaatatcaagttcaggataaatagttggcaaacactttcatgtttctcatctttgttctctttgtatcaaggaactgtgcaagctaatgaagatctgaccctgttacatgtatttgacagattatgtgaaggcggggagttacttgaccggatactagccaagtaagtcaatttttgaagtttgtcaaaaatttttactttaccacagaactgtggcatgcttttttggttgtgttgggattacttattctaaatatagggatgttgaaccggagagcatttcaattagtgcttcgtgccacaaagagcttggaatttaatatggatgtatggcatatagtcatatattgttttcctattaccataaaaccaaaatattacagggattgacataagtttatgtgagacatccactagccatcaactgtcaggaattgttcaaagattttttttcgactgaatgttcaaagatttttatttattattaagttcgtttgaatatttgatgtatgtagaaagcaaattcactgatatcacatttgttctgctcttacaggaaagatagccgttatagcgagaaagatgctgcagtagttgtgcggcaaatgctcaaggttgctgctgagtgcatttgcatggtttggttcatcgggacatgaagcctgaggtatgctctaaaagtacaagactaagtcttcttataagagtaattgatcatttgatatgtgtatttacagaacttcctcttcaaatcaaccaaagaggactcatccctcaaggctacagattttggtctttcagattttataagaccaggtttgtgtgtatgttgtaactacttgttctattgttttcttgtttaactttcttccattccatatgaaatataaaagagaaaaatctctatttggccttgtaagttagccatatcccttatttgctctcccgaaactaaacctttttacccttctagtaattcctattctattagaggtatggcttattatattttctatgttaatcccttctaattccttgtcaatgtaaaaagggcattcaccgatccatgtgcataaaaaaatgttgataattataagtagtagtaaaacttgatcgccatcttttattagaacatacattctttttagagaaccaagtctgcaggcatagaaaatgacaaaactatttacaaattttagtagcagacatagaaaaaggtatttaggcccgagccaattaaaaagaaaaacagctattttactatgcatttataaaaaaactaacatgctaaagttatactctctacatgttaaaaagatattggttttttttattaatgacaacattagaaataggaagactaaaaaagaagagataattgtccttgcttccagttgagaaggcattagaaggtaaaaaagtacttcacacataattcaagtagcaaactaatggagaagtaatacgaggggcaaatatagaaacaaagttgagaaagatgggcatgaggggttgagcagttccgcatgggcaaatgaaggatacgactaacttttgagggcaaatataaagattttctcaataaagaaattattctcagtgtaattgaaattaagttgccgcactcacagggaaacactttcgtgacattgttggaagtgcctactatgtagcaccagaagtgcttaagcgtaagtcaggcccagaatctgacgtttggagtattggcgtaataacctatattctactgtgtggaagacgacctttctgggacaaaactgaagatggaatatttaaagaggtcattttgcctaaactatctttgtcttacaaccattttattacatgtgtttcattgattaaaactattttcttgccttacaatcactatattttcttctttttttccttcgatgttgccgtattatccgtattactttgatatcgttctaacttttagtagtccatacttccaaggaagtgcgcatgttattcttaaaatacttctggtctgttttaaggaaattcagaatcttaggctggtatgtttcagttaagtggctcttcatcttgtccaaaaaggaagaggaaggatcagcacatgggtctagatgatgtggcaaatgacatggcaaaacagaatgatgtggaaagccacctcacttaaaaccacttgagaaacaatcatagggacattatttgcatgatttcaattgttgagtgacaagttgtcttagagttgacttgagagacaaaaattgacctacatgaagagttgacagaccaaagatagactttccccttttttagataaaaaagactaactctttatcttctcaggatttatgctcaagtatatctgatctagtgatctgtgtcatgacaaatctgaaaaatatgatccaacttgttgaaaagatgaaaataccttgctatgcagtgcacttcatagcatacgagtttgccattggcacaatatcaggcgtgtagatttacactgattatatacttgggaaatagcttaccacaagcgtcaacaagtttatatgctatccagaaaagcacgcatccatggatgaaccgagtgaactatcttagaacaagtatcgtaatgtgtacaaatgctagcataggaggatctatgtggagtcaatctacatgattcaccctctctccttacctaaacctatatggagctaagcctgcagtctatggaacattagctgtgcctgtgcataaagaaaaatatgtatatcttgggtagccgctaccctggtggctgcttatatttatgtttctctttgggtatcatgttggaattactgaccttgtctcaaatcgtgtccatcctctgttccccgcttctctttccacaatgctaacaaagtggcatattctttttggtgcaggtgttgaaaaacaagccagattttcgtcgcaagccctggccaaatatcactccttgtgctaaagactttgtacaaaagttgcttgttaaggatccccgtgcaagattaactgctgctcaggcattatgtatgtaactttatatcatttttggatgtcttaaatttaagtatgataatctgattagggaaactctatatcattttgggacatcttgaatgcaagtttgcaaatctggttatttaataatgggattctagtggcaaactgttgctaagtctgagtgcagtcatgcaaattcacaacttgattactgggtgactcttagatgggatatatctaaggggatttatgaagggccccttcaggttggaaacttatgtatgagggtccaacctcaaaggcttactcagcgatcattaatgggtttgcagtgcatactccctgttagcttaatacttatttgtttaacttctgctgggggttcagctttggcttgttatttgaagccatgtggctatgcttgctactcatgaaattcagacctccattgccttttatcgatttgattgttaagttattgctatgtatatggtagcactttctgattaccatgcgtaaaataacagcttataccttgaatttgatagaaacatcttatgttgttttttcatggttagacatggttggttcagttactaaggcttggtacaatctaatattgatacataaccaataccaactaattcatgttttcattacatcatagcaactaacatttgctgttcagttggttatttatcagttatcacagatggcatactgttggtataaaaataaacaatcttattatcacagtgctctactaacatgaaaatttacatattattttcttcagcacatgaatgggtgagagaaggaggacaggcatctgatatacctctagatatatctgtattacataatatgcgtcagtttgtaaaatacagtcggtttaagcaatttgctttacgggtaagttatcataccataacttaagggaatcttatccatgactcaggatgatttcggagtcaattttaaatgtttacatctcttgtaggcgttagcttctacactaaatgcagaagagttgtctgatcttcgtgaccagttcaatgccattgatgttgacaagaatggaacaattagtctggaagaactgaagcaggtacatccttgttggaattcctcgctacactattggcttgtttttttttactaatatttagcataatccatggaatacatttctttgtaatttctcttcatcttatttttgggccactgttctgaccaagctctcttccattctgccacttccctcatgccaacattctgtccgtttggaaacaaatactggaaatgtagaaaaatgaaaatagggaaaaccataggataatgtaagaagtatataatggcaaaactgtttagggattgccattgttaaattgtacaaaccccagtggctgatgcaggattttggagatgggggtacaaacttgtaaagaaacattaatacatggaaaaacctaaagctccctattaaagcaaataatactcaattattcagtaaatcagaaaataagaaaaaatatttataaatcctttgaaaaaataaatattaaggtttcagcacaagcttatatataagttggctggaactcttttggggctattttgcaactatggaatcaaatactgctgttctaactcaacaaatcatatacacatgcattctaactattgaatgaaagggtgtttacaaaatccatttacatagttatgtcccatgctggtccaccatgacaaagcatcagatttttcttaaaattttacttttgtacatttctcaagaaatcacaccacaaaaaatgtttctgttttctcaattattctgaactattctaaaattttcaattggtaattgtttgtaagtcaggtagatttaatgatatcttctgttaagtgctagagattataactactatttgttactctccctagtgaaagatgtgcgataaagctcttttgttcattaaggaaagcatcctgatgaccacagctgcaccatcaaagttcttttggtagtcattgatgcatagacattttgattatgaaattttctttttaacttgtattcaaagaattggaaacatgcttctttttctttgaagaagtaccatatatttgctcttatacacatatcaaagaaacaaattctatgttgtaccttctcttatacatatgacatgcggaacttcggcagtgtcaattttttacctcacattataagtcatctgtcttattagctatcactatatgatgtcaacactaatttgcaggctcttgcaaaggatgttccatggagattaaagggtccacgtgttttagagattgttgaggcagtatgttctcattcttataatttaccgtagtaacattatctattatcggtctcagattcacatgctttcttgtggtcacttggttggaactatgtgcaattgcaatgaagtgttaaatctttctaaaacatttaatgacgttatgcaaatagtttgcattttcaaaatttcactgtcccatccttgacagcttttgagagtgaagtcatcttccatgttttagtatatagtaatagtatttttccaaggcagctagggtaagagatgataaaaattatatggatttcatatattttattatttagtgctgaagatatagaagattggagtagttgtatacttattctagctatttcgagatgatgtggggggttttaggtcaaatgagttaagatgcctaaatggtactgtttaataatagataacagtattgaaactgagtaaatatattcctctctgcctttttgttctttgactaagcaaatgcatccacttccctctctatgactcttatgacaatgcttgatgttgttttactgatgatcctcaaatatagctttgtagtaagttttaaattatagttccagatgcaatgtttcaagttccattgtttctattaaatttgcatgtatgcaattgaacggacatcatcaagttttctccttgcaaaggggagtatttgctatcatggcataaagattttcattgctgggcagattgacagtaacacagatggattagttgatttcgaagagtttgttgctgcaacattacatgtgcatcagctagtggaacatgatactgagaagtggaaatcattgtctcaagctgcatttgataaatttgatgttgacggagatggctatatcacatctgatgaactgagaatggtacacctcttcaaatacctgtgaaacattactcttttcctattcacgtgagaattgatttatttcctataagattccaatccttaattggtgcatagcataagatcgtaatttattcaaccagttcatgcttctcatatatgtattcttacattgtctgcagcaaacaggactgaaaggttctattgatcccctcctggaggaggctgacattgacagagatggaaaaataagcctagatgaatttcgcaggctcctgaaaactgcaagcatgagttcacgcaatgtacaaactccgaggagtgttcacagatcgtagcttttcatagctgtgcacacttcacaaaagtgaacaaagggcagtcattgttgtaatatttttcatcgacacgtgtaatcaaaattgttgccagaaaagctcttgatgtaaattaatatggacatgtaggactgaagctagccagctaatctgtagatgtgcctcgagaaattaaacgttgtcttgcatacgtttgtgtgaaggatgacctattcatccctcccccctcatatttgggtagaattcagcttcaaaaaaaatattgggttaattggatacatgctattgcaaatatgccatattagaaaaagagtaaattgcacccacggtgcatcaccttagcaggtgggtgcaatttggtgcaagaacttgagaaatgagtgttctagtacaacaacttggcaaatatgtgcaatttagtataagaattttataagtgatcatataaatgtaacaagtaacaactaatatgtgcaatttagtataagaactttataagtgatcatataaatgtaacaagtaacaacttgtaacttgtaaggtaggtgcgattttgatacaataaactaagaaagtatgcgacaacttaattatttggatcattttctatatagattcaatttaagtaattatttttgacaatatactagtgtggatttgtataagcatatttatattttttattataataattaataacttgaagtcaattaaacttgatgtaaaaattattatatttcggttgatatttgagaaggtaaagaaaacaaaaaaaatcttaaggtaattggatgtaaactgtatgagcaatacaattattaaagattaaatttaatatctgaggtaatatccgtaggattgctatgtaatggcattattgatatcgggaaaaaaaaaactcacctagcatatgcctcgccacgttgatgcactcgaacgctcaattctcaagttgttgcactatatcgcacccacctgccaagttgttgtaccgtgggtgcaatttactcatagaaaaatgtcactactactcgcgatatcggctacgtgccactggaatttagggaaattggaaccatgccattgccgtcaaatattctgtcaactctgtctccctccatccctctttctctcttggctggtcggtgcaaatgacacagttggtggtggtggattgctgtggactggaggaggttgacggtgacagcggtggctcctgccgtggaagggaggaggttggcagcaatggcatagaccatgcccatctcttcagcttgacgacgctcgacggcttggaggtggaatccttggtgctgaacatgcgcagctggcctctagcaccatttgaggaagtgggaaggcatcgaggttgctaactccccccccaccagatatggatgccaacctcgtccatgatgagctggggccaccgctccggggatcggcttgccatccagggctaccgcttgataaaggagctcgccggcgcagcctttagcccttgtcacagccaccgacgaagaggaggatatgggaagacgccgccaccgacaaagaggaaaaattggaaggacgctggctcctgagtcctcccgcaatggatgggaagaggtcgatgacgaccgcggcgacggccgtggctttcgaacccttccgccatggatgtgaggaggtcgccgatggcggtggctcctgagccctcccactatggctgggaggaggtcgacgatgacgacagcaatagcggtggctcccgttccctttcgacgtggatgggaggtggtcgatgacgacggtggtggctcccgagccctctcgtccatggtgggaggagatcgacaatggcggcggcgacggtggtagaggatgaggagtgccgaagagatagattggagagaggaaggggaaagagaagagaggagagggaggtgaagaagatggaactgacagctaggtcccacatacagttagagctatcggagatttttgaccgataccgtgatgtagtggtatggttccaattttcctaaattatggtggcacttaaccgatatcgcgaatagtagtggcattttttaatatggtatatttacaatggcatgaatccaattaaccaaaaatatttgggtagagtacattacaaaatccaggtcttttaactcatgacgaaagaaaccattagatcactagcgtcctctggcaattcataaagaaatcgacaacctgctgtaaatatagaaataagaaaatgtctgggagttgagtttccttttatttatttgtttattactcccagttggaaggcatcactagacacccttggctatgtacatccgattatatgtagaggccagatttatcccatgttttcttaagggagtagctatacaactgtcgacagtttttgggatgaaatactttcaaatataactactatgtaattacattgtaactactattacattgtacctactatgtaactactatataactaatatgtaactcgagtgtaactcaaaaaagcacgatagggaaagtggttaggtgaacaaaactcgaagttggaggttgttgggttcgatccctactgcacgcgtctgaattttttaaaccgttttccttcaccagcacaaatctcaaagcatattagatggcttaaaatttgaaagttttcaccccctgttaactgtcgacagcagtatagcaaatccgtttttaaaaaaagaggagcactggacacccatcaggttgcaccctagtgccccaagctaaaaggagactagtctcactctcaccaactttcttctgagaaatttttgtgtcccggagttttgtctcaatttcttctatatctctaaattttgtctcatccttatgcatgcctttgagttctcattttaatcccttctatacctattatattagttcatctttttttttcaaaatgactatgttgcccctttctcatacttgcgagagaacactattctcaagtgaaaaaaagtcactcgtaaaaaaacaaaggggatggaattattcgactacaatttaaaatttttaaataaatatattttcaaatttagtttaatgaaatttgtacaacattttcaacacaatttaaaactaaataaaaaataatttttggttctaattctcgatgaaactcttgtgatatgagcaatagtggcatgatctttccatgagttgagataatcatgatttaggagagaagttagcaactcaactacaaccgcgcgagatggtgttgtgttgcgtcttagcggtcgatatacctctttgtgtattgttgatattgtcggtgcagatcaaccttattcctgcaagcaaatcgctaaacaagaaaaacaaaacaagattaaaaaaaacaaaagtgcaaataggaataaagcccatgataaatcggatacttgaaaggtgggttccgaagataagtaattgaacagtatagctatcacacataataataagataaagtagtaatggctaaattttaatataacaaaaaccaagagaagttgaaggggtacctaactatttcgaaagtggaaggacgattaaggttttctagagccatgctccactaggttaggcacacacaatatgaaccctacttaggctgagcttctatacgaagttacaagcccaaagattcatgataggtgaaacaacatattttttccgcaatcacacccgagtcagatgaaatttagagatgatactatgttaaaaaggggactcaaaaaattctgatggacggagctatattgatgttttgattagttgttgtatagtttgagtcattaaagaagtataatcttttattatagagtaaatttcataaaactacacgttttgtagtccaagttgcagaaaaccacacatactttgacagttggcacttaagtacatatattttggttgtgtaatttcacaaaaccacactattgataaatggattcacccgcgagatgacgtggctgtttcacctaggacgaggacatggcatcctattatcagccatcgcatgaaattaataggatgccacatccttatcctagatggaacaaccacatcatctcacgggtgaatccattcattgatagtgtggttttgtgaaactaaactaccaaaatatatgtacttaagtgtcgagtgtcaaaatgtgtgtgcttttctgtaacttgaaccataaaacatgtagttttatgaaatttactctttattatattgtcttgcaatgagatattcatggagtgatccaggtgctccttggaggagcttcgactttggtccacaaggatccctcccccaaatctactgtataggcatgggccattgaactgtttatcatgatttttttagttttcaactcaaatgctagttttaatggatttgtaataatatgagaaattattttctatatctagtttgaacaaattttgcatatggtcgacgttataatattttggaacatggaagagaaccaacaaaaaaatttactagaagataagagtgccattttataacaccaaatgtttattatagtaccatctgtgatacttgtctgattagctcgattttatgaacctttaattttaattagagtttcttgcatcggtttccaatggggaagtcccctgcaaaactcttgtcttgagaaaaaagaaaggaaagccccggagccgaccaccctccccccgtcccccgggcttcatccgctgcgaaccctagacatgtagtcgttcgccgcccgttccgttccgttccctatcccaggctctcccggccagcctccagcctccagcctcggccttcatccaaacaccaggctaacctatccctcgtgtaaaaaaatcctagggccgccttagtctttctcccctctcccctctccccctcccgcccgcctctcctcccctcccccccgcccgggcgccgccacctcccccgccctgcgagcctcgccgaagccccccgccgcttccttccgttccccctccagcgatggcgacctcggcgctgctccgggctctgaggcggccctcgtcggaagccgcgctgcgattggtgagtgtgattcttcttattattatgctgtttctttgattttttttttgggtccgcgaagcgccttcgaggaggcgcgggggggctgtactattattattgcggtgcgaagattggagcgccagccaacttgttcgggttcgtttttgttgttcatcgatgttgggggcataggagaataatgaggttggaataaaaattgttgatttagtatactgagcgagatactataaattgtggcttggtttgcctatgttactgtattttttttcttcattcgctctggtccatctgttgaaaattcaacatttagaacgctgtggaatgagaggaaaaattctgtttgttggctgacaatggaattttgatctgaggaaaatgggtacttttcaatcggtttttgtgcacctttagttcagtatcttagtaatcatatgaagaatatgtcgagcacataaaaggatattaaatgttcatatgaattatttggaagaaaaatacgcctgagaatcccaaagagaaagttagctataactgatctcaatcgaaattgttgaaggagaaatgttagttaacatatataatccttcaaaatatcaccggggaatgatgcacgaacaacaaggatgtagctttggttgagctgtatatggcatatcacttcaacactttgtgcgtgtagcttagaatgccggagttttattttgagactggtatgctgtcacagcatagcagtcttgaactaaatctctcggagagatagaaataattacttgctgcttatgcatttgcattagcaaagagcttgcctttattattgaacttggttaagatttccgttgagtagataaacattattctgtaaacatggaataaataatggcttccaatcagtgtaatatacttctaaaagtattttgatgctttattcttttctttaataaaatgaattgagggatgtctgtggatatattattcactatgtggtgcttatgttatttcaactttattccttgcgttatactccctccatctacttttgatagtcatatttcatcttggcacatagaccaaggataagggattatacttatcatccatttaaatatactactactcattcctcgtaaacaagtgattcattaatatttacatttctcgatgcctatgtagccaatcttgtgtggaagaatgaagagtcacgcattaaatccaagaaagccattaagatgataagttgttggattgtaatatgcctatcaaaaataaatttttcagatttggaaatatgactatcaaaagtagatggagggagtatttatgcatacagtttactgattgccgtctcccttatcatgtgtgcaggcagcaagtgtcagggtgcaaggagttactggatataggcatttgaataatcggaatctaagtgtctttaatgagttctcaaaacaattgaagggggaggctaagaggttagccttaatatgacaattgatatttccactcattccaattgtagatcatgttgacttttgcacaggaattaacaaagtgtttgtgaaaaaaattgtgatatcccttcttgtcccttaatatttctctggcatgttggctgtggacccagatgtcagtggaacatggtggttaaatagtggattgagtaaaattttcagggggcatgggagcatttttccttgttactaaaacattggaaaagatacctaacttttttcatgaggcaggcatcatgcaattaacaagcacacgagaggaaataagtgcctaaatgtgctgtagtgagttatatttagagaagaatgctagagttctaaacgaacattttggaatggaaggagtattagatatttggccttcagctgtttactcgggaatcaccttaatcttatcagcacttcttacttattcctgttttttggctgcagtaatcctgagttccagaaatccatgaaggaattcagtgagaaacttagtggggtaaaagaagatcttaaagtaaggtataatttaataaaagcaatgcacttgttccattttgagtcttgtacatgtggatgtttatcggtatattcttctttatgtaagaaattccagtttttctcataggcttacttgaagatatcataaaataacttctgcaggactaagcaaacagctgagacaatttacaagagcgttgatgatgttttgactgaagctgaggcaacatctaaaaaggtatgtcacctacagtggcccttcttgtatgatagtttggtctagaaaaacatgtcctattactttatttgttccatttcatgcttaggaatttggctttattgtaggttactgcaaatgtgaaagaaaaaatgtctgccgctacagaagaggttagtgataaatcattatggcgatctcacatcagtccagtatgtaacttactgttttttacatggagtttccttgctttgttgggatctattgataggtaaaggagagttttagactaggaaaagaagatacttcaagttgtaaggatggctcacctgaaacttcgaaacatgagtactctgagacatcgtcacattcagatgacaagtcacaagctggcacaagtggctatacattgtttaataaactgaggtcaacactttcatctgcttcacctgtgctgtctggtgcatttgcaaagttgagggatactagagtctcaacttatgctaagcagggatatgaaattttcaaagatgagctaagctctagctctagcagaaagaagagaaatcatgccaggcatgcttctgctggaacagttgaaaagagtactcgaactgagttagttattgtaccaacaaagaaatcagtactgggtgaaaagtgggaagcatttaagaataaggtactaaaggggacccctgaacattcatctcctttttttctactttaatcttccatctgaaacctttttttctctattaagatgcgaggtcatccagcctataagagagtgaatgaatataccaaaccagtcgtcaacataggacaagaggtaccatcggaattctgtacaattttgtttcatgaaactggtggaatgcagtttttcctgtaccagtgatgttttacatttgtacaggtagctgaggatgtacgagagcggtgggagacaagtgacaatccagtggttcagaaaattcaagagtaattgaactccattatttgtgctattgttgattctgatttatttcaaacagagttatgctatgttatttatttgttttatgatttagcacattatgttctgtataaaaaaatacatatggttgccaaaataaacagaatatcattggtgatacatgaattgatgaaaacttaacacattatgttctgtataaaaagtacatatggtttccaaataaacagaatatcattgatgatacatgaaaactaaatgcaataatctctttcttacagttgcaattagttaatatattttctctttgtttggtcatattcagaatatatcaacttgtgatgttctgttgatttgtctttgttcattccttgcagtttgaatgaatctatttttgaggaaaccgcaactgcagtgtctttcagggaaattcggcagagagacccgtaagatgttcaagaatatatgcaactcacagtttgataattttaggatatatctgaactatgtcaccattttgtgcacagatccttttctttgcctgattttgctggtgatgttcaagaaatgattaaacctgttcttactgcatattccaaggtagcatccatcttaccaagataaattctcattattgaactagcatgattgtgtggttgaaggtcctaatgatgtagtggaattatgaaaactaacgagtctgatataaaactatccgcgtgagtttgaagcggtcaattaacttgctttaatgctttttaatagatattgtctgatattatattaaacaatctaattatctcaagactacacattatgctttcagggtgatgtgaagaccttaaaaaagtattgcaccaaggaagtgattgaacgctgcaaaggagagagagatgcttatgcatcacagggcatatttttcgatcacaaagtaggcacttcttctgtcctatatttggcaacattccctgtcctgcagttttctttttgtaaactacagattaaacatatgccttccttagtatttagtcaatttaagccccattctgtagatttggattcattcatgtgagctattatttgttgcttgtaagctggactatatgaccccataaaaggaactaaagctggactatataaccccattaaagatatgattttctgttgccttgcagattttgcatatttcagatgctgatgtaagagaaacaaaaatgatgggatctacgcccatcattattgtaggggtaattggctaagtgtcattttaaattttaaatgtgtcatttttgttgtttattctgcttacatatacttttctgaaaatgtgtttcagttccaaacacagcaaatttactgtgttcgtgatagggaaggacaagtaacagaaggagggcaggtaggctatccatagggctatatgctgcttttgttgtactaatgtttttctttctattgacttgtgcattaatctgatagatggtagctttgttgttagctcaacggccttattgattacactctcataccagctccttgcttgatagaatttaactaaatgaatttttgcccatttggtaatttaatcttgcaaaactcatggcaatattctccaggggtaaatatcttttacaccaggagcatgcaccattaattatcttttttcaagattacacagctaatcatgtagctagagttgttaaatagtagtttcttattataaacctgaatgggaggttggacctgtacagtctaccattaaatagacggtctactattaaatagcataaatgtttatttcatttctatagaaccaagtaggtcatggaatttttgggtaggatcctatgaatttctaaaaaatatataatgaaccatatggttgcctttagaaaacattgttagggaataatgctttgctcttattaggttcttttaattcaaaggtggagcatagcccatattttgtaacaaataaactaatacttttatcgttttgttttgcttgaaattctggtaggacaccatccaaaccgtcttttatgcatgggccatgcaactgatggatagtgatgaggtgccagaggaagagtcatattacccggtttggcggttgcgtgagatccagcaagttggtatcaaagctctcatatagagtaggtcttctcttctcttgctatttctttctcaattggatcagtcattgccaaacatgcattcgctatttgggatggaagagcctaacacttcgaacttatgctgctgtacgatgtgatcctctcagttcagtgcaagcaattttcaacaaatagtttcatataatttatactgatgatagaaacctcttctcaatctctctctctctctctctctctctctctctctctctctctctctctctctctctctctctctctgccccccgctgatgtatctaatgtctactatgttttttttttgtgaagtcagctgttctttttgcatgttggctgaaaaagattgtataagttttgtaacaacatttttttttgtccctacttggaaaagaatgcaccggagtcttgggagcattttctatccaagagattatttagaggaggaaagcagccacctggtgcgaacattatgactacaagttggtaacagagtaacctgatggttgaaagcatgttctgtggtttcatttttttttgtccctacttggaaaagaatgcaccggagtcttgggagcattttctatccaagagattatttagaggaggaaagcagccacctggtgcgaacattatgactacaagttggtaacagagtaacctgatggttgaaagcatgttctgtggtttcagtgttgaggttgaaaattatcttaatgttttggcttttgacagtggcattttgtttgtttgccttcattaacattcacttcgtatttcgtacagtgtattttccgtatcatctcaagtttggctgaccacaactgcaaatttgttcaacatgaaatgatatgctcatacgcgacatgaaacgacgcaattgtctacattgcactgttcacttcaaataatttcttaagatgtttgatttgcaaaatctagtaatacatattttccgttttttctcgctcggggaaaagagtaaacactgatcgagtttaaaacaaaggggatttccgtctcgaatgaaaactagtactactcactgctgcttctgcagttaacaataacatgataacatcagcagtcaaatatgttctgccgctaacactaacatcagcaactgaatttttctcttttcttaactgagcaaagcacttggtgaagcatttgttgggaaaccaatgctagcttgcacaaagaagtcgtggagacaggttgtgaactgagtttggctgcgtatcgcatattggtttctttgctccagttgtgaactgttatatgctttctgcaatggttaaagccttagcttctgcaaatagtctgaccggaaatagcttggtaatttgtttggcaacaacagtcctttcggtagcatggatgtgtataactgcaatgtaagaatgaatgatgccatctgaatgctctgtacctgaatgttgaaaatgaagccagcctctatataagcttgactgtgatatactgattgttactgtatggtatctgaatggataaacacgcaaagtgtgcattgatttctgcttcttgttggtgaaattgaaacttgtttttgaaagtaagcttgattccgaaaataaacttgttccttgttttccataacctagtttgcaggccatgctgaaccacttgctatttctaggaaatactgatgcacacaattcctacaatatactgatgcttggagatagttcgatctgaaattggttcaacttgtgttagtatgctctaactgaggaaaattcgatgatccctacccaacactgaaccacgtagtttcagagtacacagtaaaacagtatccacgactgctgcatgcactgaaaatcctgaaaattcaatccaccaaaatatcacacatgagcagacttgtacacaaatatgaagtgatgacatccagaatatatttgtttcaaccataggcgatattttccaaccatatatacaaaataacagtagccgcagacaatttgtgccatcaatacatattagaaagagtagtagcagcggccaattcttttagtgcagaaaatctcctagaaagagtgctaccactattcatgtcatactttttttctatttttgcagtgtcctgaacaatgtaagaacacagcgtagaattttgcagagcactatgaagaatctgaaaggaaaaaaagaaacagagcagattttccagactcggaaattccaaatgacaagtgaaaaaacaccaaacatatcgcaacctgcaccatgtgatgggcagcgatatctgatatagaacattgagaactatggatcttgaaaagcatcagatacaagccatactccccaaagcaacagccaaacacatattggctctatagccaactctacatcagaattcatagaatacacatcccacatgcttgcaaatcaaacaacacaccggaaaaccatctagggaaacaacacgccagggaaagatgcaccacaatacataggggagcaggtttaaacaacacacagagcatactgtgcatactatcagatcagtccactcaatctgtgaaaccaaaagcaccacaatacataggggagcaggtttaaacaacacacagagcatactgtgcatactatcagatcagtccactcaatctgtgacgttcacgtccgttttttgttctgcacgaatggtccgactacatgggccctgatgcgcggggggtgatgggccgagaagtactcttgtccattcggaacaaggaatcttcacgtgggcagtaagtccacttgcgatccctcatctttacgttgagtttaattgatatccctaaccctaacaccagaaatcttcacgccccatctttccgaaaccattcaaatcagatcatttagtagtattggaggtggttttagctaacgtggtatcctagttagcaaaaagaaaataaaaaacatgtgggacccacatgtaagtggatttccaactctccccatctatctcctctcttcgagtttgctggcggggaaagagctagtggttggcgagcttgtctgtgggaggtggccgacggcgacaacctccatcgcgacggtgtcccaataagggagcgctaatacaaagacgaagcgtccatgggagtcgagtaggggtgtgttgagggaggcgttgtggcggaggttagggagcgtcgtggggatatccaagcactgctctaggacagggcctagtgggtccttggtgattgcgacccagcggaagagggagtccttttggcgccacagtggaggcgacgagggagaggctttctcctcagcagccatggagccttcttgcggatttccccgacagaggtggcatggatgggcagcaccacgcctagggcaaggctagcagtgccaattttcgagccaagctcgaggagggtggagggaggccgagagcaggcggaggagggtggaggccaaagctagaaggtgagaccgaatgagggaagggtgcagaagttgatacggaacgggagcgtgggatggagagaagcggttgctctagcacagatacttgatgatggactagatctcaggcttcacgaacttgatgatggactggatctcaggcttcatgacatggggttcctcggggagggaccacactgctccaagatgggggcagtgggtctgtggttgccatgatctgagagaagagggagtccttgtgttgcagtggaggcagcgggggagaggctttctccttggcagccagggagccctcctgtggattccttgatggaggcaacaaaggggaggcggtttccatggtgactgtagagtccttttgcggttgccgcaatggaggtgcaagtggtgaagttgtgccccccccccccacccgccatcgccttggccgcaacaaggcaaggcgctatcgctgcccctcctcctaccgttgacgaccaccggcctagagagagatggggaaagaggggagaggtggggagagagatggtaggaatagaggagggagagggggattgaaggaagaagaaatccttgacatgtgggccctattatatctaggctcacttacatgtgcgttctacatttttttattttctttttgccaactaggatgccacgtcagccaaaagactcgaggatgaatgagccgggacttatagagcccaacggtgagctctcctgcttcttcttcttttatccatgtagtctattcctccttagggagagcagcactaggccgtgttgtcaattcggaacaattacacagacacacttctacttcaggggtgtttagatataggggtgtaaatttttggcgcgtcacatcaggtattatatagggtgtcgcatggggtgttcgggcactaataaaaaactaattacataatccgtcagtaaactgcgagacgaatttattaagcctaattaatctgtcattagcaaatgtttactgtagcaccatattgtcaaatcatggagcaattaggcttaaaagattcgtctcgcaaattagtcgcaatctatgcaattagttatttttttagcctatatttaatactttatacaggtgttcaaacattcgatgtgacaaggtgaaaaattttagtgtgtgatctaaacaaggcctttgttttggaatatttgggggtatctgaaatttcggatcttgcttcagttctaatagaatagatagcactttttgccatgctagttctttttctttggactctgaggatgtgccgggacttatagagcccaacggtgagctctcctgcttcttcttttatccaggtagtctattccttcttagggagagcagcactaggccatgttgtcaattcgaaacaattacacagacacttctacttcgggggtgtttagatccagggcagggctgtaaaattttggtgtgtcacatcgggtattatacagggtgtcgcatggggtgttcgggcactaataaaaaaactagttacataatccgtcagtaaactgcgagaagaatttattaagcctaattaatccgttattagcaattaagtctaattaatctgtcattaccaaatgtttactgtagcaccacattgtcaaatcatagagcaattaggcttaaaagattcgtctcacaaattagtcgcaatatgtgcaattagttacttttttagactatatttaatacttcatgcaggtgttcaaacgttcaatatgacagggtaaaaaattttagggtgggatctaaacaagaccttcgttttggaatatttgggggtatctgaaatttcggatcttgcttcaattctaatagaaagcactttccaatctctagtatgcatattgcaattgtaacaatggaacatggaatatattttaatagtatgttttgtattataaaaactgctactttttttataagcttgatcaaatttaaagaaatttatttgaaaaaattaaagcgtcagttgtctttttacttttgggtcttcatatgcaaatcacttggtacaacaaaatattaccgtatcatctcacgttttgctgaccagcaactgcaaatgttcattaaggaattgcatcttcataactcacaagtgacttgaaactatgcaggtgcgttggtctgttgcagacaacgaaatgtccactccaaacaattttcttaaaatgttttggtttgacaaaaatccagtaatctcttttttctgtctttttggcacctcagtataaattggtaaaaccaaacaagtacactgatggagttcgggacaaaagcttccacaaggattacacaaaatgccagctactcataacttgaaatggtattttctttctcaaatttaccagccattagtatggtgttcccctgatctatttgattcctctgtttcagagcagtgaggtttcttcccggactggtcagttctctaagagagggccactttctagacctgactaggcctttagttggacaaaaagtgctgtgtttggtatgctctgcgcagttcagaaaatcaagagtgttatccttttttttattttattttttgccttttgcagtgtgttatgaacaacgaaaagaaaaaacagagaaatttttccagacttggaaaatcgggatgacaatcgaaaaaaaacaccaaccatgatgtcacaacctgcaacatgtgatggcaagtgatatacgtactagcacattgacatgtcacaaaccatactcttcaaagcaacaacaacacacaaattagtatctaaccaacacatacatctactactctacctcagaattcagagaacccacatgcaaatcaaacaacacaacgggaaaccaccatctaggggaaccaaacacaccagggaaagatgcagcagaacactgaggcctgaggggatccggtttaccataacaacacaaagtcacagagcacattccatactgatcagaatatcagatcactccactcatctctgaaaccaagtgagcccacataaatctcacaatagtgtcttcacagatgtgccacgatgcacaaatcgaagtgtagaattgctacctacgcaaatgcatgaacaagagagaagaacatcttgttgcaggcatccaagcccaatatacacatctgaacactcaaaccaaaaaaaacagagaagaaatatgccaactatagagaaacgttagaaatcagaaaaccaaatttcttaagacaacctcaacgaaccacacgccattgtgccaaccagcatactaattgatcaatactagtactaatccagaaatagacaaagaaatcatttaatatgactaattaatcaactgcatgcaggaacagatcagcataaagcggcaggggcaaaacatttcagttgatgcaaacaattaagcagttgaacatttcgatcgacacacaccagattctgttctagttggacatgatgcaaaggaaaggtaaaaaggcaagaacgccgattcgatctgaagttctgaacgaacctaccagagataactacggggagcaaccacacgcgacgggttaagcgatgatgagcagagcagatgctcgatcggggagggaggggacgctagcttctactccggatccgggaagacccaggggttctgctccttgattgccttgtcttcttcctcggtgaagtcgttgcggatgttgaggatctggcgcatctcctcggaggtcttgcccttgagcatgtcggcgaccttgcggcaggtgatgtggaagaggcctttgatgtcgagtaggtgggcgacgaggaggaggtcgtggaggggcttcacctccatgttgacaaactccttgtcccagttcttgaggtcctcctcctcgtcgtcggtgctgctgcttgacgccgccgccgccgcgccggtgttggtggagacggtggggttgcccttgtcgtcgaccttggcgtgcttggtgcagtattccttgaccttggggaagataccggaggagatttggtgggggagctcgatcacgccgccgtggtcgatgctggggtacttgtcgaacattttgcggatggccgtgcttagcatcgccgcggccaccggcatgtggaaggcctgtccgtccgagcacctgaaggagatcgtcttgccgccggccttctccccctccccgctcttgtccgcctccatgactctcgctcgctcacgacgaaactctaacctcctcttctgatttgctagcgagttggcgctccgctcacggtggatgcgaggcgaggtggaacgaagaatgatcggcgtggccgccgttttatacacgacgacgacgccgcgcttgccgggttcgggtctgagcccgcttggagcggaggcgtgccggaatttgcttccgtctcccactgcagttttctctcaggtttcgcgtccgtttcttgatttgcacgaaagaatagtaaacttactgggccgttctgcggcctgcgagagaggggaagaatgggcccagaattactgtgttgatttatttgggaataagttcatttgaggtcccttcacttgacaccgatttcatctctgaaacactggtccctcaactgtcaaaaccggtgaaaataaggtctaatacggtttgaacggtggcttaagttgacatggcgtctacgtggctggtttgacttagtcatcgtcctacgtggtgatgatgacactagaagaaaaatatcgtcctacgtggtgatgatggcactagaagaaaaatatacaaattaaaaattaaaaaaatatggggctcacatgtcctccggttgagtcagcgtgggccctacataggtcccacatgttagctgcgagtggctccttaaccaatcgacaccagcgagacagataagagagagcagaggaggaggtgtcgacgaggcgggcgtggatacggccgaagaagttgccggagtcggtgaagaagccctcgacagcggcacgtcggcgcctccttctcccctctccctcttggccattcttcctccctcctggagcttccttgtcagtcggctacggttgttggcatgccagcgttgtggcgactcagcaacggtaggtgtggctcgcgaaggtgacggctgaggctctgtgacggcctcctcactggcctccttcctccccccgcccgctcgctggcctccttcttcccccacccgctcgccggcctccccgcctcctccctctccgccggatcctgcagcggcgaccgtaacaaggctattgtcggccatggagtgcacgagcggcgggggagaggagtggcgtgcaatgcggtggcaggagaggagaggagctcagacttgttgtcggctagctcggtcggtttggtctctaatccagatttcttcgaacatttgttcgcctaggattgtgtcacatatgtttgggcaatggactttgcgacaaaccaaatagctcagacatctttttcttgtaggggcagcaacaacttattgggtcacttggctttcgaggaatgattatgggttttgaaagcaaatatgtttcttctcctttgctagttattttcttggttacacattagcttcgagcatgggctattctccagaagcccggttcacatagttttgtcacttcggcttgtattcatttggagcatgtggccaatgagtttttttttcaccttggtgcatgggtggcaacatagttttcaggtgcaaggttcttgaaccttagtttggtttttattttctttgtgtgtgaggtgtgttggttgtgtgcactttcgtagtgtagaggctaggagtgtccttaaaaaattttgccaagttcaataaatcttccattatcttaaaaaaaataatgtcctttttttttcatttttactaggtttttgcaacttgtcctgagtgatgctttaattgatttaaaactaatctgagtgctacatttctttaaactggtatcaacatattggatattttgttaagggttttttctttgttcttacttcctccgtttcataatgtaagtcattttagcatttcccacattcatatcgatattaatgaatttagatagatatatatgtctagatttattaacatcaatatgaatgtaggaaatactagaatgacttacattgtgaaagagagagtaccaattttaggttaatggaaatgagtgaatgggaatagagtttatttgagaagggtgggaatggatttaaattgaaggtatacgtatggttttcattttggcattgttttgcatctcgtgctaagggcctattcggctgccggagttgcagctgcgccgcaaccaactagtacagtctgacaagctccaagatagcaggggctgcaacagtcgcagctgcagtcccagcttgccgaacaggccttaagtttgtttatttgagtgaatgggaatagagtttctttgataagggtgagaatggatttaaattgaaggtaaatgtatggttttcattttggcattgttatgcatctcgtactaagtttgtctattttgaaaccaagagagtaagtcagtagtgtggattctctcgtgtaacaatgcactcttttttgagtcggtagaagtaatttgcaacatctcggttgcaaatgttacttattatattatccctctttcaggttcttttagtgaattgcactttagaccatcttttattaccttaattttactttggatcacctcgactctctttaatatccatcctatactcggacaaagatatggcctgctcagaggtggaggattttggcagcatgccataactaatatcctagagattgttgatgtggtaaagtggctttggggtgttccaaagtaaaataaatgtaaatttagctagtccaaaataaaatattgaattatgagtgttctaaagtgaacggtaaaaaagataaaccaaactgtaattcacactcttttttttcactgaaccgaaccattatctgccaagcaaacaaagtctgaaaaaccctaaacctcgctcgcccatccccaccccacctcctctgtggagcaaaagcggcgcaatgccgctcttccgcgcggcggcgctccgccggctgctctccaccgcggcggcttcgtcggcacccccgaagctatggaaccttccctaccgcctccggcgcgccgccgtccccgccgcgcgcgccgccgtctccgagtacctccacgccacgcgctgccttccctcctcccacgccgacaccatcgccgcgcgctccccgcgctccctgcacgccttcctcgccggcctccccgctgtgcccagctccctccgcacctccgctttcccctccctcctccgccgccacctcgccttccacccgctcaacgagctccccttcttcctcgagtccatcggcctgcccccgaccacgcgctccgacctcatgttcctcgccgaccacccgtccctcctcccagccgtcgccgcgctcgcgcatttcggcttcccctggtcccgcctcggcctcctcttccccaccgtcctcctccgcctcccgcccgacctcatcacctcccgccttgcctctctcgaggcttgcctcggcccgctcccccgtgccgccatcatcgccgcctgcctcgccttcccctcgcttcttgagaacgatctctccagcagtgaccgtctcgtcgacgatcttggcaaggtgtttggaaggctgggccctggtttggggacctccaatgacattgatgctttcttgggggtttgccgcaggacatggatgttctatgatgctggttcagaggtcgggggcattggggaccttgtcggctgcaacaaccagagggtgtttcttgagcttgaggaggagaggattggtaaaatgttgaagtttttcaaggggttggggatggcgggagaggaggtggggagattcttgcttaccaatcccatggttttttatcttgaatttggtgatgttgtcatttcggtgccggagtacctgaggagagttggtttggcagtgaatgaggttaatgcagcggtggagaagcacccgtacgttgttgggaagaacctgctgcagaacctccctggtgtgctgcgggcaatggaactggatcattggttcctggagaagatttctgatggtggggagagtttgcggtatttatttccagattttgtgttggaggatgttagttatgacgttgagattgagcgagcattcttgggagggatgattaagatgaaggctgataaaagagctcagcatattgacggcaagctggaattcttgaagagcattggatatggtgagaataagatagccacaaagataatagccgtactgcacagcaatcgggatactctgcaagagagatttgattgcctcctggaaagagggttggagtacaagatgctgtgtcagatcgtgagtgtattcccaaagattctcaaccagggaaagaagatgcttaatgacaagttgaactatatgactaaggagctaggatactcagtggagtacctcgagttatttccagcatttctgtgctttgatttggagaaccgggtaaagcctaggtatacaatgcttcggtggctccgagagaatggtcttcttagaagaacattagcccctgcaactgtgcttgctaactcagagaagaggttcatttccaacctgtacaatgtgcatcctgcagctccaaagctgtggcttgagtgcttttcttcaagaaagcacatggagtattatctcaggaacatatatcaccagcatgctgataccaaataatttaatgtatttaattctattgatacgattctgagaggttaatgattgttacctgcgagtcttttgtggcatccctctccctattgagggtacttcttagttgctacaggtttcactctgcaaaattctttgctcctgcatattttaacaatagtatgcaggatgtaggatggagtagaatatagcaatggaaaatgaatgtaacttaattttcataaaaactgagttgtacattgtacctgaataatttataggttgtaactgatcttggcttcgtttattcatgagtgcatggctttgattgcattatattgtgagaatttcttcctcttgaaattatgttgaaaattgttgcattctttgctgtttggctaatttgttgtgtatcagtcttcaagctctaattccatcctgttgcaatcagaaaatagtttgtgcatcccaatcaaccatgagctgtaactttcttttaaaccaggtggtgctgatcataaagtagtaaggaatttctgttacaatcagaaacaatggcaggactgtcgaagaagctcatgaaaaatattgagaatacaacccaaattgcaaaggatggcaggactgtctaagaagctcatgaaaaacattaaggtgaaaaatattgagaataaaacccaaattacctgactgttcctgtattctagtacctcggatcgttctgaaatttttatcgatttgtgccattttgaaggttgctaatgaagcaagagttgatgtcaggttgaagataaatccaattttgtctcaaagatgctcttgataagtaagcattcaactccaacagttccctttattcctttatttttcaattttggtgaaatgcatatgtactatttcttgtgtattgtggtcacacttattttagcagattctcagaactgattaggctaatatgagtttcataagacattgtgttttgtacttttgtatggctacattcacaagattttgaagattcaaatatgtgttgttatgttggaccattacaccccattatgttgtttactgttgtttacttccagcaacctgtcagaaatttaattcgaggtttctattcacaaagctgggaagttgctttatgatgatattgcagttgatttgctattaacagataaaatagttttgtatggtatgaattgattttgttctgccaccatgtttgctcccacctgaacaaattaattgcgttatccacggtaatttgtaatgaaaacgacaatatttctaaccccccccccttcttctgtagtgcttcccgatcactggcactgagcaggccttgctctgctctggtgcagactcaatggtgttgatccctaccattggtatctttccctagtccaatccatgacaacaccaaggtcgagcgaaatcctctatggacctcatcacatcccccccccccaccacactgtttcttggcatgtcatatcattgtactaaagaagaaagggtagaatcctgagtacacacgtgcaccttagtagaactcagattatgttcacgcctatgacaaaagactaccaacaaccacctctaaaagactaagatccaggcgatagggctcttaggaaagagagtcctcaagccccagccaaactccagaactgcacttttttcttggcaagtaacagggtgctcgtcaggttaggagtggcaccatcaaacacacaatggtttctatgcttccagataatccatgccccaaggatgacaagtgagttgaggccctgctgcatctggccattaacagcatcactgggcatgctccaccactcatcaaaggtatgattggcaaataacagatatgcaaattaacaccatatggctttattctccattggtatcatttgatcttccttctatttttttctctcattaagtttatatttgaacaatattcggtgcatccagaagcttattatcgttttgctctagtttcagcctgtcgagggtcaccctaatgtgacagggtgttgcagcggcgagcaaaagcaatggccacatcagaagagcgtgcctgttggcccattccgtgattttccattggactgattcagctgatggactcatcctgttcttgcaaacgctgtatccgagcaactgagcatatagcttgctatatttagttgcttgtgtattcaatgctaagccattaatatgtgctcacaaattgctccctgtgttagtacataagaggctctccagtaaagcacctgtaaggtgcatgttgaaatgcctctgtgtgctacagagggaagtgagcataatgtttttaggaagagcattacctttgctcatttcagaaagtattatgtgttagaaagatagtaagcaccaattcggaggtgataattaatttcttctttaatttcattgctattaatttggtagtcttaacagatgatcactctcactctttgtctctctccaatctgcttatatatgagtccgccaacctttttttataaacacttaacagatttatagcttttctcatagtattgtgctacaaattgttgtcaggcatgaagacaatggggagaaagacgcttaatttgtcaagaaaggcctgggtttcagggatttaaggctcttcaatcaagctcttcttagtcgacaagcgtggtggctaatttccttccctgacaatctttgtgctcaaattctaaaagccaaatacttccctaactgtgacttgatagatgcagttttccctagcgattcttctcctacctggaaagcggtggaatatggtttgcaacttcttaaaaaggggttgatatggcgcattggtgatggaaagaaggttaaaatttggcgtgatcagtggatactgagggagacttctctcaaattggcaggccagaagggtaggtgccggatgcgatgggtttctgaaccgattaatcaggaggacagatcatgggatgttggactgatatatcaggtgtgtcaaccttgtgatgtccctgaaattctgaggattaaactaccgcagtatcagtcggaggattttcttgcttggcactatgagaagtcgggtgttttctcagtttggagtgtttataaagtcgccttgaagtctcagctgccttccaatatgggggcatctagctgctcggcgagtggagaacggagcatctggagaagatttggaactcagttccaaataaggttaagatttttgcttggcgtgtggctaaaggtggctactatgtgcaaccggataactcgaaaaatggaaaataatgctatctgtcgcatttgtggtctggaggaggaagatgagttccacgcttttatttcatgtacaagggcgcgggagctccgtgacagactgcgcctggaatggcttctcccggctgaaatctgttggtgagatcagggccggttggctgttgatgattctgcaacatgtgtcaaaggatgtgaggtcctgctttctcctcgttctctggagggcgtggttcttacgaaatgatatcttgtttggtgcgggtcgggcgagtgtagagggatccttccttttcctgctaagttactgggattctcttcggcaagataaacaaaactgccctaaagactctggatctccatggcaaggcgagttgttgtcctcagagatcggagccggtaaaggaagatggagttcagttctctaactggaggaagcctccggtggattgggtcaaggttaattcggatggtgcctttgtcaggagtacgggagatgcaagtgccggggttgtgattcgggatcatgaagggcgggttcttctgtcttcttggaaagtgataagaaattgtgggtcggcagaggaggcctaagtgctggcttgtctggagggcataagactcacggtggaatggattaagcagccgatgatcctagagagtgattgcgcaaatgcggtaaatatgctgaagaatgggccgatggacagatcactgctgtggcatattctctccgaggctaaagccaagttgaatctgcttcccagtgctaggattggaaagatctacagagctgataacggtgttgcccatagtcttgctcagctggctctgaaatctaagcaatctaccgtgtggcgttttcaagttcctgtgtgtgcgtgcgagcctttacctcgagattgtaatgctcctggagtttaatatatttcagtttttcctcacaaaaaaaaaatcttcaagtctttttctttcttgaaaaaaaaagacttcatttctttaagtataaaactatggtgatgtctacagaggaaatacatgctacagttttactctggggctttatttgccagtactctactttatcactgtagtctacgcacacttctgagaacaattcaagattttataaccaaatatattttagttttctctggactaggtttcagtgcatactaacacaaataaaagaaaaagaaatgaagagctcaagactcggttgtaattcttttgtattattctgtctgctttgcgtccattgacaggtttcttgtttcttcttgagagaggaatttcctatttaaatattcccaaatatccatcaccatttagtgtttcctctcggttactggtagtaacgagtaattctttcacattaaattcaatgcagattcatgtttgtttttctgctagttattctgtaccggttgtcttcatttttactcatctgtttttgctcctagagctgttatctgaatgccttcagtcttcaaatatatcgtacttttacagtgttcctttctgccatcttatggtctgtaactttctaaatgggtcagatcttatttgaacaagcattagagcccacttcatggactattaaccctttaagatatccgtgcggctttagctatctggattaaaaacgtgtgtgatactgttaatttttgtccaaatcctgcgcatagtgtgctgcccttaattgtcatgtaggagttagggccaaagcttcgaatattaacctataggtgtgtgtggtatccctgatgtatcctagctgctgttgctacttagattgcccatcaaataacgagaacacttttgctatatatttatcgataaattttctcctaaaaattttagagatgtaattataatactgtaaattgcatgtaactacaatgtaactataatgtataacttgcatataactttcatataattttgaaccattaaatttgttttaagatttgtgcaagtgaagaaggaaaaaagttattgcgcgcacatatgtgagaggattcgttcccacgacctccgtttcaccgaaatagcatgttacagagagatttttgaaagttatatacaagttacatgtaagttacagtataattatactacgattgtactatagttgcatctgttaaatttctagaagaaaattttgtcaataaatatataggttgatccggcagcagtggcactaaatgacttaccagattttttgtttaaatgaccagccttcctcaaagtggcatcatgtcatcatttacctcttctttcatcgtctcaacattttaaatgttgaatccttccattaaacagatattaatggttaaagttaacttatgaactgtacatatgttacgaaatgtgattcatttgtatgggactaaaattatcatactctctaacattaattcatggactacccagaccattatcttgctattgggttaggcggtaactatgtttctttatgaggcatatgacttttctttttcacactatttctttaacaagaaaacaaagatcaaacattatgtccaaaagtaaacagtgtcgtatatttagaaacaatgcaagtacattataagtttgcgattgcaacgcatacacaaatatatcattaaaaaactgtatatgtacatatattttgctaaattagagcgctagtgcgtagtattagcacccttgagtgctagcagtgcagccccgtaggccgcctccgtctgctccgcctttctcaccggaacgccaagcacccttccccttatcgccgtccacttatcgttccgagctcctccacccgccgtcaaaacctcctccaccatgctcgcgccgagctccttcaacagattgtacccctttgcctgcttgccgttcgtccacataccaaatttcatttttttagaaataatataattttaatggaaaattataaaaaataaatattggttgataaaaatcacaaatttagcccctatcaaacaaccgtagttcgataatattgttcgacaacttagttggcctgattaaaaaaagaaaagagcatgcatggggtggcctaacgaattcccgaagtttgatatgtcccacagcccattcacatgcatccacacacatctaagtccctaacttcttaaaccttgtcaaacaaccattgttcaatagggtgcttaatttgtgatttcagataaacaacatctatttttataattttccattaaagttgcatgatttctaaaaattaccaaatttcaatgtccaataattcagtttttcttttaactcatgctaatgcagcgcagaaaaaagatatcacctcaatccgcgcgatcgactccagtatgccatgcaagtacgccgtgtcgctctccggcctaggctgcagccttaatgcagatatatgagacaaaaacattcaaacacaaataaatgttgtcaagatcaatgaggcctacaccttctgtcccataaataaaataaacctagtacattcttctactatgaatttgggtaatttttttctagatttatagtattaggattctgtaataattttgtagatttatagtgttacgagtatatatcatgaaaaagaaaagagttgaattagtaaatgatgatttacttgtgtaccttggcatcatgttggggtcggagacagggaacctttctcctctcttaggcagagggtagtaatcgagaagggaaggaaccgacgggtcgatctcgtggctgagagcgacgagctgatcgtcggtgaagagctgcctgaggacggcgccgccggtgttggacgcgcccccgaccagccacatgtcgtccagccgatggctgtacacgccgaaccgcgcgtcgtccacgcgggcgttgctcagcagcttgatcgccagagttgaacccaacgacgtcacctgatcatcgatccattcactgattgattcgtacgtgtcatacaaaaaaaacattttgtgaattgcgattcatccgtgtcgtagaattaactcacagctttcccgggctctgtggtgcgcgctgcgagaaaagcggctatgctgtccgttgttccagtacagaccacgcagttcttgggaaatcctgacatgccaatgccatacatttcaataaaagctactaagtttgatgtcattttgtagtcacgacatccaaatcaatatatagtttaacgagatccaagaaaaatatgagaattaagttggatctgtaccaaactgtgcgcgtacatcctccttgattgagccaattggagctccgggtgctctaacagacggcaacatgtaagcatatggctgtgacatcaaccaacttgggtacgagtcaatctctggatcgtagcccacctgcagcatgaaaacactataaataagggcccctttgaatcgcggggttgaaaaaatagaggaataggaaacacaagattctgacagaaattgaagtgtaaaatagatgattgaaaaacacaagaaaaatacaggaatgatcgtttgattggaccgcaggaaaaacgcaaaaatcaaatgagagagagagactcaaaggaagtttccaaaaggttagagttcttgctaaattttctccaaaatctctatatgattgtccattccataggaatttcaaatgattggttaggattcaatcctctgattcaaaggcattcataaaaaaattttctataggattgaaatcctccaaaattcctatattttttcctccaaatcaaaggggccctaaatttctggcgagcaattcctgtactacattgaaatgcgtttttttctcaaaagaaaaatatataggacactaatgtggacattcatcgtcagttacatgttcatatagtttcatctcgctatgtgtgtacatgattaatattaatagagtgaattacactttagaccaactttggttgccgcattttcactttggactagctaaatttatgtttgttctactttggaccatccaaaaccacttctttagcacatcaacggcattgaggacttggctccaccacgctagtgaaatcctccacctatgagccggtcatatctttacccgagtataggatagtcatagacatggctagagaagaaagtcaggatggttcaaagtgcaagaaatgtaaagttagctagtctaaagtgaaaaaattagatttggggtggttcaatgtgaagctatgacaataaaaggtggcccaatgtgtaattcagtcatattaataagtaaaggctctctggatagggggtgtcaagatatataattaccttcagagtgttgttataatcagaaacaccatattctccatgcaaaagccagagcaaccagtctgactggtgcatcagtatcgctgaatctctactgctcaagcctgctgagctcgaattccaccatgacacaagcttgcacagggtggacgaaccagaacgcaccgtatgatttgccggggcaatcgattcgactgctggcagcgcgtctgcgaagctctcgttgtagagatatgggccagcaagaatccctccattgttcctaattgcgagcatgcatggtcagatacttgcattagcgatgcaccttttgtctgactgaattttgcattgaagcgatgtggaatgtgtaaggatctgaggaacagaaacctgtcgatgatgaaagtggtggctgaagtcccgtcgattgaaatggaagagatggatggccggtagatggctgggatattacccagaagatggaagagagcttctctccaggagcttgcccagtttgtgactctaccaacctacctagtaactcaaaccaaaggatgtgtatgctcgttaggagtgaacaaataatccaatgcagtgatgatggcagagaaaaaattacagccatatttttcaatcttgttctacctatggactgaaaaggagttagctggttgattctgatccaattaaacgacagttttactgatattttaagccaataaaacaaaacttgggataatcagttgttcatctacattcttcagccaaactgaaaagaaaaaaatgatcagagattcacaaaactcgtacaggagggtaagttcttttgccttcagaatgtatggccccttgcttatcgacaagagcatatctggcacctgaagttccaaagtctatcccaagatatagaggctcgcctgttccatcaaagctcttcttctggcctcccggatttttttgcctaagcatcataacccttactcttgatgtacctttcgttgtgaacctggatgatcctgaaagtaccgccaagaaagaatcatgcagataaattcagaattgtacagcacgcatacatccagggtagaagttaaaagagggtcgatagatggtttcacttgcctcgttttgcggggaggtgagacagaggcttggcagagacactggcaattggcattatttggtctcgatgcgacgatcaactcgtttggatttggagatggagaggggggcgattaatgtcgctcgtgccgtcttagagggagaggtgccgtgccctctgggctggggaaggataaggatcctttggatggaagaccgttacgctccgcagactcgctgcatatgggtggctcgctgcacccttcccacccctggacgtactgacgttgtacgacaatcacagccatttcccagtctcacgcaggtaagggggtgtttagattcagggtaaagtcttagagtgtcacatcggatattatatagggtgtattattttattattaaaaaaaataatatagggtgtattacagaatccgttagtaaaccgcgagacgaatttattaagcctaattaatcagcaaatgtttacggtagcttcacattgtcaaatcatggagcaattaggcttaaaagattcgtctcgcaaattaatcagaatctgtgcaattagttatttttttagcctatatttaatatttcatgcaggtgttcaaacgttcaatgtgacaaggtgtaaaattttagggtggggatctaaacaggccctaagcttgcaactcaagggtcgaactcggcacaggctcagctccccaccatagctcctttatatacacctatagagaagagatactgtagatattcagggatatttactgtatcataaaaatgatatatcaaaggcagcaaaaaaagccagctaccacgatcgttagggcatcaccaatgtatatggcaaaagtagtctatatagatgagacccacataaataaactttaactatagcaatcctcacaatatgtatgtgtcggtgaaatgggcccgggggtacgcacagtagaggaaagtatccttcccatctagtcgcgtggctacacggcctcgcctccccccgccccttgggtagcgctgaggtggccaggggacctcggggtgccatgtcgcacccctcgggctttcagggcgtgctaccccgaggccctcgcccggccaccacgtggcggggagagcaggcggggcgaaaaacactgctccgcgccttcaatgtgcggcgccccaaccgtcctgcgccgcaattaatgcggcgtgggagggacgtgtggcgccgctcgattgacccatgtcaatcgagcttgaccggcctgtgaccgttcataggcgatgggacgggggcagtgcccccacgttctgccctgtgtcaggcggagtgggggcaggtataccctgtcccattgacacgttgccaggggcgccccacgcgcatggtgagccgccaaagttttcatacaattaatagggaatgacaggtatgttccccgtgtcaggcggggggcggcgctgggccccacttgaagccaggtggccatgctgcttccggttgaagcaaaggatagcggtatgattagggccatgtgggcctcccctcccatggaggggtaggtgcaaacggtgcatgtggtatccccttaactataaaaggaggacctcgcccaccgagaaaaaggacgactctgagatagctcaagctctagaggaagaacagctagatttccctctagagctcaagacctcttgtaaaagttgatcttaatcccacacacaggagtagggtattacgctcaatagcggcccgaacctgtataatccttgatctcacgcacagccacgagagcaatctagcagttagaccgcgagcggaagtaggctcccgatcatcgcgccatttcccccggccgaactcataaaggagggtctcacgaccacccgctagagaggatcactcctctaccgtatggatacaaggtagcattaagagaagagagagaagtagagatagataatattatttattttatatggatagtccatatgcatatggataccttttgttatttactttatatggactagttgcacaatgttactaggtggctgaatggaatagtttattccctatggactacttttgtactacattatagatgccctaaccatactaggtgtgtctggcacgagtcatcaattaatcacatcatacaccactagtagtacatctgaatatatagacatctccaaaaaaaaaaggaaaatagaaacgatgcgagtatatagtaacttttttcaagacggtaataacgacaaatttcaataccattgcattgtccagaaaggatctggatatgtctagcttgccaatttacagtttaatcttgctatttatcttcaggtaaaaacagaacgaagaaaaaaaagcaacagatggtcatataattgacaccgacggtgccagaacactgaaatgcatggtatgcaaccctataattctaggtatcacaagtttatatcaaacagaattaacacgcaactgaacatgcgatgtccattgcaatcactgtacatcaagtcacgcagaaggttgttcagcctggggagcagttgagctgctaccgttcttccgggacatactgaaaggcccggccacagtcttgcccatgaatttcccagctttaccgaggccgctgccgacagcgccaatacccgaaccaacaagcccaacacccgaaccaacaagcccaacaccagcaccaattcctgatccaacaagtccaaccccgccgacaatgccagtgcccacaagtccaacaccagaaccaactagtgaagcagcaccaccaagagcatccattgtactaccaataaccccagcctccttgagtcgctttctctcctcgatagctctcttttcagactctagggcttccatctgttcttcctttgaaaatgggtgatatgtgacctgaaaagcaaaatgtcagaaccatcatgcacaaccacaaatattattttcctaaactagcaaacataccaaatgcaccattttttttacgaaatgcacatagcatataaaagtacatagatgtaaaacatatcagactatgtgcagctacagaaaaattgcgcataatagtaaaaatgaacaccctacaaaagagataaatatgtacagcgtgtgtgcaatcataaatttataactgtgcacagctttgtgcgagtatgtgtattcaggctttcaacgttttgtgatcttaattaagataatttttcaatattgtatagtctacattcttttacatgttcgcatcatttagtccatgagactcatgttttcaaccaatcatgacatgggaaactttttttcaaattaatctaggtgttctttcattgttttctatttttcaaccttggcttttaaaacaatgagtagaaatctaaaagtcctgccctaaaatcatttttggttgcttcgtttattttttgttcggcttataagccgtagctcaaccaatgacgaaaaataaattatggaatcccctttcatggcatcaagacaagtggcatgaataaccaacattatggaaaatgaattatgaattcagataaaaaagattatctgacatccacgcggggtgcagataaaaatcagaatggcatgttcttgaacttatgaaacatcctagctacaaaaagcagactgcgcataaaaaccagaatagcatgtcctcgaacttatgaaacatcctagctacaaaaagaagagtgtagccatcatttgtgctaagttgatgtaaatggagatttcagcagatgtggattcctgtttggtaatggaaatgtccttggttcctcaaccaaaatgtcaatattatgtgcatgctattacagaaggaaaagctactatgatatcttgacggcaatatgctatgcaataaacttgagagataaaacgccaagggcaaccatagtttaagcagttcagggggtaaagtgagccaacaaaaatgtttggagggtttagtgctctatcaaaatctatatctatatctatactacttaaaatgttagtagtggtggtgtccgttctgccacaccacccctaccactggcacttgggccccacaatccatactattacaccaacaccacccttcaacaagtccttccccgttccactgttggctctcaccaaatttcaaaatcacctacttgttcaataagaaaaataataaaagtactactcaatctgtttcccattgcgacgcacgggctcttggctagtctatactcctttaaaaaggagtagtggtgggggtgag

SEQ ID NO: 32248 - DNA, 38148 bp, Oryza sativa
  unsure (1)..(38148): unsure at all n locations
caccaccaactccctactttttttaaggaaaaaaaatagagtaccaagtctaaagggcccacttttcagctcaaaagatatgcaggcataagaggtgtgcagaaagtacggcaaaaacgggttgagatttttctttaaaactcacattgcaaggtacgtgcaatatactagtagtagagaaataaagtaaatgttttccatgtattaatagtttagattagagtggagttacgtgttgaatgcacgtcacatgtagaaactgacaaaacaaaagtctcatgctaacctgaagatgtaatgttcctctatccttggtgtccttaattttaagagaatctagtgattgctgaagtttcaaagtgatttcactggtagcctcaggttgaagactgttcactgctagtttagctacaccaagctttttgtcttgctgaagtctgtcttcatcatatacctgcaaaaaattcacaagcatgttatctggtactacattgagtagattgacacatagaagcataatattaagaacacataaaatcaatcaagatagaaacaacttatgggaattcaagttgaaccgaaatttctaccaatgatgcatcaggtccttccaagcactttcaatgaaactagatcactgccaggtatgaaacattctcaaagcacatctgattttttttctagtccaagtctccaagacgcaccaaggaagtatcatcatctcttggtttgattaggcaaattatttagtccaaaagaaatcagaaatttctgtcatctgacattcgtatgttaaaaacaattacatgtattgtcccatgactgtttggacatgaaaatagcaatgcagattagactaagatagtgacattgtgtaatcccttctagccacccaatatgtagcataatctgactaaaaactgcctagggggatgggacaagctcatgaaattaaggagaaaaaactaaattacattgtctgtgtatatattaggtccattttagggtaaccaaatttgaaatggctctattgaccaaaaaaaagggaatccaaaccagggctgagcagtgatagaaaacagtatgttaacaatattattgatccagctactatctactccctccatccaaaaatatagattatatagcattcgaaatttgtcccaaaatataaggccttctagactactacttccccaacccaaccactcatcgtttaattatattcaatcttatatgcaaagatatgcagctctgctgcgtattcgagaacaaaaaaaatccagtcttaccctcaaccacccctcatttaatgaagcattacaatcctttcccttcatccttaatccctccaaaagaagccctagaagtccttatattttgggatggagggaatacgttgcagttaataatatattgttgtggtacttaccatatgtatacaataattgccacctaaaaacaaagaggcatggaaaattaacaaaagggaaaagaaagatgacaaaatggaaaagaactgagtggatttcatgagcagggatatggtccatgctcactcttcatgcacgatcagtaccagactaccagtgcaatgttgttggctgtcccaagttggttgatttgtttatcttcagcgataagctgctaaatataaggatttgacgggagaggatttttgacagtttttgagttagagataataagttaaaaaaaaggatttatcccttcttaattcttttggtagagatcacgtgttagggctaaacctcaataaaaaaaaggagccatagcaccaccatacagaaaactaaacaatagaagttggcatgggactaccatgtacagtaccagacacatgcatcatagtctgaaacttctgtacacgtgtaatgtatggcaagcattgataacatggcatttccatccactgaaaaattctgaattatgggcatgattctacagtaagccttgaatggaaccaaaagacacattgagtgaaagactgaaacaccaagacataacttgactcatgactaatgtctcaaagagcattcatcatacatgtgtaccatgaaaaatagtacacacacatgagcatgccactagtccatagaaatttattgatatcccatcaaagcacaaatagattcttcacctttcctcaataactcaatcttttagattaactaatcaggccataaaactcaacatggtatcagagctagaagttctaagtttttctaagtttgtgatgtagcacaatcttggagaaacacaatgtcggcaaaatacatggtatcagcttatcatggtctccaccatcgtcaggctatcatgatgtcaactttaggacttccagctctgataccatgttgaggttcataatctaaccagccaatccaagagcttaaattattggagaaaaggtgggcaatctactcatacctcgacagctatactgattagcataatttatccctctgctttccatttatggaacaaaatattcttctatgcatactaaggaaaagtgagctccatatcgagttcatcagtatctgggctacaagcccacatgtcaccttgtttggtacaaacctgaacattataactaaggcttgtcttaattcatatctggactagcgaaccaggctttctagcttctatgagcatttttctgacatgtttacctaactgcatgagatcaataaactatttatacatatgagcaaagaatgcaattgctttaacagaagattttacaaccaacacacgtccatatatatctgactacaatatatcttgagtagggggtagatacagaccataccatcaaccccaactcccttttttaaatgagtaaagaattaaagaataactggaccatttgccagcatgatctggaatccagccattaatcagccttacaatccaatgcagattgtttatagaaagcaagcatataaatctttcttgataaaattgtctattcccttcatatgaatactagcaaaaaaacccatgcattcaaatggatctcataagagaaaaacttaaattatatatatttctcagggaaaacatatataatttgcaaacaaacatcaatacacaaatagcaaatgcacatacacaaaaatatcaatttatccaccgttagaagaacccaccaactctagaggtgtggtaggatggcagactcacaacactgtggtcttctatatactagagatatttgtgcatattttattgtttaattgacaccattttggtcatagttgcatgtgagaaagaacatgcaggaaacaatgaagaattacctcaaaaatgacagactgggtttctttgtcttcaacaatcagagggaatgtttcattccattcaggatttaggttatcatctatgacttttgttttgaccttgaacattggacgcacatatagtatcacatatggatctgatttaccaatcaactccttattcttcaatgaagttgcttttactacagtaacagtaagtcttccctgaggtttaagctccagctcactgcagatgaagtagagcaggacaaataaaatttttgaaattacatgccaatgggatgcaattcattataaagatacttttcagaacaaataaacaaaaatattagtgattttcagaccttaaaagctagcgtgaggcatcaaattaacatattatgcttgtgtatatctcatgcctaccaaaaaaatatggccaccaccaaatatactccttccgccgcaaaatatagctacctttagcattaaaaatttgtcccaaagtaaagctagctttccacctctcaaccaatcacaaccattttaatttctccacttacttcctcatctcaaccaatcacaaccatccatcattgtatttcacttttctcatcaatacccgtgcccaactctaaaagctcttatattttgggacggagggagtataatggaaagattggcaacccacataactcacctagatggaaatgcagtattcaatatcacataaggactttagattgggatgtgaatcctggatgaaatgatactccagaaatatattctgaagaactccagaacaaagctaccctatcaactttttcagatgggaggatactaaatctggatgtgtgatgcagactaggtcactcaagtgacacgatgacccagctaattttgtttaagttgcacaaaacaacagtgcaatgtttaaactattaacaccacctaatcggcacaacattgtaaaacacgccaggtttttgtcatttagaggaatcagccagatattgaacagcacactctgtacataatttgaaatgaaactatcaatatattccaatttcatcatctctttttccccaaccctttttcccgatcaagtcttaccaatttttcactaagttatcaaaacattctgttttgtgcaaaaaagatgctaatttagctcgagcaatatgaaatttactttaaattctaagtattgaggtattgtctggtccaatcgtgtaatcattaatgcagtcaacatctcttgttaagcattaatgttcatgtatcgagaacatcttgcagttggatgattcaaaggaatgaagaattattatgattaaaaaacaagttcctttcaagaaaaatgaatacatgatactatgtgaacaataaatataacacagaaaagcagctcattgtcaacatttattgcatatgattggagagctaacagttagcaggattgattataactggtgacaacattcaagagaagtcaccttgtatcaacattgacaccaagtggaacaacaagcctgtgtggccacttgagcatgtcagaaacaattgaattgacagtgtcctaattaaaggagaggaatcatggtcaggattttataatctgttagaagaaattaaatgttcaaaatactttcatctcacatcaatcatgtcggagagtcctggaacagcggtcagacttcctccaatagccttcaaagtgtattgtattttcggctctggctgaagcacaaagaaccgccattgaagaaataccacaggaaatgctcataccaattagcaaaagactccaaacctcaaatgtagtcaacagattatctccagagacattcaacaataatggcaaatttgcagtatggaacatgtattaagttcaaaaaataataatgatataggccaaagtaatgaaacatttccttgaattggccttaaatgttatttgattggccaatttctaatcaattaacattaaaactggaccaggtggagttggcttttcttttctcattaggaccctttcacataatctcctaccttggcagtccactttcaagctatacttggaacagtgttatgtgtaatttaatcaataatttcaaggaaacagattaataaggttataaacaatctcaaggaaatttcactttgtgtcatcctaatgataggggcacccggtgttactaaaatagctgccatcgaacaactgtgcttaggatgtccaccttgttaattcaagactcgtctctgcttagacatgcagatctcctgtattgtcttagaaaaaaaatctcctttgaaatagaaagataaatcattttttgtagatgtatacctctgcaagaagagcaacaacaacagcagagatgcaagggatctcctctgatagttgaaatacaacacggacaatggtgtagacttgaagatctttgagctgtgagatggttggcaaagatgatatcatgactagttcaagagagatttacttctgtaagaattaatcactgaaaagaacaaagaaatagtaaaacctgaataggaagtgatgcaacaacagcatcaacagcaaggattatgcttggatcaccaccccaacgaagatctatatccattatgatttggcctggctgaatattttgaatgcgaatacctttacacaacatgacaaaacgtgatgtctcagttatttagtattgcattaacatgatcaagatgctaaacaaaacatagcttagtggggcatccctaagaaagaactcatgcataatatacataaaggtaacatcaggtaattagcatttatttaatgagcattgtttggagaatgtacataagaccgtcccctggaggcctgaagcaattgaaatgacaatcgcatggatgcaactataccacaagggcaggggggaaactatagagactagagacttgtttattcttgcttgatgccaatacttgcaagaaacctcttatatagcggactcacctacctcttatatagaggactcccgctcccctagcaattatagatatgatcaatttaaataataacttgcctaactactggaaagataccaaacaacctaagagctagattatcaagtaacaaacccatgcctaatcataagacgatgtacttttcatatgagcagtaactacacactgcactacacatccagggcccatgccaacattggcagttggcacatgagtacatgacaatagtaaagaagaaattaccagcaaacacataaaactgcgaagatgatggccaaaacataattggtatttagtaattagtaggcaaagtaaccttgcttgttagctggctatcagttaggaagggtaaaatggcatattttgtgttttttaacctacaccaatctgcattgttttgtgccaaaattttctttccatatcacatctatttgacgagtttgtctctctcgacaaatcctatctgaagctttttcacatcaagttatcaggggtactcatgccattttgaaaattttccctccataaatacgtaaagaaatggactcaattaatcaattattgactgacagtttgcatcgaccgatgttaacataaagtgtcaacttggtaatgttggtcaatctacatagaaaatagtcactcagaggtcgcaaagagtgtatcgtcagattcacaaatcacaaaacaaaaggatgaacttgtatttagtagtcacgatggtcagttcctgcaattaaaaccatctaatgaaatactcctaaggcatgtcaccagtcactattaccactgggtgcagttcttggtttacatacatcagatgcaaagattgttattctcactgtaggaattctctaattcagaacccagacaggaggcatacaacagagtaaaaatcagataaatagtgcagaacgtggagattataataggaaaaccttctatctttggtgaaacagttccaagagagaatttgctgaacttcagagattttattcctggaggtcgataatcatctagcagtggctcaacagattccttgactactgcagtggcagcctgaaatggaactaaaagtttagtagcccccagaagaactaaaatctaccaaaacatagtacatacttttaagaaaaaaaataacttggagaatgagattggggcagaataaaacaaagaaataagtcctatctttattaacacaattgtacatatttaccacaattaaaaggattaggacattgtgcatactagtggaaaatgttaagataacttgatagaggtatgctttcaacgctatactgatgaagcgtatcttgatatatcttcaaaaaccaagcacaatttgtataaatagaaaatggcatatcactttgaatgaaagtgacaggatgattgagatgatcaatatttaagttaaaatgtttaacctttagaacctgcagttaggagtagcattacaatacacaaaaagatcaacatgaattatacccccccccccgcgcgtgcgcgcggaaatgccggtgtttttgtttagataatggaatataaattccggcctttacttcaaagaagctacagccacttattacacaaaactctcaaagagagccaatagtcaggcaacaatatgaactaaaactctcaaagaaatgccagtgttaaagacaaagaaagctattaacaaataacaattaggaagtttgctggaatagcatacacataggaatgaattttttttgtaatcaaaggaacgaataaaaatttctacaagaaaataccatagttgtcagcaaacgggggctgtaggactgccaaactaacagcatactttacattattatcagttggctagagcctagagatttaacaaacatttgtcttacttgatcaacgaaaggccagagtttgctgagatgcttgttcagccatttcacctgtagaaatcaaaattgtgggtaaaatagtcattgtccatagtacaatggataaggataactcaataagcatcaagaagtgtccctttatgatgggtatttggattacaatacgaatattgccagcacattaatctggacagacggtttttccagcttcgttgtactaggatgtgtctgtccagattcatgtactaggatatgtcaaatcaaccaaaatcccttatattatgggacggagggagtaataaattgcaagaaaactaaacaaatgaaacatcctgtcaatgtaatgatgttcatgttcaccacagttaactttttcacaagcttacaaattacaataagtatagccagctaaaggtcttttatgaagataaaggtctatttcatttggttaggtttgtattaggtgtagtttataccaccttgattcactagtgttcagttggtagtacagccatatgatggatatgagaatttcggctagtgtttactcgaaatttcaccattgggttgattaagctgtcacctcttttggggtaaatacaaagtagcaatgctaactaaattgcgaagattgaagcctgtcaatctcaatccatcatgcaagcatactatgatgtgaatcaccaatcctcaacattgccaatagtttctgaactcaaaatgaatgcatctattttggtcaaactaagccaaatcccttacaacctactgtcctactctagcagctgcctccgcatgttgctgaccaccaaagggctacagcacttaccaatcctcccaagggcagccttagttgctgagatgggctgttaaggcgatgtaaggcgacccaacccaaccttagcggtaaggcgtaaggcgatgcgaaaagaagaagaatgcgagaacagatatgggccagaagtacatccagccagccaccacactatagtattctgcagttaaccccagcccaacagcccgtttaaagccaaccaggtccctttcctctcttgccccagcatgccaagtccacaaacattctatatatctatgtacccatcttgaccctctatagcactactttgtttttgagatctctgcttcttaaaaagaattgcaccagacgtccaaacctacctttggctttgatcttgtagtttcaaaactagcacagaaacaagtcatcatgcaaactactacaattttccacttgtgaatgaaggggttaaaaggttagattataaattgtgttccattcattatttttctttacttgactttcaagacatggactcagcatatatgatctttttttttctctaatgacatattcatgaaaattatttaaagagcaactgcatgaaagtatttttatggcaaatctattaatgtcatttctacaaatcaaatcttaataattttgcatatgttaacaagttgaggtttcaagatctgacagcacggtgcatgcattctcaaggaaaatttggttccatgaaactgaatccatgagttatgtaaccatcgaaagctcacttcaatatcaccaaaaaatttgcaaagctcctttttataccatttccatccaactgcgctaactatgacccagaaaatcatctagcaagaacacagacccagtactaccatgcttatgctgtattaaatttttggtgaagaacagaaacggcgcaaactttcggtgtcacaaactcaatatcagttcttcccattctaaaacgtcatcatttgaggacatcgggtagtagtttacactttacacagacaagaacaaaaataagactaggaacatttcggaggaatcaccacaaacctgctcatactgcgggaaggatatccactcggggaaattgtcgccgcacagcttcttgagatcgtccctaccgagagacccaaggaccttgatatccgcagcctgtagaaaaagtttcggaaaaactaaacaaaaatcaaaacctcgaccacgaaaattaaacgaccatcaccctagccttatacgcagaaacaaggagcaatccaggcgaagcatcaccaccacgcgcacccgaaacacgaaccttagcgatgcgcttcctgctgcgccgctgcatcacacggctccacccggccataagcgcgacgccgaccaccatccccatcaccatccccgagatcagccccatcctggcgcacccgcgaccgacagcccgccctccgccggccagccaacctcgcttctcgcgccggcaccccccttacctcatcaatcgaatggcagctcgagatctgcggcttcgcagcggaggagacgagggggagggttacgcctctctggcttgcgttggcggtttgcaattgtggcttgggagtggggaatgcggaggattgcgacggattggggcttgggagaggggattaattacggggattagtgcgcagttaatgccccaagggaagcatcaacgaatcgatgtactgctcgcttgctggaacagtgacgaggaagtcaactcgaggagatctggagaggaaacggagttgatttttaggacaaacggcaagtcggccgcgagcgagggggcttttaactatttgccactcttacggatgttgcttaatgatttgccactaagctcacatgtcatagacacatgagggcccacatgtcattgacagggtgtggcaaatcgttaattgtcatgtcacaagagtggcaaataacgtggaccttccaacacccccacccgcgagcgaggggcaggggctgtctgcggggggaaatttaacctccacgtgagcctggctagtagcttcgctttttgttttacccaaacaaagcagatgggagaccgattttacaaatccaccccaagtttgacaaaactatcgtaaaaaactaaaaacgtctcttttgagtaccttcccatgcaacacgtagcactgcaaaacacgtacctgcaaaacgaattgcctgtatttgtatggatgtaagtaacagttgcatataaacatatagcaattcatatttgactatttgtggatgcagcttgaagctgcaaacatacggagtaaatttagagttgacatattagtctaccctttgtatataataacatcctccagtaattacaggcctgtttggcagagttctaactcttaaatttagctagttgggtctggagtggagtcgtggagctgcctaaacccaactccacttctctagttcattttgtgagagagctctacctagctctgctcctattttagatagagttgagactgtttggctaagctccaccttcaggagagctggagctggagctgtgccaaacaggcccacagtgagaaccacaccgattttcttatttttttgcagaaaaaattgcttcttttgaaaaatttgacatgtggtgggctagtttgaaaaaagatcattgtctacgtacaaaatatcaaacaaacctcccggcgcacttgacacctagttgtgttttttcggaacaactcttgtcttttcgtgatatacaatgtgaagaagagaaaattttgttgctatggataacactttacatatggaaactaaaggggtattttcataaaatctcctttactcacctcaacctctccaccccatcaaaaacccatccttctccccaatccgcgctcctgttgcacgagtgctgcacatccgtgcctcacgccgactccaacgctgccatcttcccttccttccacacctgtcgcatagccatcgtcgttcttcctccacccacaacctctcttcctgagcaagcacattgtcggctgcttcaaaaatccctatcttctcgaaccctaggccaggcgacaagagcagcaagcgtcggtgtcagggattgttggttcttctctttaatctagggatagttcccttcccttcctctctctcactctccccatatataagcccttaattagattagaaaatatataactgagatctagtgcttcaaatggaagaaagaaaaccaagcaagattgaattgccacccatttaataaatttgcatctacctacagctgacgttgcacggaaattatatggaacaaatgaacaatcaacttccaagcgagaccagcatggaaggatgcgcggtgcaatacaattatgatgaatggatgattttttttttcaaataagaattgataaaaatcgtaaaattcaaaattgcctctaatcattgtgccgacgggggatacccgtagaccgaatatagagggtattagggtatgctggtacgaggatctacgtagtacgacatcaaggaaacaaaaaacatgaattatactggttcaggcctcttgataggtaatagccctaatccagttgatatgggattatatagtggaaaccacagattacaaagggaatagtagaattcgatgataccgacgagaccgtagtcgagttggttcaactagatcacccgacaacttggctcctgtaggctccgacttcgtaggctgtggcggttgtattggcaatgagatttgatgcctttgatcctccccgggggtcccttttataccgcaggtcagtcggtttccaagtaggactcggagacatcggaccctacacgatacagtgacgacccagttctatccgagtaggaatctttccatctgtggactccatgatggatttccttgcgtgtacgaagaacgtccgtatacgcgcagatataccatatcgacgcatagcgtatatccaagggtagagggtataccttatccgtaaccctgacacattgagtttgtaaagtactaatacgcccttatgaaccgagagttcagatcgattctactagtagtatcataatatcagtaatactaccagtagataacaccattgtgggactctattgactaaaccaatagagtgattaaaattttttcttgttttttgtagcattttcctgttgccttgcatatatgatggatttggatgttatttatgatccttgttaacggtccttaaatcataatatttgaccgtcaatacctgcatataatgaaataaaacatggtatccaacttagtggtagggattattactaatcatttccaccagtgttggtgaaatatgtgtatgcatgtaatttgaggagaaaacacatccgtcatgcgacaaaatgcacctcagtgcattcaggacacgtttacacggattggaggcctaataagtcagtgaaaaccatttagaattgggccaaaacatagcataggttgttggggggccattaagcaacctcccggccgaaggagaggccgggaggagtgtttttgggttcagccgaacccatcctggcgctttccgccatctgttttcatgtggacggcttggatttctcccctatggcgtttacagggtggtttggtcatttcccatgcccctaaccgtcatttagagcttatataaggaggtctccatctcacttcaagcacacacaactttgagctgaattacaagaggctttattgtatcttttgtacattagaattaggtatagagtgaggggaagctctggaggagtgctcggaagtttggcgctcatccgacttctacctcgacgagaatagcttcctagaaggaattcgggaggagtacctgagctgtcggtacactctgctctgggttcagaaaaacttcttcaataaagtaagcattcgtgttcttttcttatgttatttaattactttgtctaagtaagatagattttcatctttgcgggttcattggttagtattcatactaagtgctctagtactaggactctggataatgaatgaagttcctgcacaaatattagagtagtaattaataacttagacgtagtgtttaggttagagattacctttgtttgttgtgtatcccacggatttgtcagaggtaggcgacaggtggtgatagccctaaatcccgtcctagtaatcctccacattcggatacatcatagaactatagccggaaccaggctggcagaccagcaggggtcggtgcccgaagcaacagataggaaattacctttgcttagcttagataattaaaacacatagaaagtcctctctagcctagccagcctacctatagttgttgtccttggatagtcttagccttaagtagattacacacgttcgctgagttcgatatccttttggggtcaccgaagatgaagtgctataattgtattctgtgcgcttgcggatttatctgtggtcataagaaatgccaacaatcctcataattaccaaatggattttacttggtggattttattttgcagtagtttctttgaaatcccttgtttctatatggtttcaaatttgttcaccatatgccttttgtgttagtgtattggttttgcctaacatttcatttgtttgtcttatctaagatagtgttgcattatagcttttggaatgtattccatcacagttagtggactaaaattatgtgcaaaatctgttatattaaaggaaatggaggaaagtgcacgggtggtccctaaacctatcatgttgtgtcatacaggtctgcaaaactctcaaaatacattttcaggtccctaaacttgtcccaggcacaaattggctccaacccattctggacactgacatggcataccatggtggtacctatatgtcattaggactcacatgtgatacacattaaaatataaataaaacattctcattatgttactttttttccctttcttcttctctccccttctctttctttactgtcgaggtagttgttcactctctctctctctccccttttcccagcgagcccctctttggagcggcggtggtgagggccaaggctacgccggtgagatcctgcttactcaaaatctcaaatgcgaggccttccctgatgtcatcatcacctatggtaatgtgcactggtccgcacaggttcctctcgttctcatatgccctagtctatagtgacaaaattaagatgtgcactgctcagttgtgaattgtgataaacctttcaagcaatcatgatgattaaaatccaactcatgaagcgtacgtagccatggacgtggccggcgaagcctcatagagaatgtgctccatgcatggcctttctcatggcctcgccctccacctcgtgtcccgcgttcatgttgtaccggaggcatttagcggcacaacgcgtcgtgccacggtggatggtggcaaggttgcgcgccagccacctacacggtagtactgcgccgagctcggagtctaactggtcattgagccactctcctcgtacgacatggcaagtccggcagccccatccactactaagaaaaagtatttttcatgacatcaaacttttttttactagcgggtttaataaacacacgcttgtaaacatatatttgagggtttctaatcacaaaccaccagagaaaatcgattttatgttagctgtcacttacgaggtccacctgaaaaaacaaatcgttataataaattgcagtgccatatgcgctaagtattaaataatcgctatcctctcaatttctccccagctgccttctcaattcctcttctccctagccttctcgattccttctcgacttctcctctcgactgctcctcctctccctccaggccccctccgtggtggctccctccagcgataggggctccccccagccgatgctctcggcaacaacagcaacggcgacaggaggtggatccggttgcgggatgggaggaggccgatggcgggcggcaacactcttgccctcccctctctctcctagatttggccggaggggaggagaccgctggtggcgacagcattagcaggggagcatcggtggtagccctccaatccccatccctcccagttctagtaggaggggcagcagcagaagcaggaggctggtgatggcagaattagtagagggggcagctgcgatggctcccccagacccctccctaccctgcctcttttagatccataggaggctgccggcggtgacagcagtagaggggacagtggtggcggcttccccactcctctcccctccctctcctagatctggccggaggggagacggccgatagcagcagagagggtggcttcggcgacgtcttgtccatggtggcttcagcagcctcaaggtagcagagagggtgacttcggcgacgtcttgtccatggtggcttcagcggcctcaaggtcaccagcgagctcatccatggcaactagggttcttgtgaattagcgaggatatgcttgggagcaagggttgcactggtgaatttttccgtgtttgttcttcccttttggcttttgcagatccatttaatgcagtggtgattagtatttcatagggatgatgtttgtttatctgtagttgatttgatttgatttgtggaaatgggtagctacatgcatgtggtatttttgaaaaaaaaaattggccacaatgcatctattctagcggtcattgtaatttgaccgcaaaaatcggactttcacagatggtcgcactactataaaacatcaaataggtgtcgccattataggtgccggaacaactaaaatcggcacctataatgcatttctcacccaaaaagcgcatccacgggacaccattggctagaatcggcacctttgtaaagagataggtgtcggttctaaataaaaaccgacacattttagattagtatcggtttttctgaaagaaccgacacccatatatttatattataggtgttagttttatgaaaaaaccgacacctattcggagccgactgacacctatttagagcactcagccttatcctcagcctctcttcccttagagcaagtataatagaaggctgtaagccgactaaatgctgaggtggaggagagaagagaggagagagaggagaagcgggctgtaaacttacagccggcttggacacaagaaccaagtaactctgtgagagaggcaagtgggctatgtattaattgtaaagagctaactattatataggtaggctgagaggaggctgcaaagaaccttacaaccaacaagtcggttgtattcttagccttgctctgatcctctcagcccctcttctctgtctcctcccctctctcagctctctctctctctccaccacacagtggcggcccgacggcggaaggggatgcagcggcggcagcggcctggcggcggctcagcggctcgggaagtggcggcggctccctcccctccgctagatttggcgggagaggggaggtggcggaacgggatgtggcggcgatggctcggcggcggaaggggatgctacagtggtgggaggggaggcggcggtggtggtcccacggcccgtaagatgttttgacttgtgattatttgttgacgtggtgatttaatgatgtaatgatttgtgatttgtgggatcggcttgacggctcgatgcatcgaggcgatttttttttggctcgtgtgtacttcaaaggtgccggttttgaaaccggcacctttaatcttctgtaatctgtgccacctctagagtgctggttgggaaaaccggtacctgagggggtttcccaaccggcaccgaattgagattctctagtagtgtcggcttaacctagttgcttgcgaaaaccattttcgctggcggttgggctaggtcacccgccagagaaaatgatttcttgttccgacagtcgccgtagaaaatacaaactggccatcaagaaaaatccattttgtactagtgattgccgcctccacctcatggttcccctcgttgaccatccatgctgctcgccggctggcataatctgcatgaaccgaccaccgatgttgtggtgatgctcgtagcgctgatgtccagtggcgactgtgacgacctcacaaacagcatcattgcgttgttggcaaggcttgccaagcagcccgtcggtgcggcagccatcctgtccagctgcttggcactctcatgtggctcgttgatttcctcagcgtgtcggtgttacggttggctaagaagcacgacactacgctgttggctcgctatgctgccacgcgcggcgacgcggtggtggcactgctatggcagcacattgccagcctgcacgataggggatgatagaaatgagcttttttttatgcgactgacttatgaaccccacgaaaaagtccaccggagattcatcgtggtccacatcagcgagtggagcgggttgcatccaatttggattagttgttatacccatgacgagtttagagatctgaaagtgcattttaagattatggggacctagatgacaaacatgataagtttagggactatccgttcactttacttaaaaaaaagttgggtgtccgacctcatttctatatgatatgcaatttatttatctagatgtctttttgcatctattgtgtttaaaaaagtgcagatctttattatgcaaactaaactgtatcattacttcttcatttttttaatttttttaaataaataaaatgttgactggattaccatgcgtacgccacgtaggataaaatcactctgtattgggtcgagggggtaatttgttcagtattgaaagttgagggtgaacgatgtctagttttcgggtttaggggggtaattcggtcgaccgtgataattggaggaggggggtaattggtacctttttccctttttttttcctcgtgtgagtgagcagcccttcccggtctcatctatctcattccttttttgaactagcaagaagtgatttttgtcgtggtctacgggcctgatgctagcacttaacagaatgggccaaatgatagcccacaacaaaacgagcaaaatggtagcccataaaacaaaaggagtaaagtccatcaccggtccctaaacttgtaccgctgtgtcatcccggtccctaaacttgcagatcactcgtttaggtcctccaacttattcagatgtgtcaccccggtccctaaacaggatggtctaaaaactttatatcaaaaaataattcataactttttcatgtgaactctaatgaagacaaactttatatcaaaattgtagccttcgacgcgacttacaactttgtatttgaaaagtttttgaattaaaactgtttaggtcccaaaatattgttgcatgtttatatattttgaaattttaattttaaaattacattttgggacaaaaaaatgacttaaaataaaaaaaattcaactacaaagttgtagatcgcgttgagggctacaagtttgatataaagtttattttcattagagttcacatgaaaaagttatgaattatttttaaatataaagtctttagactgtcttatttgacccagatgatattcaaatccaagtttagggaccggggtgacacaattgaacaagttgtaggacctaaacgagtgatctgcaagtttagggaccgggatgacacagtcgaacaagtttgaggaactgaacgatcgatttgcgagtttagggaccgggatgacacaacggtacaagtttagggaccggtgatggactttactctaataacgagtttgggaggttgggagcagatccgatccagttggcatccgagtgtggaatggggatcccgagtgcgggtgcgctcgctttgcttgggatgatttcatcggatgtgaaaaagggtgtcgaaactaagggtgtgtttggttgggcttttcaacctgcttttgcttttgcaaaagccaaaagccaaccaaaaggctcaaaagccataagggcttttgctccaaagctgcttttagtgtagtacaaatccaaaagcagcccctacccctgctttcactggcttttgagggaaaaaattacccacctatgccattatgaaaaaaaaacgattcgctctttctttctttctttcccgttccccttctcgcgagatcgagcgcctggccattcacggttcgatgcggcgctagggtttgcgccgccgcccgtgctcccgccgtcgcgcgccgcatcacccggtgccgccctgctcctgcgtccgtctccccgtcgcccgcccccacgccacccgacgccgccccaggccgcccggcggccgtctccccatcgcccaccccacgccggccgatgttgccccacgccgcgccgaagccgcccctgctcaacgccgcccgatgctgctccgacgccttcgctaccgctcagccgacttgaaaggtgaggccgaatcgcccctgcccctgtgctcttgtgttgatgcatgtgctgtccctagaatgttacagcaaattgatttttggcctgcaaattgattgaacaacaaattatttggttcaagaataggtgacatggcagattggggtgattgttttgtaaagcatttgtttgatgtttgcaaagaagagatagaggctgggaatagacccatgggaattttcaccactaccggttggaaaaatgttgtttccaagtttgcggaaaaatcgggtgacaagcgaaccaaaaaacaattgaagaggaggatagttattttgagatatggcatcattgtatgaaccatttatcttttgttctgtttatgtggaccatatcactttgatggatgaaaaaactaatatatttcgatgaaaaacttatacattttttaaaaaaattggccttttaaatacaaaatattgaacaggttaggtttgtacaagtaatttgcatataaacagtcctacatgccattaggggcattacaggtatttcttctacaacctacagtttcacagctgctctaaccaaacgggcttctgcttttcccacagctgcttttccacagcctacagctcacagcagcttttccaaaagccacagctcaaccaaacacacccttggcgatactagaaggggtagcgaacaagctatgaaagtgaatgggttatgagaaaagatttatacatgttcgggccttctcaatgagaagtaatactctactcctgtctcgggaaatattccgccgattgtgctattgatctaacgatctaatagcatctccaacagcctctccaaatctgactctccaaatactcatttagctagcctaccaactaaatagagtcaattttgctttcactccaacaacctctctatttacactgtccaatctaataattggtcccacatgtcacatgtcagtgtcagtatagttcttttacctccctccaatcttctctccacgagtagcacatcgccgttctctccttgtccccgcctcctctgcacaagccgtcggcaccgccgcccaagtcaccatcaccgccgcagcaaactgtcacgccgctgcccacctcgccaccatcgctgcagccgtctgtaccactgccgcgcaagtcgccaccgctgcatcagctgccaaagtcgccacctaatgtgaccatggctactacggatacaaccattgctcacatcatggatgaacaaggagatatcaagatcaagtcctccaagtgctggaatctgattcggccacctactacactgctgacttcaaatggccaccgaatctgcatacgacctctgttttcggcccgtaagtacttgatggaaagctcttggagccctctttccaacggatccagcctcatcgccaatttccatgtcgtttggccgcaatcacataaacaaggtgctatgtcacctgtcttgggcctataggcttgtaactttgtttgggaccccgacccaagtggggcccatgtggggtgcgccccaaccaggtggagaatgaccattggcaccccttggtcttcctcccacccctataaataggtaagcaccacttcagggttactcgggttttgtttagatgaaagtttagccattgctacttcctcgcagcgcgcgtgtcggctagaccgtctgtctgcttgtattcgaaaccccaacttatcgtgtgtactcaattcctatttgcaatatcagattgcttttatcttgttcttgcttgtttcttcgatttacttgcaggaataaggttgatctgcaccggcaagatcaacaacccacggagaggtgtatcgatcgctaaggtgcaacacaacgtctcgtacggttgtagtcggatagtcaacgtttctcccaaatcgtagttatctgaactcaccgaaagatcggggcaacaacaaccttgagtttcgagtggaactcagggtttatcaggtggtattagagctttcgttgctcggtgagtttttatctacccataaccagaaaataaccacaaaaaaatttgtatcatttacctagccatatttgtgcctttgcattgttcttttcagtttttgctttgttgagttttctgttgcatcgtcaagtcgtgttgctggtcgtagcgtcaagtgcgtttagggttttgagttctggtcacgcttagtaccactatcaccgtgtgctctgttgtcgtcgggacctacgaaaacggaatcggctcgttgccacggttctatttttgtagttttcagaagtttctatcggttagtttttgagttcttgagttgcatctaagggcttctgttcggtggttgtgccgtgcatgtgtgtgcgaggaagaagataacagatcagtagaaaagaggataaagatcggttttcagaggaagttttgcatattagatcaagtcggttgggttgtttccatgtaaggccaaacttcccactttggccgattctatttcctcccccacgcgtgaaggccggcgtccatctccttctgtcgcccactttagctgaatccgactccctccctctcacgttggttcctcctgttccgagttgtgtcaaacaccttggtgaatttttgcttggtttcggtttcgagatctgtttggaaaaacggaaccggcataaattcaacattccatttttgtataattttaatttttgagtttgtacttttacagctgagtccctgtaatttccatatttgcatttgagccccagtgatcatacattgaggtccttgagtcagtctttgtaaaaaaaaataaaagaaaaaaaaggcagaaaggtgcataaaaaagaaaaagaaaagaaaagccacaccaaagaaaaagagagaaaaaaaaagaagaagaaagaaagaaagaaaaagaaagaaggaaaaaaaatcacttgttatcttttggatcgcttggatatatcagagtatgcttgagttgtttctagtactattttgtggtgccgtttgtgtctaggctcgcgtctctagtacgttctagcctaggaccagcacagtactgactttgaacgattattcaattttgcattatctgatttgagcatttgctattcctttgctacatatttaagcctacccagagctccacagatttgattgcagccgtacagcaagtgtttgccaagtcatcgatacatccaaactccattggggtgtttggttgagtcggtgtggacaccatattctagtttgcattggtaaaaacttgtaagagctcgatataaagcttgagtgtgtgtgatttgtgagcttccactacctcctagttgataggaacgtatatattcttgtatatgtttcttgtttgctactaactatggcagggttacacaaagagtttggagctgttcgtgctcaatgtggacattttcaccttcgacaacacatggcaagtgaccaacatgacgcaaataaggtacatgatcataatcttgcaagagtagagtctgttttgctatcttttgatggaaagtatgattccgctgcatacgttaattgggagctagccgtagaaaaacaatttgatgagtatgatttttctaatgctcaaaagattaaggctgctagtaataagtgtaccggttctacatctttttggtggcatactgtgagaaataagcttgaaacttgggatgaatgcaaaatactgatgagaaaaagatttgtgttttcatagtatagacgtgctctccttgagaaatttgaacatctaaaacaaagtgacaaaactgttagggagtactttcatgattttaaaatttgtatcacttatagtggtttacaagaatctaatgagaacacaatgactagattttttagagggcttaattccaatattcaggctgggcttgttaatgtgacatataatcaaataggccaattgttcatgcttgcttgcaatgttgagcgcaaaattttggagaacccaacggagcaacaagctatgcttgtgcctcctatcactgatattttgcaggaagttcagaacagtcctcaaaatgagaagaacgatatgtttgagatgtcacttccatcactcgcgaatgaggagaaggctgatgcacctacattatctgaagagggcataaaaggtaaattaaatggtgtagaaattactcaaggtgagtgtgcttctgatgaattacatttttccacttttcatgccagagaagagcaaccattagtgaaaccaattgctgagatgcctttgtcacaagttgatttacttgctgttccttgtgataaagaagagttgtgtgataatgcttcacttatatccatgccacaactggtgaatggacatgctatttctagtatttctttgtgtgctgattttaagcatgttgttcacattgctaatgaagtagaggaacgtgaattgctatcttctttaaatactttgggctatgttcagcttgatgatttttgtgagcttgataatttggaggagaaattatttgctaagtctgatttgccatgtccaactaatgctatttttcatatatttggcgaatatgatgatagaggaatacgtttggtgcatagagtttatatatgttcggatttagaacctcctgtacatgtggataaaacttgcaagctagagaggcatgtaatttttaatcatattacttccagtttatcttgttttgattggatgaaacaggttgttttaaatcgaccacacgatgagcaccatatggaaaaccgaggacggtttttcgtgaagaaggggaggatgatgtgactatggctactacggatacaaccattgctcacattatggatgaacaaggagatatcaagatcaagtcctccaagtgctggaatccgattcggcctcctactgcactactgacttcaaacggccgccgaatctgcatacgacctccattttcggcccttgagtacttgatggaaagctctcggagccctctttccaacggatccatcctcatcgccaatttccatatcatttggccgcaatcatataaacaaggtgctacatcacctgtcttgggcctatgggcttgtaactttgtttgggaccccggcccaagtggggcccttgtgggttgcgccccaaccaggtggagaacgaccattggcacccctttggttgtcctcccacccctataaataggtaggtaccccttcagggttactcgggttttgtttagatgaaagtttagccattgctacttcctcgcagcgcgcgtgtcgactagaccgtccgtctgcttgtattcgaaaccccaacttatcatgtgtactcaattcctatttgcaataaggttgatctgcaccggtaagatcaacaacccacggagaggtatatcgatcgctaaggcgcaacacaacgccttgtacggttgtagtcggatcatcaacatttctccaaaatcgtagttatctgaactcaccgaaagatcggggcaacaacagccttgagtttcgagtggaactcagggttcatcaccaccgcagccgactgtaacgccgctgcccaagtcgccaccgccgccgcagccgaccgtaggatggcgagaagcaaggcgagatgggggggagcaggatgacggggaggaaggggtggggcgatggtggcatggggcggagatgttgacgacagcggggccgacggggccgggcggtgatcgtgctgctgcgctggataaggaggtggcggcggcgacagctcgaggtaaggggatttgcgtcggcgttgctactcgccgcgggtgggaggaggctccggcttgccgtcctcccgtctcgttgtcctacctttgggtcggcgatcaaggtgacgatggggtcatcttcctcgagccgggaaagactgtggcagcgacgaggggagaggcggatgggaggagatggtggcgagctagctgctcggggggcgtcgttgctagccctgctcggtttggggcagtgatgctcgctagtcctaccgccgccaacaggtggttccttctccgacctgctcgccttcctcttcctcttgccttgcctgcagcgcacgctcctcggcgccgtcaacctcgtctatgtcatcgcgtccctcgtcgtcctcgtccgtccccgcggcggcggtggcgacactggggatggtcccaaatgggaggcgctgctgccaaagccttggtcgtcgggaaggcctttcctggtcgtggtcacgctcggggcatcgggatgtttgtgtttggccaaccaaacaggccgactacatttggccagtgagatggcttagccattcaaatagagagtctgttggacctcattttcttgttaagtttgctactccctctgtcccataatataagggattttgaggttttgcttgcaacgtttgaccactcgtcttattcaaaattttttgaaattattatttattttatttgtgacttactttattatccacaatactttaagcacaacttttcattttttatatttgcaaaaaaaatgaataaaacgagtagtcaaacgttgcatgcaaaaactcaaaatcccttatattgtgggacggagggagtattttttaacttggagagtgtgatggccaatctgttggagatgctctaaagtatgattatgtccctaaggagccctcgacccttccttatatagaggaaggagtcgggattataagataaataccttatcctttacggtccaagttctataaatattttataattgtaaccgattaagactacatgatactttcttgatatacaagttaacataatacacgagtttctgttactatgagttaccctgataaccagtcgagtaatgcagccacgtgggtaatctccacaaagggctagtgtgtttataattttttttactagggtgatacatagacagtcccaatataaatatatcggagcacgcatctaaacgagtgaatgaatacaaaacttggcatgaaaatatggaacgcacctttatcataatcctctctctcccaacacgataggagaccaatcaataaggcatcgaataaaggagcggcgtcgcttcgcaccgcaccacccccaaagcagaggcgcggacggcggagcccacctactccttccgccgaatataagcaacagcccagtgaatttttttgagaattaatattatttttatggaaaatcgcaaaagtagtagtcaaccggggaaaatcgcgaaagtaggtccctgtcgaacgggtgcagttcgatagggcgcctatcgaacggccagagcgtgactggcgaggagatcagaaggctgccgttcgacaggacctgtcgaacagcccccgttcgacaggcagggctgtcgaactgcccctgttcgacaggatatccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtgctaagttaatcgtaaagtgtttctcaaatagtacggacagaacagaaatgactaaaagtttaatacaaatagataagtcaaggacgatcagtgcccttcgcacgcttgctaggtcttcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggataagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttttcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggatgctcgccacgtcgtcaggcctgacgactggaggtctcgcgctctagtctttgcagcagggtgtcggactccatgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgaactaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcatccagagttgcatatctcgcgtgcaaagatccgcgagaccgtgcggtgcatgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaatgaatttaacaaaaaatacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcaccgcaagtaccgccgacccccaactgtactgtggaatctccgcgataggtaactttgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgaggtggaaagtgtgggtctcaggcctccatctatccacaagagcactcagaagcgccgcgtcaatgtggattcgttcggatcttgcacgtgaaggctcgaccaaccgtgcaaacgtcaacaacccagctgctctcagcctacaacatgacagagcgcaagttattaatacatgaaaatataaacaccttgtattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcatattgatcagccatacctgcagatcgaaaaccacattagtacaatgcacgtacggtaacagtacagtaaatgtatgcaacataattcaagtaacaaatttgcatgccatttcaatttaaaattacagtaccagcacacatagatacagataagaatagttcagtacatttcaatttaaaattacaagcccaggacacatatattatgatattacaagtgcagtgcagttcgaaatttaaattacaattccaatacaaatacatgacgatattaaaagtgcagtgcagttcaaaatgaaaattacaaggccgttacaaatagattcgggtaataaaagtgcaagaaagttcaaattaaaattacagacgcactaaacataaattgaacgataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatcctgcgcgactggcgacgacccttagtatcaactaataaatttgagtcaggaacccaattggcttgccctggaggaggacgagtgaaatcgcacacggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaaggcttgttgcaattgcatttgcaagtgtgatactctggccacaacgtgcattccaatgtgatgttagtagtcccaatgccgacaccactcttgtcacgaagtcgtatctcaaataacaactctctgttcccagcatgccacactctgtggattcctcccttcttacttttctcatccatgtactgtgtaatagcggggctatacttaacactgggtttgctgaggttcagactatccatggaataccttttacagagatacttctgtgtacccctcgtgatgccctccaggatagcaacaagtggtagaggttgtgtattcttcataacccagttatacacttcagcaagatttgttgtcatcacaccatacctcgatccgtctgtatcgtacaacaacgaccatttctcccttggctcaaattctacccactccgtgaagcacttcatggcccttccacgcttcctgcgccgagtaatacttggtgcttcattaggaatgggttcaagtccctcggctcctcctgtctggcaactatatgttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatctgctatgtaaatctggctatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccatcaaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatttgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcaacttgtccaccttccaacggagtttcttccaccacggcatgacttgactcccccgatcgatcaacacatgttgtcttctgcaccacgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcattcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactatattaccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctctcctcgctccctccggcgctcacggcgacgatgtggcgactctcggcggcggctggcgatgtggtcctcaaaacaaatcgaactcgcggcctaggtggacggggctttaaaccggcctgtcgaacgcccattgttcgacagggtcggtggagggccctgtcgaacgcccccggttcgacaggcctcgcggcgccgggtggtgggccctgtcgaactccctccgttcgataggtgagcgtgtcgaacgccagccgttcgacagggctttgtcgactgcccgtcgttcgataggtgccctatcgaattgcacccgttcgacagggacctactttcgtgattttccccggttggccactacttttgcgattttccataaaaataatattaattctcaaaaaaattccagcccagtcgccagcgcgcagatagagccaaacgccctccacccatagcctgacaagtgggacccacgccaaaatgtccccacatgtcatggacgcctcttgcctggctaccaagtgttcccctgcttgggaatatgtcgctcggccgacctctcgtattattgatgcgacttgcagcccaaaacccccaaaaagccacagaagagagacaggggagaaaaccctaatctcaaggccgcggctgtgagcgctcctcccgtctctcccccaacccgccgccagccaccgagctcgccaccgtctccgttgcctcgccgtgctctaggtctggatgcctgctccccttcatccctcctcttctccgtctaaagccgtcgtgtttagcctccaggggcggctcgccgcggcatcttttttttttctttaaggtggtagtgcttacatggcgatgctctatgtgcctcttgtgcgtggataggttctcggatggaggccgaggcggcggcgaagagggcgcgggagagcggtgacgcggcggcggccggtgccggcgagcaggcgggtatctctgccgtcatccctggatggttctccgagattagccccatgtggcctggttcgttccgctctcttaccctctgtagccctgttttgccattacaatgccacaccctcttgctttgtaaattcgctcgacatggactacaggttcgcttttaatttatataaaaaaggtttatatagtttataaaggagtatattgtttctttccagaattaatgtgtccagttgaatctccgattgggcttcttgtatcatgggacggagcacatcgttagggaactgataaaattctttgccattttttttaaaatttttagcttggttgggtataggggtgggcattcggttttcccggttggtacagttcggtttgttcagctttcagaaagattggtttttaataatcgcaagccaaagtgtctgtgagaaaaaaaataaaccgcgccgaatagactgatctaccttggttttcttgttcggttttcccgaataaaccgagaaattggctactcatggtacggaggtgccgcaggccttgtgcgcgcactgcacggcgacgtttaggctggctgccgtgggaattagcgcatgatctagtggcctctaggggctggtatgatgctatcaatgggcttttgcatggatcgatggaccgtggacgttccacctttcatagacatgcatagatcaatttcctggtttcttcgatttttggagataaaagaccaagcaaattaccgaaggcctaacaagggaaaaaataaaccgaagaggaatccgatgaccgaaaaaaccggctcttcggtttggattggccttcggtttccggtgattttatgcccacccctagttgggtattgctttatgctgttcaaggcttcaagcaaccgtgcagagaaacagatttaccaccctaaaaattctaaatatattaattatgcaacttgcgaataagattttttttctggccacaacacgtgattttttgcgctctagtaatttttgaaataatgtttttgagcccatggcaggtgaggcacactcattgaaggtcgaaaaggtactattccaaggaaagtcggactaccaaaatgtgatggtgtttcaggtaaagatcttttattgcaccaatgctgctttttcttcgtcttcactcaaactggagtatgaacctgtgctgttattttgctttctagtcctccacgtacggcaaggtgcttgtgctggatggagtgattcaggtcactgagagggatgagtgtgcttaccaagagatgattacccacctccccctttgctctatcaaagatcccaagaaggtaatgcatctaatttgcagattgtatgttgtataagttgtaatcctgctggtgtataacgagatgaactcttataattatttgtggttaggacatgcatgtgtgaaatatattagacataatattattagaccttgtcgagaaaagtttgctcgtattcttttgttcatatcaaccatgcacttccaagtactgatgatgataatattttttactgcaacaaacaccaacttaatgacaaggaacttgacaacatgattttggactaattcagagccaaacactggcaacatgtttgctaccctattttaacatcaagttttgagtgaaaagttccatggaaacacaagcaccatgtgaattctagggattcctaggattttcctgcacaaacgttgtcatgacccgaggtcatgacgggataaacaccgccgggaagatagccgggcggcgtcggctcctggagaagggatgtagattcaggctagggagaagaacattattgggagggagagattagactaattgatattcattgcttaacttgagatgaatacaatccatcccttatatagagatgatatgacttgacccataagaaactaactcaaactaactctatctaatcctatcctatctcctaaccgactgctacagtactcgtggtactgtttatccgctaggacttggcctcgtgggcctcggcctctctgcccaacgcctatgacaaacgtgaatgcatttttacattaacagaatcttgtattgttcttagttttgctacttgtcagcattcctattaagttaattcttctggccagaacataataaagtaccatttagttcctttttcttgcatcttttttaaatcgacgtggccaaacagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32249 - DNA, 676 bp, Oryza sativa
caaagcttacaaaagagaagagaaaagctactagagccatacctgaactcttctgaagacttccggactcctgatttctactctattcctattccaccagctagatactactaaactaaacttgagaaaaatgagagagctcttgcttgaggtgtatgagtgaagtaagaaggtgaggggtttatatagcctcccaatgacggttgtgacggttggaatggtcggaaataccctccaaccgtcattgggagctaatccacaccgtccagaagaaaccctgcatccagcgacgatgagggaggttcggccgaacctggggccaacccaactagcccatggtttggctggtggcctcctctgttgtttttctccgcagacttgtgaattttggcccagtttgtcgtgttaattctgagttcttggcccattcatacataagtctggttctcgacatcgtccgattgattatcgtctgagttgatgtcgattcttctctactttattgtcattctctgcaaaaggttagtagacctaatactagtggaatattattattctaacatatatatgcatagcaagcatcactaattctcctctattttgataatattgacagttgaaactgatcgataacgaccttcaacaacctccttggacgactagaacccaaaagatg

SEQ ID NO: 32250 - DNA, 392 bp, Oryza sativa
aaggcatcacttacccacaatttacattttagtttttcagacaatatatcccaagtaatttgttggtaactgattccttctcttctgattaagagatgcttgacacgagtcacagattatgatatatgttcgtagtaaaatctcttggcaagaacgttcattttcagttaagttcaatgttgtttgtgttcacagtcctctcagatcatttttatatgtgataagcaccttttaaatttgcagcgagatgggatgaccattcatgctgaacggctcaactttcatcgttatatttcgcatttccggtctgtgcataggggttctagtttgctaaaatgcgtacgacatctgtgaggaagttgcttccagagtatgttaaactaccttaccaa

SEQ ID NO: 32251 - DNA, 4682 bp, Oryza sativa
ctaaccaactatcattagctacactttttggttgttagaagttgctctatttctgttgaatatgtacctgcccaataacatgttgacaaccttaggagcaaatggtttgtgccatgtaaagataatttgtggttctgttgtatcaagtgttttaattggtactattttcatttattggtggcagatgtatgtcatcctgctcttggcaggtttgctaattttgtgccttttgaaattgtcccaaaatcaatgaaattgtctgtttctaagtacttaattatgtgacaacatatcatgcagaaatgattgcattgaaaatccttttttataaccagtcaggtggctcatataaatattttttcagacccctcagacaccaattgtccggacagctacatatagcaagtattgcatggatgagttcccatccggaacaaatgctattgttgcggtgctatcatacacagggtgagcatttcattatgttgtgtaatgatcatttgtttgaactttaacatgataaaatcatagaactggtattgcaatctaggtatgatatggaggatgccatgattttgaataaatccgctgttgatcgtgggatgttccgtgggcatattttccaggtaagtaaatgttttttccccttttttggtgactcttgaagatatctcattaacactaataagaatttaatgtcaaaatgtgtatcgaatggcatacgcacatctttaatgtactctccatcccaaattttgatgggatgcctttttctgggcatctgaatcattacccattgatctattttgagatttgtggctttaacctgggtatcttttacacaaatatatgcgacatttcagttctgcaaaatattgaatccatatttgatttatttttgtgaaactgcagttgcattaatttgaaagtagttcaataagttttctttcttcaaaagttgctattgattgtaaagatgtatcagacagttcttgacgtggatgttggtgcctaggcatccaaatatcaaaattagtttacctatctatattttatatttgaataatcctgagcattagatttggattcttcaattcggaatgccatctcagtatgcacgtttagtatccaccaacagagagtacctttggaaaaatcttgattggatgatctaacttggtatagattgaaccttaagtttgacaaaacctaaaattagtttcttttatcctttgtactctttctgcagactgagtgcattgatttatcagcaaaaagtagagataatgttacggagttcttttgcaagagtaatctttcgagggacactaccgctgcaatcgaatcagatggccttcctcggattggagaggtagttatgtgctcgtactaagttaattttttaccatgtggagaagtggtagcagtgtaatttcttcttgacgatattccccgtactcaaatgtatgtgtatgaaacagaacatatttccaaatgagcagtactacagcgtctgtaacaatctcactggtacagtaaggcctatcaaactgaagggctcagaacctgcagctattgattatgttgctgtcaatgggacaaattttaaggatcgtctacaaaaggtgaggccatggccacctccagtatcctgtgctggatgaaatttatcttcggcaataatgtgtggatatccctattcaccttgttaaaaaagggcagactaagtgcctgtgtttgtttaaatgcaagaaaaaagtgaaataccttcagtttctttaaactacaaaaaaacccagcctcttttggaaccaatgaactttagtatgttacacaatgcatttcttgaatgttagtaggattattgtttgtgaaagtgtgttctaatttgttttttgtcatcttggcatgcttttcactactgcatgtttttgtcaggctaatattcgtctgcgtcgcgtgagaaatcctataattggtgacaagttcagcagcagacatggtcaaaagggagtttgttcgcagttgtggcctgatattgatatgccattctctgctaatactgggatgaggccagatctcatcattaatccccatgcatttccttcacgaatgactatagcaatgctcttagagtcgatagcagcaaaggtacaaacttctttcataggttgagagaagcttgcatttttttcttcattttgaaagaaatatcatgattgttgcgagagagagacagagattccttgtttccaattcttctcatttaagtatgatagcgtcttggtactttctttactcactgaagtcttgtcttcacaggccggaagtctgaaagggaagttcattgatgcaacgccttttgcaagctcagttaaagagagatcaaattccattgtggatgaactgggacccatgcttgcttcttatggatttaattaccatggaacagaaattctatatagtggagtttttggcactgagatgaaatgtgagattttccttggacctgtatactatcaacgccttcgtcatatggtctcagacaaatttcaggtgggcaatcattatttgtgtaccatcttattatgtatagttaaagtcgttatctggcttatttttcctccttttctattcgatatcggattgaagatctctacaatgctatgcatcaaaagtattcattgctctatttatctagtcaccaatgtttccacactattgcttgtagattctcatggatgtgttgggtttcgcaggttcctaccacagggcgaatagatcagatcacaagacagccaataggaggaaggaaatacggtggagggattcggttcggtgagatggagcgagacgcgcttctcgctcatggtgcctcttacctcctacatgacaggctccattcctgctccgactaccatatcgcggacgtgtgctccatctgcgggagcttgctgacggcgacggtgatcaaatccgaaagccagaagaaagccaagcgcgacatgctcgggctccccaccgtaaaacctcccaagaactttgcctgccaggcctgcaaaacaagcaaagggatggagaccgtcgccatgccttacgtcttcagatacctggcctccgagttggcggccatgaacataaagttggagcttcggctcagcaatagaacagagcatcctactactaccagcgaagaatcctgaatgatttgtcttggtagatctactctgaagatattataatcactggttcatctggagctggcagggcacaagtgtgcagtcatgccatccgcggcagtgtcctgggggatactgagaagttttgcttagaggatgtctccagttttgttgtgtgtcactgctgttttgtttcatgaaaaggcagagtctgttgtatcaaaacatcaatgattataccaattttataacattagacgtaactgaacttgtgtgcattgcaatgacacatctgaaatagtgaaatacgaagctttattcgagagatttggcaacaccggttccctcttctgaagtgatatatgtgttgtgaaaaaaagattactccctcggacctaaaaaaaaatcaacttaggaggggataaccatatatctagacatatgactgtctagatatatttgttctaggaggagtcacatcctctcctagattgattattttttgaatggagggagtaatatttggtctctgaaaatgacgatcgtaaatttataatgaaaaatactttcgtataaagtaatgatcgatacgtgatgcccaaaacctaattttgaaaaagaaacgtagaacacagtagacggagggagtatatcggaatgacccctcgagattaaactgggcccactcatgagtgggcttaggcccacagttcttgctgtatcagtataatgggccgggcttaaaactccccttcctcctccacccgccatctctcttcagttccccaacccgccgccgccgcctccactagggcacgccgccgccgccgccgcctccactagggcacgccgccgccgccgccgccgccgccgtcagccatgtcggactccgacgagtacggtgcgttccccgccgcttcttctcctcgtcctctcctctatgcactgtttgtgttagttttgacaacgtttggctttgctgggtttagtcgacttgcccgtgtcggatgaggaggagtgggaggatggggagtcggaggaggacgaggagaaggtgggctctcgtaagaaggccaaggttcacgcgaagcagctcaagaggctccaggagaaggttcgtctccgtcctcgccgtctcctacgattcgcgcacccttctcccaagcttatattgcttactattattacttgttactagtaagcatcaaaagtagcatctgaattgctcggctccattccatatgtaatgcctatgttgatttagctttgggctgtttatactaggattggggattctggtatgtgttttttattctggtatgtgttattctggtatgtgttttttattcttatatttatactaggactgagcacgcaaggcagtgaatgttagaaggtatattgcatgcttaataggtggatattggctcgctctcgtatgcatttggtaaacttgtctggttggcccttgttgattgattttattgattttggaaatggact

SEQ ID NO: 32252 - DNA, 15929 bp, Oryza sativa
  unsure (1)..(15929): unsure at all n locations
ctgatcattttgaagaaggtgatggtaaactaaatctcaagttctgattgtgcatttggtaatcagggcaagtactataagcccctatttattgcccataaatttgccacataggattagatgatgagttggaggagagaagttaggagagagagaatgagccatccctcatgcaaggggcaacctccacacaatctccaagaaaaatgtaagatgacgtgagagtaaactaatattggggtttgtgtactagatgtgacatgttgtatttgttacctcttaagtaatgagaagatgacatggtttaaattagatgtggcactcacctccactataaaacttgccctcaggaagctagttgtaatgtcatagggattgctggtatgtaaagagtacttttgatatctagaattacgtagctcagtactgttatgatttttttctgcttacgttggatttatagctgtttatacataaaggtagttctacagttctacttgcacttttagtgtggaataacctatggctctggtttagcggccctggcattgcaattgggacagatgaaactgaagaaatcatatgtgttaagcacatccagattccagtttaagtactttcagattagttgcttgcactttgaactagccctcttttttggaataaagaacatgttattgactcgacttttggacagtcttattctaaaaataattgatactttttgtttcctggtagtgaccattagacggctttttacaaatttagatgataattatcattgttcaatttattgctgaaattcttatctgtatgcatcattgttaacactgcaacaaccaggaagtttttcttgagctaatcatttcttccatccctagttcttgtcatatctgtgctgctgtattctgtcagctgcttacgatggctgcaaaactcttatttgtaggatcctgagttctacaagtatttggaagagtgtgataaagagcttctggaattcgacgatgatgactttgatgtaacacaaaactatttattcatttattttgcatttttttttcttcttgcttgagagaactatatacattgtatgtttgctgcatattttgtttaggataatgaaggaagtgctgagaaacatagttctgttcctaaagaagaaccgaaagaaattgtaaagcctattacaatgcaaatggttgattcctggtgccaaggagcagaagatgggaagataggttctatccggtctattctcgaagcattccggaaagcctgccattatggtgaagaaagtggaaataattctgcaccgaaatttagtgtcatgtctggcagtgtacttgacaaagtcatgcactttgttttgaaaaacatggatagaatccttcgtgaattacttgatgcacctagctttggggggaagaaagagacagttagtgagctgatgattactaagcaatggaagaggcatgggagattaatgaggttataccttgtaaatgcactccacatgataacagagttgactgatgagcaaatggtagcatttactgtacatcgtgtcagagcttctgctgtttttctggcggccttccctgcactcctcaggaagtatgtaaaggtttgtagctttggctcctcatccatctttagtaacctttcgtgtcatctgatgtctctgcagagtttgtaatttcttttattttcacttgactaattcgattacaggctctgctgcatacctggtctagaggacgaggtgctatgcctcttgtttcatttttgttccttcgagatttgtgcattcaactaggttcggagtgccttgatacgtccctcaagggtatctacaaggcttatttggtgaactgtaaattgtccaaatcaatcagtggatcaaaattgcagcacattcaatttcttggtaattgtgtcagagaattgtacaatgtggacccacaaagtgcatatcagcatgcttttgttttcatccgtcaactggcagtcatcctaaggggagctcttactgaaagaggaccaaaggtatgtgtagttgaactctgatgatcatatactgcaatgtaattatttacttggcagctgacaagttttgtggtccctatttcattttgcaagacatcgaaggacaaaaagcagaaagaaagtatcaaaccaacgaagaaacggatggaggtatgtcattattccaatgttgcatatgtactatcgaggaatagagtccactttgggataacactattgctttctttcttatgttagtttagttttactctctattctatattctattactctaactgagcctttcttttctgacttgttatttgctgaccttgttcttgtgtagaaatcctaccaaaaagtttatgattggcaatacatattctgccttgagctttggacaagtgttgtgtgtggatgtagttctgaggaagaccttcgacctttggcttatccactaacccagataatacatggtgtggcatgcctggtaccaagtgcgcgttactttcctgtacgcctgagatgtgtgaagatgcttaatcgcattgctgaagctactggtaccttcattccggtgtcttccctgctgcttgatatgctggaaatgaaagaacttggagggaaaccagatgctgtaggcaaagcagtgaatctgttcagtgttaaacaggtatattttctcgtaatacaacacttcctttgggaggactactttgaaaaaacttttaataggtacttttgtctggcaggtagataagaaaacagtgaagacacgtgcctttcaggaagcatgcatcttttccgcggttgatgagttggctaagcatttggcccaatggagctactccattgccttctttgagatgtcctttttaacacttgtccggcttcaaaacttttgcaaaaccgttaaggctgacagattccggagagagatcaaagatcttatccatcaggtttgtgaagcatgtaagagagaattgtacctaactgaatgcatgtatgctgatgtttgtatcctttgtgattccagataaaggctagtgctgagtttgtaagctcaaagcgtgcaggaattggattctctcctaatgatccagccgtggattcatttctacaggtatggttggtcctgttggatgtgcactgtatatttgttatactcatttagtgtcattttgtgagatatataatgttcatttcaggttgagaaggaagcaaagtcaagtcctctatcaaaatatgttgctactctacatcagagaagtcaggacaggatggactctctggacgacacaaggttggttacttggtttcattgatgttcatctaaatttaggagtcagccagttgagtcgtagcacttataaacagaaatgcaccaatttttttttacctcgtcgtcttatcatgcaacattttctagtagtctttacatgtgagtggagctatgcttgatgctccatattgcgagtacatataattaataaaattactgatcattcttttccctatcagcgttattgtgggggcagagtcctcaaccttttcacggaggttgtcagaagcacagaagcgacaggatgaacaagatgatggcgaagacaccattgcattcagtaagaacttgttgactgaaaagaagaaaaccaagtacgctatcaccttcctctttgcctctttttgtttcttttattggaatggtagacgttatatgtttcctttcgggggtttgcagaactccaaaggagaagagcaagaagcgagcccataatcacgacgatgtcgctacggaggaggatattgttgaggatttgatcttgagttcagacgaggaagacgaagatgaggacaagaatatggaatcagatgaggatgatggctctatgcctgttgaagatgacagcgatgacgatttcgtcgacccagacagccagtggaagaaacagaagaaagagaaatcaaagaaacggaacaagcggcaaccctcaaagaagggttcgtcaacaacaaaaagaaaagagaaaatcccacatcccaagaagaaggcgaagcattagccagagataatgaaaacgatgatgatgtgttttcaattttgaaagaaacagacgcatcatgaaaattttgttttaattgagaaagacctctgccatttcgttgcgttccttcaccgttattatttatttatgtatgcttaatcgttcagcttggctgatgttgttgattttgctccatacatttttctttctggcagattgtgtgctgagttaaacaagtgataatttccttggggaaaaaaaagagaacgcgaaaatagtattgaacaggctacaacctttgtaagacatgaaatcagtcttaactagtgcgaatcatggggatattccactactttgcacggcttaaattattgtccatgaatcggtggacctgtgattttcagttctgattgtaaactggtactagcatatgaagctacatttgaccaagccatgagaaaaattaggactaattcctttttctaaaacaaaatctccacgactttagatcactgataattcagtaggggagaacaacgagcctcattatttcaatttgctccgttgccaaagttattcacaccattatatatcaacgctaacttaattaagagctcccttgtcttaacactagcccttgacatttgtcttaacactagcccttggcatttgcaaagctctgtacaattaacctaaaccataaaaatattttcaaaccatataatattttcaactaaacaatactgctacctccttttcatattattagttgttttgactttcttctagtcaaactttaggttcaatcaagtttgtagaaaaatttaacatctacagcaccaaattagtttcattaaatacaacattaaatatattatgataatatgtctgttttgtgttgaaaatattgctaagtttttttataaatttaattaaacttaaaattaaaacgacttatatataatactaagtatcatgtaaaaaaatattgaactaaaccgattataagcagcgtgatggaaattccagccgttgacaatgtccaaccacggccgtgtgggccccactccacacgcttcccttcttcccgcccccgccacgatacgaagtttacaaacagaacagcagcctcgcttaatccttctccgtcacgtacttaattaccaccttttttacttaacttaatccaactcctaatcatcccattgcaatatgtctgttttattactacgtttcgtcgcgttcagctctcgatcgattacgagagccatgaagtcgccgttccgacgcgcggcgagcgcgccggcgccggcgccggcgccgatgccgatgctgtcgttcgcgggcaagaggccgaagcacttcacgcttcaggacagctcggcggcggagagggacgccgacctggaggcgttcatgcgcgcgcgccgcctcgtcgtggtgtcgtcgtcggagagggtcgccggcgacctccgcgcgtacctgcggagatcgaggcggtcgccggcccgcggttcgacgcggcggtgagcagggcggtgccgccgtcgtcgtcgcagctcgggattgcctggcaggacgacgcggcggcggcggcggcggggggatggcacaggtggagtacggcgggcgcggcggcgtgccagtggcacacgtcgctggtgaccgagcgggaggtggcgatgttcgcgctcgcggcggagtcggcgcgggcggcggcggcggaggacaggcgcggtgcggacgggatccggcgggcgtgcgccgcgctctgcgatgcggccggcgcgctgagggaggcggcgggcggagccgacgctggcgccgcgacgggcatgtcgcccgcgcgcgtcgcggcgctggagggcctgatgctggcgtaggcgctggagtgctacttcgagctcgccgtcgccggagggaggccgccggcgctgtgctcgatggtggcgaggcaggtgagcctggactacggcgacgtgcgcgccgcgctggaggcccccgagctgcggcggcagcacgccgaccaccggcagtgggcggcgcacgcggaggcgaaggcggcctacttcgccgccgaggcgtgcctccgggcggcgcgcgagcggcgtgccgagggagacgtcggcgtggcgatagcgcggctgaggcaggcggcggcgacgctcaagggatcgaagcctctcaagaaggcggcgcgccggtgcacgccgccgccaagtggctgaagcgggaggtggaggccgagctcgccggcgccgagcacgacaacggcatgatctactacatggcggttccggccaacggagagctcgccgagctgcccgggctgcagcagaggctcgtccagcccaccccattggagaacatcctgcagcaaggaacgcacggcgacggcggagctccggcggccggcggctagccgccgtcgcgcgcgtagctgaagtaatggacattgctgttcatagtgtatttgttacattgaatcgagagtttcgagacgttggcacgttgcatttcatggaggcctgtctcaaaaggtggatttgtttttttttaaaaaaagaaattgctaccggacactcaaaaatcatgtaattgactgaaagacacaacaaaaatgtgaaactgtcgatgaaaactacaaaagttgtgtaattagttgtaggacacccggaggcattattttataatttccgggctgaaagagaggagataaatttcgtaatgacgggaataccccccactactccttcctttcttctcgatgcagcggacatgtaggcccgcgcacagtgttgtccttcctcctcttgccagcgctccactccaaatcctctatcatccatggcccaaccgactgctaccttcacatcttcaccctcaccgcccctgtcctttgccttctcatctcgctccggcctcagtggtgacgctagcggtcgccttcgtcgtcgtatcctatgccgccctccttctgctgttcgcatgcctctgcgtctacgagcggcgccggcgagggcgtggctcacgtgtgcggtatgggcagcctccatgctactcaccaccatgttcgtatggaaggtcgcggcgctcatgctgtggcccgtggttgccgtggtgtgggggctctccatagtcaccgtgctcgacatggtttaccacagaactttactcaaatccgagcgattttgatcgagatttcaaaatggaatcttgagggcaatcgaagagtaaagtgagagcatcaaatcccctcagcctattctggaaaaatgcgagggaatcgattggattttagaagggatgcaacggcgttggtcggcgttggacgatggcgagaagaggacgacgatactgtacgcgggcccacatatcagctgcatccagaagatagaaaaaagtagagggggcattcccgtcatttcgaaatttctctccccataattcctcccctatcgttttttccttctttttttccaggtagagcagagggaacagaggagcggggcactggtgctccggtggctgggaggtggcgacgtcggcggccgaatgtgttcccgagcgccgcgctggagagccccgagctgcgacggcatcacgccgactaccggccgtgggcggcgcacatggaggcaaagccggtctacttcgcgtcgaggcgtgcctccgggcggcccgagctgcagcagcagctcgtccggcccaccccaatctgggccgattgggccgatctcagcctcccggagcggagaccgatctgggccgtccatccgcgccgcccagccaatcggacggtgggtgtattactgtactgccaggtcggtgaccgtacaagccggaatattcagtagcgtcgttcgctccctggcttctccatttcttcagctccgccgccggcggcggcggcggcggcggcaggcatggcgcgccgtgtcaccacccttacccgcgcccgcacccgcgcccgcggcggcggcgtccccagcgcgcagggtggtacgacccaagacctagggcgcgcggggggcagtggcaccgagggcgcacgccacgtgctcgacgaattgccgctacggggctggggcgcctcgatctacagcttcaaccgcaccctcaccgacgtcgcgcgtgacagcccagccgcagcagtttcgctcttcaaccgcatggcccgagccggcgccgacgaggtaactcccgacttgtgcacctacagcattctcatcggttgctgctgccgcgcgggccgcttggacctcggtttcgcggccttgggcaatgtcattaagaagggatttagagtggaagccatcaccttcgctcctctgctcaagggcctctgtgccgacaagaggacgagcgacgcaatggacatagtgctccgcagaatgaccgagctcagctgcatgccagatgttttctcctgcaccattcttctcaagggtctgtgtgatgagaacagaagccaagaagctctcgagctgctgcacatgatggctgatgatcgaggaggaggtagcccacctgatgtggtgtcgtataccactgtcatcaatggcttcttcaaagagggggattcagacaaagcttacagtacataccatgaaatgcttgatcggaggatttcaccaaatgttgtgacctacagctctattattgctgcgttatgcaaggctcaagctatggacaaagccatggaggtacttaacaccatggttaagaatggtgtcatgcctgattgcatgacatataatagtattctgcatggatattgctcttcagggcagccaaaagaggctattggaacactcaaaaagatgcgcagtgatggcgtcgaaccaaatgttgttacttatagatcactgatgaattatctttgcaagaatggaagatgcaccgaagctagaaagattttcgattctatgaccaagaggggcctagagcctgatattgctacctatcgtaccctgcttcaggggtatgctaccaaaggagcccttgttgagatgcatgctctcttggatttgatggtacgaaatggtatccaaccggatcatcatgtattcaacattctaatatgtgcatacgctaaacaagagaaagtagatcaggcaatgcttgtattcagcaaaatgaggcagcatggattgaatccgaatgtagtgtgctatggaacagttatagatgtactttgcaagtcaggcagtgtagatgatgctatgctttattttgagcagatgatcgatgaaggactaacccctaacattatactttctgtttcctcagtcttattctaaaaataatttatactttctgtttcctgttagtgatggctataaccattagatggctttttacaaatttagatgataattatcattgttcaatttattgctgaaattcttatctgtatgcatcattgttaacacagcgacaaccaggaaattagttcttcttgagctaatcatttccctccctagttctgtcatacctgtgcggctatattactgtcagctgcttatgatggctgcaaagctatttcttttgtaggatcctgagttctacaagtatttggagaagtgagataaagagctcttgggatttgacgatgatgactttgatgtaacacaaaactatttaattaattatttttcatttttctggtgtcttccctgctgcttgatatgctggaaatggaagaacttggagggaaaccagatgctgtaggcaaagctgtgaatctgttcagtgttaaacaggtatattttctcgtaatacaacacttcctttcggagcactactttgaaaaaccttttaataggtacttttttctggcaggtagataagaaaacagtgaagacgcgtgcctttcaggaagcatgcatcttttccgcggttgatgagttgggctaagcatttggcccaatggagagagatcaaagatcttatccatcaggtttgtgcctgttttttattctcttttccaagaggttttccaccggtttttggtgtaaatgttagcatgtttctaggtgtaaattgattcccatgcattgctatataatcttggccaatggtttttagtgcctgttttcaaatttggttagctgtcagtcaggaggtgcatgctattaaatttacttttgccgatgcaaaactgtccattttcagtttttgaattcataaaactccatactagcttgaagaatattagcaatactagctttcttccaagctaaccattagttgttagagaagaaggcaacgctcaaaatgtcctttttagtttttatgtttgttctgcagacacttgtctgtaaatttgaaattaattaagcaggtttggataagctgcttacttttaatatgtatagacttcaaatatcctttggctgattgcatccaaaattgctacggaaagtctgaaattttgtttagatcatgccaataatgcatgcagaaaagtttattttggttttataggcaggctacaggcatgacattgctgggtcaatggcttgaaagctgaaacagtaacctacaatatggaagtaactaaaacgctgggcattttgctttcaaatttttgaatgccagttatgtttgacagtcctttgcactttgcatttaatcaagatgtccatatctcgggtagataaattgtttatcttttatgatatcaattggatattcgaagtcacatcctactactactaatttgatgatgcattagtttcgatcacaagcatgttttttggcagattgatatcagaaattaatgggaggatggtggtgtgcttgcaaggctggacgtttgctaccagaggagtgtcctgtaatacaaggcatgcagttcagtgtcctgtaataggagtgaatcggtgtaatttctgaagaaattacgcgtttgcttccctctgatttcgcgttggggggcaacatggctttgcgcctgaagattagtagtattagggtaacagattgttgagctaatatttggtgccgcatcggagaaactgaatagtatatgttgttaacagagaggctcatagctgatatgtgctcttgattgtgtgctcagtttaattactgtcaaatttaacgagagtaaattcatcccatcagtgtttgtaatttcagcccaaatgcacctgtgagttaggcccaaagtggtcccaaaatctgcctaaacctggcccaaattcggtcggtagtgtcacacagtttcacttatcgcgcggcggttatcgcacttaccgcgggggtacggtaggagaaaccggtgatatggtttagttgaattttgaccaaatttaaaattccagaaaaaataaaaaaaattgaaaaaaatcatggatgttgttctttaattgtacctgccaatggtgaagaaattttttgaaatagagtaagttaaattcagatttgaggataaaaccaaaaatagtttacaaattggaaaaaggaagacaatattaggccttaagtatcctacatatccttccaattattctcaatttctagttttctacacatatttagccatatttttgtttttttcctatttatttttcatttacatgatttcagctatacagcccgcgataaccgcgaccgtgcgatgtcacggttatcgcggtaaaccatgcggtaaccacggtgaaatcgcgaaaccgccaagttttgaattcgaatttttggatgtgatgtttgtacaattttagatagttatcgcgctactgcggggtggcggtaaccccggtccaaacgataaggtaaaccctggtcgcacaaatttgacctaaaaaccaaccggttatcgtgctaccacggggtgcctcagtaggaccttatgtcatgggttcaactcctcatgggagcgaattttctaggaattagtggcattgtgcttttcaacggtaggcgacgtaccggttgacaacgaggcgcctgtgatgacttcgtcaatttcaaggatgatttgtcggcccaatcttcgaagattataggggtagggtttgcgcacgtgcgttcataagggtgagtgtgcatatgttatgagtgtttgcgttatactgtataattctaaaaaaacaataatcatcccataactttcgacccgaaaacgaacgtcaattcgacccaaaagtgcgtctaaagttatcccctttcacatccatggtaaatttaaagtttatacattaatgtgatttaaaatttaaaattatttgaaatgtgtataaaataaattatctaaatattgtcaaggtagtcatagatatagatcatgaatttatgttgctagaaatatccagcttataaaaaaaatcctagatacatggctgtagcaaaagagatttagattttatctcaatttccgttagcattttttcaattaataatttgttaagtttgtaataatttaaatctaatcaattatgtgctaatgaatttctgttttacgttacatctatttcaaacatcaccttagagcaggtagaatattgaattataagtcagctataaacatatatcgaggagataaaagaagagagagataagtagcgggctacagatttatagccagctgcagcacagacttcacgatgcaatgtgcgtacagtctaacatatacctttacatataactattgtatgaattgagggtgtgttcgcagttgctagttcccaactagggacagtacgcacgtgattaattaagtactactccctccgttttatattataagtttttctagcattgctcacatttatatagatgttaatgaatctatacataatatctatataaatatgggcaatgctagaaagtcttataatataaaacggaggaagtattagctaattttttttttaaaaaatggattaatttgattttttaagtaacttccgtttcgtgtagaaacttttttaaaaacacaccgtttagcagtttgaaaagcgtacgtgtgaaaaacaagaaagagaggttgggaaaaggggcatccgaacacagcccgagtataaatgatttggagctggtaccagtaccggtcacacgcggacgcggtgcgccgaccgtccgacccaaccccagccccagcacgaatctcaacgcgacgccccccccccggcgggggcgcccgccccgacgcggcgaagcaagcaatcctcctcctcctcatcacacaacacaaagacgactgactactcctgtggacggcttccaacttcccccaatttttctctcttttttttttcttcctttccttcgccgcgaagcactccaccgccgccgccgcccccgatctcttcctccggcggccgccatgtcgtcggcggcgaacgtgatgctggcgatccacgagaagaggaccacccccaccgacctctaccgcccgctccgcctctacatcgcctccgcctactcggagcgggaggcggccgcggccgacgacgacctcgccgcggtgcgcgacctgcgcgccgacgtcgagcagccgtcgctcccggacccgtcctccctcgagcgaaggcgggacgcgctcctcgcctacgcgcgcgccctgtccctcgtcgagccccgcttccccatctcctccgaccgcgcccacgtccactccctcgccttcacctggcacgacgccttcaagaccggcaagaaggccagcgtcgcctccatccacctcgagaaggccgccgtgctcttcaacctcgccgccgtctactcccagatcgcgctcgccgcggaccgggccaccgacgtcgggatcaggaccgcgtgcggctcgttccagagcgcggcgggggcgttcgcgtggatgagggagagcggcgtcgccgccaaggccgtcgcggccggggccaccaccgtcgacgtcacccccgagtgcgccgccatgctggagaagctcatgctcgcgcaggcgcaggagtgcttcttcgagaaggtgatagccggtgggaagccgcccgcgctgtgctccaaggttgcccggcaggtgagcctcttcttgctctgcctcctcttgttcaggttatttcgatgatatgagctgataataatgtagtgagggagcttatttcgatttatgtggctagtattttggaatgctttttgtggagtcgtttgatggggatactgtctgtaattaccatccacaggtgacttaacatagcaacttgtagttttgggaatttgtctaaataagtgctcctttagatgctatctttagtgttgataataataattggactttgctatggtgattggtgaaccattgggcatgaagtctgtcttgatagcatgataaacttgagttgtggcatcatcccatggagtgatcatattttaaatgaaactgactggttacaatatgattgatttggtagcattcatgtgtctctcctggtggtaaatagaagctagattaggtcttgcagtttatttgattaaataaagtacaatttgcagggtttactgcttttacaaacattcaagatacaaatatttcttcacctttttgtaatattggtgtcagatgtgctattggattgatttgtggatgtccctttttcaggtgggcatattctatgaagaagcctatgcagctcttagcgcagctcctctcagtcagcactttgataagacatgggtttctcatgtccagctgaaggcagctcagttctatgctgatgcttgctataggtgttctttggatcttcacgagaaagaagaaattgcacaggaaattgcacgtctgaagattggaattagcgctttggcagatgccaagaaggtggccaggggagttgctgccccacttcttgattctgttaataagctggagagtaatatgaagaccaacttggagagggctatgaaagagaatgaccgtgtttatctgatgagggttccggatgctagttctcttggcgcgctccctgcagcatcacttgtaaagcctacatctttggctgaagttctagatgctagcaaagagaggcttttttcatcacttgtgcctgatggaagcatgaaagcactttccaagtacactgagatggtagataacatcatcaggactcaagcggagaaattacagcaagctagtgagatcactagagttaggttgaaggaaatggacttgcccgattccattctttcattagaaggtaatatcaccttacctttagatttgaaggaagacgttgaggctgttcagataagcggaggccctgctggattggaagcggagttgcagcagcttagggatttaagcagagtcaatcaggaattacttgttcagaccgaagagatgctgcagaaggaggcgaatgaagatgctcagtttcggacgcaattcgggagtcgttggactagacctcaatctagcaccctaacaaaaaacattcaagaccgattgaatctgtttgcttctaatcttaagacagctggtgatagtgattctcagattgagcgaggtttgaaggagagctatccattgatatctattcttgacagaagaccggtgagagttaaaaatacattatactagatagtgttcttgttttttttttcttcaacttgtctttcttgatatgcttcattatgaatttcaatgatgttattcaatcctacactcttttttttttcatatttggtctgttacatattgctattatatattgcagatagagtctgcactaccgagtatttctaggcctattatgtccttggatgggaatgaggatgctattgttggagcccttaaacnnnnnnnnnnnnnnnnnnnnnnnnnnnnnnnnnnnnnnnnnnnnnnnnnnnnnnnnnnnnnnnnnnnnnnnnnnn

SEQ ID NO: 32253 - DNA, 715 bp, Oryza sativa
gatttttaaggacaatataattgtttcaccgggactcatgcttgttctgactgtgagcctaatgttacctttacatgcccttacattgtctattttttatcgttttatgagatcttccaaacaacttgatctgtcttaatgtttttttgctagctcctttcttggatatctggtaaatggttaggccgaagtatgaactttgccttattgtttcaaagaaaatgtaacaactcctggaaaagtctaattttggttgccctttattttgctgaccgtattggcacacatctaattctgctgttcctttctggcaggttcttatgaacttagcaaatgacaacccatctggttgtgaattgattgcgtcatgtggtggacttaacaccatggcctccttgatcatgaagcatttcccctcattttgttttgtcgtggacaacaactataacacgagagatgtcaatcttgatcatgagttatcatcttctcaaaacagcaaggcacaccaggtcaaaattaagcaattgcgagatcatgaacttgattttctggttgccatattgggcttgcttgttaaccttgtagagaaggatagccttaataggtaagtccctcacatgcttccttccatttgctcaattcatatcagtgttactgttctggcagttccttggggtcaggactcagaaacatccaattaatgttcatgttctct

SEQ ID NO: 32254 - DNA, 661 bp, Oryza sativa
tgcacagaaaaaatagaacagcaacatcatttcagtggttcctaaaaagaaaatgtgttgaaccaacagtggtaatgacattagaaaatatgtgactaacacacctttgtcttagtcacaagttccatcagatcctccatcttggatgctgctttttcatgggaatactcctgagttatgggaccatactccaatctgcgcagtgacaagaggcacacaaatgaacactcagatagaataaaatatgattgagccatgaattatacaagaacagtaatgtggtggcagctaaaattttacccagagaaatgcccttcaagattgtgccatttgggatccctgcacatgttcccaagcctagcaacagatgccgcaaaatctttgaactgttgtctgcataaaccaagcccaatgaatgtaagaaatcttgaaaaacacatataagtaataatttatataaatagtaaaagcattgaaatttatagaaaaagtcattaattacctaatttcatccccaacaagagcaagcaactggctctgatcatctgagatcagactttggacgccttggttctgaagcacaacacgtttcaggtaccttatgttttcctcggagaagaagttcatcaggggggaacccatggcaattgtgttggctacc

SEQ ID NO: 32255 - DNA, 821 bp, Oryza sativa
ggtagcagcgaagaatcaagagagtgcttaaggtgaaaaaaaaaaggaaaggagaagtgatccgtaccagaaattgatcagttcggagcagttggccttgatgcagcggagtcccctacggacgggaggccttgatcttgccctccactgagtatgccttgtagctcaccacgcgccgtcccctcctctttgggtcactgaagatctgggggatcacatgccaccatcaccgtcaccaaccttggccactactatattctccttcaaagcaacagatcaagtggtcaacaaggtattcactgcagcttcatgaaaattacaagcagagaagcagtagaacctgaattttatctgtggatccttccataccagaacagcaccaaagaagcattctcttcactctcttaaatgctcgcacaacaaaacatggtcaaaggagcttccactagcattcaaacttcatagatacaatcatttaatcagaatatttgcattaacccttctttataagactagcaaaatgcatttgcgttgttacggaattaaaaatcataacagcacaatgcagagaggaaatctattttgaatcctagagcttaattttagaattaatttgagttttttgcttgccaagtttacgctccatttgttattaactcgcaaggatgattatggttgagagctccatggtctgtccgtgatttccactgttctatcatacaattggtttggagaagggattgacagtgatcccacatgtcttggagaagggattgacagtgatcccacatgtcagaattttgagagttggtggtggggtg

SEQ ID NO: 32256 - DNA, 4740 bp, Oryza sativa
taataatcgtgtccaactctaaaacttcttatattctaggatagagggagtatgtggtgttatccatctcactccttgctgcctcacacaggtaaatagaaacatcattccatcagatatttcatgattagtacatgtgcataataatacgttgagataagataatcagatcggaaaccattctatacaatccaatcttgttccataaaaaatatattgtgatgatcagtactgcatttggtaaagaacaaagcttcagacatatcttttgttcagttaaaaaacaagtcaaactattcaacacctaaacagtacacatagatgaaatttaatgaaaccctataaattgttttggatctaatgtcaaaattactgcctagacacattaagtttgaaactccagtcacaaatccctttatgatccgttagtagagataacgacaaacttttatgttttttctggcatcaacagcataacataattgcttgtttacagtctaggaaccacagtaaaaataattcggagaggtggcatacatacctcgctatttacacatacagagaagatccctcctctaataggactgtaggagaaaagaattccaacacagaatttcaaagctgcaaaatgcttcagcagctcaaagattctataaaggacttgtatttttcagggagaaacctataatattcttgatattttcccccagacaaaagatctataaacaaggaagcagtggatgcttcgagggaaaagtgcttctcatcaatcatggaaaggtaagtgccagccctggttatctcacctctctgcaacagttccctaacaatgaaatttagcatgccagagtcaacagtacagccattgtcctccattgaaagaaagagttgatccaattcttctagcaacccctgtcctataatattttcagccatcaacctgtacgtccaataattcggcactaaaccgttagacgagaaagcaacaaacaaatccttggcttcatcatttctgccaactttaagcaatgcatcaatcataatgttgaaagtcctagcctcaagcttcaaatccatcaaacataggttctgaaacatctgaagtgcatcatcagtgagtttgtttttgcaaagtccatgaaggattatgttgtatgtgctaagttcaatctgcgttccactttcggtaatcctgacatagagttcttttgcagcagcagttcttctggtttgaaataaaccttgcagaattatgttatacgtaataatatcaggactaacaccactgctctccatctccttaaaaagaactaacgcgtcttccatcctactaattttgcagtagccattaatcaaagtgctataagtaacagtattaggtttcaacccaactgagaccatgccagaaagtaacttcattgcttcatccatcttacctgccaagcaatatccatcgatgagtgtactgtatgtaatgatatcaggcttcacaccaatacgtaccatcaggtcaaagagtttttcagattctataaccctcccttctttgcaatgactgtcaattattgaattaaagaaaatagtgtccagacaaatgcctcgatccaacatttcaagaaataactattatatgtcatgcaatcaggcatgacaccattcttaaccatcgtggtaagtacctccatggcttgtccatagcttgacccttgcataacgcagcaataatagagctgtaggtcacaacatcaggtaaaatcccccggtccagcatttcatggtatgtactgtaagctttgtctgaatccccctctttgaagaagccattgatgacagtggtatacgacaccacatcaggtgggctacctcctcctcgatcatcagccatcatgtgcagcaactcgagagcttcttggcttctgttctcatcacacagcccgttgagaagattattgtaggagaagacatttggtatgcaaccgagctcggtcattctgcggagcactatgtccattgcgtcgctcgtcctcttgtcggcacagaggcccttgagcagaggagtgaaggtgatggcttccactctaaatcccttcttaatgacattgcccaaggccgcgaaaccgaggtccaagcggcccgcgcggcagcagcaaccgatgagaatgccgtaggtgcacaagtcgggagttacctcgtcggcgccagctcgggccatgcggttgtagcgggacacggcggccgcggggctgtgacgcgcgacgtcggcgagggcgcggttcaagccgtagatcgaggcgcccctgccacgccggagcaattcgtcgaacacgtggcgtgcgtcctcggcgccactgccccccgcgcggctcctcgcccttggatcgagccgtccgagcgaagggcgccaacagcgcgggaagcggcgcggcgcgccatgcccgccctagctgacaggtgcagcagcagcgccggcggaaaccaacgccgcaacgcagtttgtcttatacggagaggtgggcggcaccagtggaggatagaggggaggggaaggaggagatggcagggatggtgtaggagatcggcgacgagcagggcgtggagagaatgagagatcggccggcgacgtcggggcagggagatcgcgatcgatctcttctgcgcggcgctcttggggaaaaaaaagacagaaaaaaactaatgctataataatgattatatttattttaaagttccatgggagttataaaagatagttctgaaaataaacaatgtcccttctctcccaccgtaagcgacaacagctgcgcattttcctactgcgcgccgtgaaataatatgatatggttggatttaatttttattaaattaatcatgattaataatgctctttgaatattttttaaaattttcggagcttaatttctaattttgataatataaacaccttttcaacatttatttaaataaaattcccaatttctctatgggccattttcagtccatttactatctcagcccgcaaataaattctactttacctcctccaactcctcctctgactacgtttgttcgaccctccggccttccctcggcccatcaagcatgcgcggcctgaagatggaggcgttctgagccgtctgatctgatggacagcttggatcgcctccgtgtcgctgaagatacgaatggggaaaaacctaaccctccctcacatttccttctctctccatatcctatctcccaagcagcggcggcggcgccctcccataccacgtgcgatagcagcgacatcgttccccgtgagcggcggcggcggcgctcgagcggattcggcggcatcggcagcttcccgcgggattgagataagatttgtgtgctttttattattttttctgttctttttctctattttttggattgtctagttggatttcaatcggatttacggacgaaaatttaatgtgacgaaaggaaaattatgaatattttaattagttaagataagatttaggctatctcttttggtgatgctctaaaataaaagcatagtttaaatttgctatagtctgctacatcctcagtttcatattatatgtcattttgattttttttcgtaatcaaacttctttaaatttggctacatttatagaaaaatatagtagcattttaataaaaaaacaaacatattataaaaatatattccatgctacatttaatgaaactaatgtggtgcttaaatgttgctaattttttttctataaatttagtcaaactcaataaaatttgactaagaaaaaagtcaaaacaacttataatatgaaacagagggagtacgaaataaaaactactccctccatccaaagaggtaataacctattaccgaattagacattacatacgactacaaatctagatagcctaatcaaattcgtgaatccaaataatatctaatctagtactagattcttatattttggaaggaaagaagtacttcatccgtcccgtaatatagcaatatagtatggaacgagattgttatattatggggcggagaagtagtaaaaatgttattgcaagtttgcaactgtgccaaaaccggtgtggtgttgaatgaaacatatgttaacgtgataaaatgacattattaaactgtacaaacagtttaataaccgatgtattgattattgggtagttagtagtagtgcatgctaaataatgaacgtaagggcaagctattgctcgttgtgctctgtgctaaggggctcaaattgtggtgtagatgacggttcaagctaaagtttcagcagaggataatgagaaggatatcatcttaagatcataagatgtaggatcaatatatacctactgcctagataccttaagtttgaaactccagttacaaacccctttatgatccgttagtagagataacgacaaacttttgtgttttttctggcatcaacaccagaagataatagcttgtttacagtccaggaaccacagtcaaaataattcggagaggtgacatacatacctcgctatttacacatacagagaagatccctcctctaatcggactgtaggagaaaagaattccaacacagaatttcaaagctgcaaaatgcttcagcagctcaaagattctataaaggacttgtatttttcagggagaaatatatgatattcttgatattttcccccagacaaaagatctataaacaaggaagcagtggatgcttcgag

SEQ ID NO: 32257 - DNA, 34897 bp, Oryza sativa
aatgttgaaagtcctagcctcaagcttcaaatccatcaaacataggttctgaaacattcgaagtgcatcatcagtgagtttgtttttgcaaagtccatgaaggattatgttgtatgtgctaagtttgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggattaattgatataagttaccaattccttaatcaaatggattaattctcaaaactcttcatcccattgatatcccatagaagaatgaattcacatgaattcctagcataatgagccttggaatttatttgatttaattgatttaaatggattaattatccaattaaatctaacaaagttcaatctgcattccactttcggtaatcctgacatagagttcttttgcagcagcagttcttctggtttgaaataaaccttgcagaattatgttatacgtaataatatcaggactaacaccactgctctccatctccttaaaaagaactaacgcgtcttccatcctactaattttgcagtagccattaatcaaagtgctataagtaacagtattaggtttcaacccaactgagaccatgccagaaagtaacttcattgcttcatccatcttacctgccaagggtaatgatatcgggcttcacaccaattcgtaccatcaagtcaaagagttttccagattctataaccctcccttctttgcaatgactgtcaattattgaattaaagaaaatagtgctaagacagatgcctcgatccaacatttcaagaaataactcttcagccttctcccatttgtcaaagatacagagactatgaattagggagttataaacaatgctgtcaggtcttagtccttcatcgatcatctgctcaaaataaagcatagcatcttctactctacctgacttgcaaagtacatctataactgttccataggtcactgcattcggattcaatccttgctgcctcattttgctgaatacaagcattgcctcttctactttctcttgtttagcgtatgcacatactagaatgctgaaaacataatgattagggtggataccgtttcgtaccatcaaatccaagagaccatgcatctcaacaagggctcctttggtagcatacccctgaagcagggtaccataggtagtaatatcaggctttaggcccctcttggtcatagaatcaaaaatctttcttgcttccgtgcatcttccgttcttgcaaagataatccatgagcgagttataagtaacaacatctggttcgacaccatcactgcgcatctttttgagaaatacaatagcctctttcggctgccctgaagagcaaaacccatgcacaatactattatatgtcatgcaatcaggcatgacaccactcttaaccatggtggtaagtacctccatggccttgtccacagtttgagccttgcatagcgcagcaataatagagttgtaggtcacaacatttggcgaaatcctctggtcaagcattttgtccagatccccctccttgaagaagccattgatgacggtgctgtacgacaccacatcaggtgggcagtcacctccatcatcagccattatgtgcagtaactcgagagcttcttggcttctgttctcatcacacagcccgttgagaagaatattgtaggagaagacatctggtatgccacgacggagcaattcgtcgaacacgtggcgtgcgtcctccgcgccaccgccactgccccccgcgcggccccctcgcccttggatcgagccctccgagcgaagggcgccagcagcgcgggaagcggcgcggcgcgccatgcccgccctagctgacaggtgcagcagcagccagtggaggggaaggagatggcagggatggtgtaggagatcggcgacgagcagggtgatcgcgatcgatctcttgcgcagttgtgtgcggcgctcttgggaaaaaaaaccagaaatttccgttcagaatggcccacttttattttttttattgtactgaaaaattacccttgcgttgcaatggaaaaaaaactaatgttatgataatgattatatttattttatagtttcatgggagttataagagatagttataaaaataaacaatgccccttctctcccaccgtaagtgatagcagctgccatttcctcatcacggaccgtgaaataatatgatatggttagatttaatttttaattaaattaaccatgattaataaatctcttttaatttttttttgaaattttgggagctttattgctaattttcataataaaaacatcatttcagcatttatttaaataaaaatctaaataacagttagtgatgctctaaaatgaaagcacagtttaaattctatagtctgctacatccttcgtttcatattatatgtcactagcaaatatgcccgtgagttgcaatgggtgaactaaaaattaaagatttgcactggttttaggagtttgaggggacaaattaagggagctaaagcgaaattattctgtgcggagcgtacacatggcctatggggtggcccaatagtgcggccggcctgggaacaattcagaggcaacttaaaggacctaaagtgaacttatttcacgcggagcgtacatgtggcccaatagtgtgggcaacctaggagtggcacccggcccaacgcgggagaagccgtagttgtccgatctgatggacggtcctgattgatcccgatctatataaaaactcagcagcccaaaccctaactctaaaatcatttttcctcccccctatctctctcaaagccaccactccccttcccttcctcaccggcgtcgccgctcccccccgcgcgcgcgccctcaccggcggcgccgctccatatccccctcttcctcctgtctcgccggcgcggccacggggaggcggcgacggggagggcaccctactggttcccctcgaccactccctccccctttctccaccggcggcgctctccctcccggcgtggaggcggtgatacattctagtataatgaatttggatagatgtgtcacattcacctaaaatctcttatgctatgtaacgaagggagtattgcaactttgcaagtttgtaaatgtgccaaaaccggtgtgttgaatgaaacatatgttaacgtgctaaaatgatgttaacagtttaataatcggtgaattgatttttgcgtagttagtagtagtacatgctaaataatgaacgtaagggcaagctattgctcgtgcacacttgccatgtgcactgatattttgtttttgacattttggtttttagtaataccccttcttttttttaaaaaagtctttgttcctttataaaggaaaggaacatcgtatcaatatcacacgttatactgtcatatccgtatacaatcgcttgtgcgcataccatataagatcgcttgacacgcagtaactgatatgttgagctgaccatggaatctcgtcaaattcatacccagaacgcagaaacaaatgaaaaggtaaatcacatgcacgtaacacaagtgaatccaatacaaaacattattacacttaccgaatggtgtacccggacacaatcttaaagaaactaaaattaacaataaatcccttaccttactcattaatattcatagtcactaggatttgaacctagtagataacgttatgcacccacaactccttcacaataattcctttggtgcttccccaaatttgatatccttaacttaagccaagtaatcgagcgtctaatatcaaatcttaccaataaatttgtggagtatataattaccaagtttccccttttcttctatcttttggttcattttcacttcgattttcaatgaaatataactcatttgtgcacgacaaaattactttgttctactgcttaatcggcgtggcagcaccaagtgcacaaatgaaggcagaagcagtcttaccattcagtgttcgatcctagcctgccctacaccatatcttcaaacaagaacacaggattgcattgacagactcgagcacacatttttacttcacagtttaatttaatgaaacgagcaacttctcctaaattacgataagttcttaggatacgttatatatttgtattgttaaatataaaataggggctaaaataaactacatcagagtctatttttacaaatctgactaacaacggacagtcctgtatttctcctctcttcagtctgcaaaaatggacagcactcagcacctagtctgctaccagccatactagaggctcaggaacatgaagtagataaattgtggactagaagtctagaacatatataaattataaaacatggaaaaaaattcccactcaacgtgggcaagcaaattagcatgatatgcatgaaaataaggtgctaacattcaaagatagaaataaacaaaattcattatgtggtttggccatatgtgtatgcaacaaagttcttcattttaaagaaggtgctataactgtgtgaatagaactatgttcaaggcagccaccaaagagagtttggtgttttccccaaaatcatatatgattcataaaatcttgtttgtttaccaaattctgtaattgcatatatgtctacttaagaaagcagggatgagactacagccataccagctggctcctgctgtccatacgccgcaaaggaattactcctaagagatacattgcccatcaaataattcggaacataaatatacttgtcttgcttataaacttgaaacaccttcctagagttagaagggtatagatatccaaaaaactctgatggttcgcaacatagatagcagggctactattcggtggcaggttctccattccctcgacgtcaagcttgtagaacatggaaattgtcagagttgcccaaatctttgcaatgtagtgctgagctctcgaaaaaaatttgcaaatatacttattttttcaataatttatgtttatatacatgcatggagaggttttataaaaatatacgcatcccgcgaaacggaaacgcgggacagcgacggttccgcagattcaaaatacgggaccgacgatcctgcgcggaaccgtcatggtccggcagctccaaaacgcggaatcgcgacggtcccgcggttccaaaacgcggaaccgcagtggccagcgactccagcactgtgcagcgcagtttatacactgttttaaccctgtgcagcactgttcacacattgttcatggtcggtgccgcgcctccattgtgcggaactgacccgggaactgtgtaaaacagtaccagaaacagtgtcaaacagtattaaacacagtgccatgcagtaaaaaaatgttggcgccgcggttccgcacactggcgctgcgggagcgtaccggttccgcgttaccggcaagcgagactggctcggtcccgcagccccattccgcgcgaacgcctcggccgtccactccgcgccgccacgccatacttttgttgcgctcccgcataaccgatctgcggattagttatattttcgcaaattcttcatactagtgtatataaacgtaaatctttttcaaaaaatgggtattttcaaatttttttcctgaactctcctccggtatcggtcaaataggagcacaagtggatgaaccacaaccatggcgacaaacaaaaagattgctgcaactgcagccaccgcgtagaagcaaacccctctgacccttgaaatcacatcgatgtctggtaaccaaatcaacaacaaaagtaaccacataagaaatgcaattctggaattcggtatgaatcccatgagtttgtccatgtacatgattttatttgcatccgcacattacatgtaaactgtatagacatagttttttgttttgcatcatacatcttagtaagaaatatccattgctgctcaaattccatgaaacacaaatgcacaatagctagtattagctgctacaagttctttagaaagtcttaacaactgcctgttctcctcaatttatactaaacattctattgacaccttcaaggttggtgtggagctaactgttataaccaacaatatatcatggtggttaacaagaatgatgcgctggcaatgattatgtttgatttccacaccttcagttttaaaattagagatggcaattttgtcactgcaggttcaaatgatttttctcccctccacaattccacattttgtcaagcaattgccaacaacgttccaaatgtaaatgttccagcaaactacattaatggctatgaggcctgcccagcgagacgaacatcacaacacattttgcgagaaaaaaaaataaaaaagggaagagagtggaggaggctgcaaacctgagagcgcctgcggcgaatcccccatggtagcgacaccaccagcggcgaaatccgatctcaccacagtctccctccgccgccagctcgccgccaaagcctgcggaccagggcggagcagcgcggccgatacaccctgatgcggatggcactccacgcctcggccacggtcgccccccgccatcaccactgcaaaaacgccaaaatcacaaatcaaccggatgagaagatatcagctagcggcggcctcgagatgcgtgtgattaccgtgcgcggtcgacgacgtggcagcgggggcagcgacgtgggcgattacgtggtggcgacgccgacgcggcggtcaaatgcaaaagggtcatcaccaccaccactgtcggtgattacattttaagatagacggagtctttttgccatttctctggagttcccatcagaactgtgcgctcttattgaaatccatccagttgagcctctaattggatttgcattgccacgatccttttttatattcaacttcaaaccactaccattgctgtgcctctcgcctaatgaaccacttgatgccccattgcttgatataaatggagaacaattgaatgccttctgtgacagaccagcatcactaccagaagatatagtaatatgagaaacttctgattttgaagataagcaacaatgacgtgtctggttcgacaaaagtttttttttttcgagttcttgctctttccatcattaaatgaagttccccccatgacatctgctgcataacaaagcttcaagaatgtcactaattaaacttatacgaggaaccaacaagataatctgggtcaggaaacatgaaatattaaaaatatcaggtagcattttataaatatttggtgtcaggccaagttcaacatctgtagtgagacttgaatggcgaccaaactatattgagacagtgcatagaaaagccaacgagatcaactgatcaaacaaaattggtgtttgttattaccagagtaactctgttgagagactttagacgatttcggatatgtagagctggaaacaacagaagaattctgaagtattgaaagagctgcagcaaaacaaaataggcgtcagactgcaactttaacatactggatgtttaaaacattttattgtgttagcgaacacattgtattattaagaaaaatacctgataataactcaatagtattgataatgacaccaacaaaagaaagcaaggagcgtttcgggttcaattttctactcatattaagcaaatgggtctgcaagaagcaaaatgaatgtaagagttcatattgctttttcaggaagaaaagaaaattgttaagcagacatacaaagtcgcactgtttgcacattttgcacagaacaaatcaggagagaagatagtacagaagaaggaaatgggtactaaactgaaacagaacatataaggagcattaccttgttatcatcgcttagaaatatggcattttccaatattttcaaacatttcaagaggagagcagcactttgcaaagatgttccttcatttcggtccaaagctgaagtggatgtatcctttatgagattctgatacacaaggtttgccaccagaagtatattgttaatttatttattcagtttatcagcgtaatatgattgcattattagttggggaataaaaagtacacagataggaacaccaagcatttaaattaatgcgcaatttactccaaacttgcttacacatgcaagaacagcaagtatagctggaaaagtaacatccaaatgaataatgttcacttggtgtagatatgtcaagtgttattatcgtttcaagtgttattatcgtgggggatataatcatcagaggaactgtaagatactaacaccacatgcagaataaaaaagtattaaaaaactatttttgcaacataaaacaacataatttgtgttgcagccaattttccatgtcctgatgaaaatagttactacctcaagcattttccatgccccaaaatataacaacctttggctatgtatctggacaagcattactttcatgtggcttcaagcacattaaagctaaaatggcgaaaaggaacaagcctgcacaatccattagagttgaacaaaggaaatgtaaaatatgcgatgttagcgagatctcacctccaatgttgaatgaaaatccaccataacgtcaaaaatactatcaagacctcccatctcccttaatgtctctttaaaatttcctccaactctggacactgtgtcagaagtctctgtaacaatcaaatatttgataagggaaaaccttcctagtatgacaatggccataggtgcttctagtgcagtccactactccaattcaattctgcaacacagatggaagtcatcaatcaaaagcaggtgaagaaaagggctaagcaaaccacccatgaatattgcaaataggtgctatgtaacttatgacaagttgacaactgcttatttggctcatataaataaatataatggtcataaagggaaatcatgaccaagaaatttgattaaaacttaccctctactgaaacagcagacaagcatgcattttccattgtcaacaaagcaagccactttggacacagttctggccttgttgttttcttgtcatctttgtcgagcgacttgatcacttgacagcttaagagaatctcttcaacttttgaaaggatttcctctgaaatgcagtcagaatccttatttgatccattaagcatttgaactttactgattccaaaaagtttggaacctatcgatggtgctgtggaatcaacaagattcactggaggatttaataatttaagaagaaaatggacaccagattctgaatccaacaaatgattttcttgaacctgaacaacaagaagggagatattggagaataagcacaagtgaagttataccattaaagagtacgagctgctagcaataataactgaaatttacaccataaattaaagttcaacttcaaacaaaatgatgaaataaaagcatggattttctcaaataatcttctttgtaatcacatgccaaaatattcatggaaaactggtgaatacttatataactatactgtagaaataaataactttgtcatgatgtgattatctttatggactgttatataaaagaaaacaatcgatatgcgtaaaaaattggaatgaagcatgcacagaagcataaggatgggattgagaggtactcacatcacttcacaaaatgaatagaagagcagctgcaccaatagtgcagggaggatcatcaatgttcaaaaccaaaattgaatcaataatttgttgtaccaatctataggatataagaaaagaggacacttgtgagtaagaaaacaaaaggtaacgtacaataatttcattaacggaacatgtgtttgttgaatggaacgatttcagtatcttttgttcagttaaaaaacaagtcaaactattcaacacctaaacagtacacattaacgaaatttaatgaaaccctatagattgatacacacaaatgaatcctacacaatgttggatctaatgccaaaactactgcctagacaaattaagtttgaaactccagttacaaattcctttatgatccgttagtagagataacgacaaacttttgtgttttttctggcatcaaaggcagaacataattgcttgtttaccgtctaggaaccagagtaaaaataattcggagaggtgacatacatacctcgctatttacacataaagagaagatccctcctctaatacaactgtaggagaaaagaactccaacacagaatttcaaagctgcaaaaggcttcagcagctcaaagattctataaaggacttatatttttcagggagaaacctatgatattcttgatattttcccccagacaaaagatctaaaaacaaggaagcagtggatgcttcgagggagaagtgcttctcatcaatcatgaacaggtaagtgccagccctggttatatcacccctctgtaacagtttcctaacaatggaatttagcatgcgggagttggcagtacagccattctcctccattgaaagaaatagatcatccaattcttctagcaacccctgctctataagattttctgccattaaactgtaggtcctaacatctggcactaaaccgttagccgagagagctgcaaacaaatccttggcttcatcatttctgccaactttaagcaatgcaccaatcataatgttaaaagtcctagtctccagctgtaaatccgtcaaacataggttctgaaacattcgaagtgcctcgtcagtgagattgtttttgcaaagcccatgaaggattatgttgtatgtgctaagttcaagctgcgttccactttcggtaatcccgacatagagttcttttgcagcagcagttcttctggtttgaaataaaccttgcagaattatattatacgtaataatatcaggactaacaccactgctctccatctccctaaaaagaactaacgcatcttccatcctgctaattttacagtagccattaatcaaagtattatatgtaacacaatcaggtttcattccaactgagaccatgctggcaagtaacttcgttgcttcatccatcttacctgccaagcaatatccatcgatgagagtactgtacgtaatgatatcgggcttcacaccaatacgtaccatcaggtcaaagagtttttcagattctataaccctcccttctttgcaatgactgtcaattattgaattaaagaaaatagtgtccagacagatgcctcgatccaacatttcaagaattaactctttagccttgtcccatttgtcaaagatacagagactatgaattagggagttataaacaatgttgccagggcttagtctttcatcgatcatctgctcaaaataacgcatagcatcttctactctgcctgacttgcaaagtatgcctataactgttccataggtcactgtatccggattcaatccttgctgcctcattttgctgaacacaagcattgcctgatctactttcccttgtttagcgtatgcacatattagaatgctgaaaacataatgattagggtggataccgtttcgtaccatcaaatccaagagaccatgcatctcaacaagggctcctttggtagcatacccctgaagcagggtaccataggtagtaatttcaggctttaggcccctcttggtcatagaatcgaacatctttctagcttccgtgcatcttccgttcttgcaaagataatccatgagcgagttataagtaacaacatctggttcgacaccatcactgtgcatctttttgagaaatccaatagcctctttcggctgccctgaagagcaatacccatgcacgatactattatacgtcctgcaattaggcatgacaccattcttaaccatgctggtaagtacctccatggctttgtccatagcttgagccttgcataacgcagcaataatagagctgtaggtaacaacatttggtaaaatcccccggtccagcatttcatggtatgtaccgtaagctttgtccagatccccctccttgaagaagccattgatgacagtggtatacgacaccacatcaggtgggcagtcacctccatcatcaggcatcatttggagcagctcgagagcttcttggcttctgttctcatcacacagccccttgagaagaatattgtaggagaagacatttggtatgcagccaagctgggtcattctgcggagcactatgtccattgcgtcgctcgtcctcttgtcagcacagaggcccttgagcagaggagtgaaggcgatggcgtccactctaaatcccttcttaatgacattgcccaaggccgcgaaaccgaggtccaagcggcccgcgcagcagcaggaaccgatgagaatgccgtaggtgcacaagttgggagttacctcgtcggcgccggctcgggccatgcggttgtagcgggacacggcggccgcggggctgtgacgcgcgacgtcggcgagggcgcagttcaagccgtagatcgaggcgcccctgccacgccggagcaattcgtcgaacacgtggcgtgcgtcctcggcgccactgccccccgtgcggccccctcgcccttgggtcgagccctccgagcgaagggcgccaacagcgccggcgcggacgcgggaagcggcgcggcgcgccatgcccgcccgccctagcggactggtgcagcagcagcagcgccggcggaaaccaacgcgacgcagctgatacggagaggtgggcggcagcagtggaggatagaggggaggggaagggggaggtcggcgccgtgctatttggcgctgaagtatacgattttgcgctcaacaaaaagattatttttaaataagttttggtcacggttaatttataaaattaatttttggaaagtgtcaaattgtcaaaaatttgtgtgataaaagggtggccgcagtttgcaagcgcgtctaggtctagacgctgttataaacaacgtccatcctgttttgataaatcctccaaacaaattgctaataatttaattttaaaaatattaattattattaatataaaaattcggcgaaacatgtgtcatgtaaattggatatatagatctttatttgagtcagattttaaatccgtttgcttttggaaatacggaaggagtcgtataaggtatctctttaaaaattttacatgctaacttgatcgagatatctgttctgcgcgcgtggaagagaaaaaaaacataaattttttgcggtagtttaatagagggatccacctttagttttttagttttttattgaatttaggctctctcttagatggaggagtatttccacttcctattttcagtttaggaaaaaaaataaattttagggatagattattgctaacatattagtgatgctctaaaatcaaagcacggtttaaatttgttatagtctactacttcctccatttcatattataagtcgttttgattttttttagtctaacttatttaaatttgactacgtttatagaaaaatatagcagcatttttaacacagaacaaatatattatcaaaatatattccatgctaaatttaatgaaactagtgtggtgcttaaatgttgctaatttttttctataaacttagttaaactcgataaaatttgactaatataaaaatcaaagcgatttataagaaaaaaaaagtcaaaactactccctccatcccgagaggtaataacctattaccgaattatacattacatacaactataaatctagacaacctaatcgaattcgtgaatctagataatatctaatccaatactatattcttatattttggaagaaaagaagtgctccctccatctcataatatagcaacttagtaccagacgagacataccaatttgttatattatgggatggagaagtaggaaagaatttattgcaagtttgcaactgtgccaaaaccggtgtgttgaatgaaacatatattaacgtgataaaatggcgttattaaaccggtgtattgattcttgggtagttagtagtagttcatgctaaataatgaacgtaagggcaagctattgctcgttgtgctctgtgcaaattgggctcaaattgtggtgaagatgacggttcaagctaaagtttcagcagagggtaatgtgaaggagattatcttaagatcataaaatgtagcatcaatatatacctgcgaaagatctgagaaaaaaattagatgtgtaggagtaatggtagttaagaacccttcacttgacatgtgatggaagcaaaaccaggaagaagaaagggaatgaaagagagcttaacacgctggtaggtttcttactttctatggttaaacaaattgagttacataacgtggagaactagaacactggaagaggttggaaagtccccccccccccccccaccgtcgctctcgcacgggcggcttggggggcgaaaaaaccctagctgcccactccccacttcttctcccccacctcgccgccgccggagctcgccggcggcgaagccggcagcgagcaaggaaggcagcggcgaggcccttttttcttggcgtcttcctcctcgacgcgatgaggatggggcaaacgacgaagccctcactgcggtcggaggtggtgacgccgtggcggtgtggggaggcggcggatccggcgcccccaaggccggatccggccatcccgcgcctggatctggcgtggcggcggcacgaggcggctagggacggcggtggcggctcagcaaggtgcgcggtggcggctcggcagcgggcgggcgaggtgcgcggcaatggcatggggctgcctcgggcgcggaggcggagcgtggcggcgtgcggtcgtgtgcgccggtgacgtgcagccggcccgggcggcagcggcggcggctcagtggcatgctcggcccttggagctggcggttgtgctcgctggcgccggcaacagcgcgacggccgtggctcgctggtgccagcgcgagctgtcccatggcgcggccaggcctcggtagccgggcggccgtcgtggtgcccttagcggccagctgggcggcgcgacgcagccaggaggggcgcggagaccaggcaaagggggtgcaggtgggtggcgccggagccggagcgacagcgtatccggcattggcgcaggcccagatggtagtgcaaagggagctggagtcgatgggttgtcttcctcgttgccggtcggcaccctcgcccttcctagagctcatccccttcttttgcggggagtttctaggttggattgagacagcagctcgccagcgggggaagctcaggctgccgaagcaatgtcacccagtcccgggttctcctttggccaaaactggcaaggcggccggcgggtggtggaacggaggggtcctgggccagctctcagggatggtggttcgatggagtcggccgacgaaggggcgtcggtgcggtgcggtggaagctacgtgctaccttttgtctgtgtggtggttctgagtggtggacggtgatctgcgatcaaggctatagggtcctaggcggaagcctagtccggtggttcaccggaccggcagcggctacgccttcgggcgtcgtaacctccttggggcgctgtcaagggttaccctctccccttcttgatgagtttctctgggtgaaaaccacatctttttagatggacgatggcagcatcctacatgtcgtgaccaccttggtggcatcgttttcgaagtctcatctatgtgttgctgccgtaggcctagcggcgtttggtcacacttagtggcggtcgtttggtgctaggcttcaccctcagtggtttgtgcttgggggtagtgtatggtgtgtggtcatgcaccttggtgcattgtggtgttttttcttgtaacttttactccttaatacattcggatggccttgtcgatgacatgggatcaggagtatcatgactagaggtttgaggcagacacaatcgcccacgtggcctggcaccctcgggggacgtcgggcccgagggtgatgtgttcgccctcctcttagtccccccgagggggtcggaccgcacccgcctcggccccgagggccgaggcgccccgacccctcgtgggtttttgctccgcgtgtatgggttaggtgagcacagcggggctcacctaaccacatttattgcggtttggctgagcgtgtcacgcggcatgtaacgaagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcctagagatggcacgttagtcctggttagatatatgccaggcttcatcctaaccattacaggcaagatgttgtgtgaagaagggccaacatgtagattgctaaactgacgcgtggtggacaggaatgagcaatttgtgaccagtctgacactggtcatgtcgtcagcagacagccataatcccacgtcgcacctgctttcggcggaagtggaggtaggtatgggccgtcctatcagaaggtcattcggacggcaactatacaaatctccgtccatttatgaaaaggtagggtaagtccccacagaaaggagggagatggtgcatgtggtatccccttaagatataaaaggaggaccttgcccacttagagggggggactggactggacttttccagattcggaacccagaacaagggagaggctggctcatactttgtagctccttcatacacagatccccccaaaacacaggagtagggtattacgcttctcagcggcccgaacctgtatacatcgcccgtgtcttatgctctttcgacggtcgcgaaccttccacatacagagagcttagaatttcaccctgagtccccggccgaaccggcaaaggggggcctgcgcggtctcccggtgaggagccccacgctccgtcatctggcgcgccaggtaggggactcagtgtgtgtttttctgagctctcgtactcttccgtgtgcgccaagcttttcctgttcagcctgatggccgagcaagcaaaggcgcacgacctctctccgagtgtgagtggcgacgacggggagccgaacccacgccgtcgagctcgtactccaccgctccctccacgccaaagtcctaagcggggggaggcgctcgagagggtcgaaagatccgcgacttcaccgatcgcgggcgatggagaagaacggcgagatggggagcgtcgcctcctcgtctacggcgacggcagcacgccccagggcgcgctccaagctgcgggcgcgctcttacgtcacccgcctgtcgtccctgacccggagtctccagcccaacgatggctggacgacgtggccaaattagtcatgacggtacggcagcgcctagatgctggtgggcggtcctccgccaccaaggcctctggtgctgctaccaccggctccgcgtcgtcaagacggagggcacgacgagcggcagccgctgttcgccattcggccgccactccttcgtcgactccttcgacccagaaagatctgcgtggggggccggacgcccgcaccagcatcgagcgccggcgtaatgaccgaagtgctgcccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtggctagcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatattgaagcttatgtcgatgacttggttgtaaagacgcgcaaccaggaaacgttactcatagatctagcggaaacttttgagagtctccgctccgcccgcataaaattaaaccccgataagtgtgtgttcggtgtacctgcgggcaagcttctcgggttcttggtctctgcccggggcattgaggccaaccccgagaagatacgggctatagagcggatgcgcccccccagcaaacttagggatgtgcaatacgtcaccggttgcatggccgccctaagtcggttcatatcgaggctgggagagaaggcgttacccttatttaagcttctcaaacgctccggaccgtttacctggacgaaggaagctgaaaatgccctcacccagttgaaggcgtatctaagctctcccccagttctggtcgccccggagccagacgagcccttgctactctacttagcggcgaccccgcaagtagttagtgcggcattggttgtggagcgcgatgaggacaattctcatttcgcgcttccccaccctgtgccgacttggcccgggagagagcagggaggagaggcccccgagccgaacggtggcccgaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggcctaaggcccctgacgaccggagttggccctttgcccgcttgtccgacgacgccaggagcccctgacccccaggacggccccaaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtggttacgtcttaccccctcggtcaaatcttgcataatcgagacggtacaggacgggtggtgaaatgggcaatcgaactttctgagttcgatttgcactttgaaccacgccacgctatcaagagccaggctctcgccgattttgtggcagagtggaccccggctcccgagcccgtctcaatccccgaggccagcacggacccctcgcagctgcctcacaccgcccactgggtaatgcagttcgacggctccctgtctcttcagggcgccggtgcgggggtcacgttgacctctccgagcggagacgtcctcagatacttggtccgcctcgactttcgagcgaccaacaatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtccacgcgagcccagaccccaccgggcgcctttgaagaaaggcttgcccagccgtcggcgcgacccgaccccttaggggagacggacgcgcctgaccggcccccgaggcccgttgaagtccaggcctcgggacccgaggggagcgctcccagctcccttagattgattgcttggattgccgagatccaagcatacctcacagataagactttacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaattcagaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaggcgacgcgcggccctcagagccgcgcgctaccagcagagcctgcggcgctaccatcagcgtcacgtccgggcccgatcactctgcgtcgacgacctcgtcctacgccgcgtccaaacgcgtgctggattgagcaagctctcaccaatgtgggagggtccgtatcgagtggtcggcgtcccccggccgggctccatacggctggccacgggcgacggcattgagctgcctaacccgtggaacatcgaacaccttcgtcgcttctacccctgaggggggggtcgggtgtcaggtttcgggctcgggccaaccccgcaccccctcgggcgtgcagggttggccgggggctgccacacatgcacattcttatttctcttatttcagtatttcaataaaagcagtttcaatttcctaaaggctgtatctgtgtttttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccacgccttttgaggactgggacctgggcacgagcccttaatcaagctaagacgcaaaaggaccacgtcacagatcatcctcatctcatacacacagcaagatgaaattgacacaaaaatttcttcatttttgattacagattaagttgatctatacaaaaaagaggcccgaaggccttagaagaaggaaaagaagaaaaaactgaagaatggcgggggcttgggggatcaatccgatacgcccgggtcgccggcctcatcgtcactgtcgtctgcaccaccggcattgtcctcctcgtcggagttgggggcgaacgcgagccgaggggctgagccctcgaagctgtggacgatatggtcggcggcatcccggacctgcgcgcgcgctgtcctcggtcccaggagggaactcatccagcgccatccatggagaaattggggtccctggcctggtaactcgccagtacgagctccaccgctccttgggcgaggtccctcgaggatgacttaattgtcttctcgagctcctcggggagccgttggagagccccggccatcttcgagaggcgctgggcgaggcctccatggttggcggcgtactttacggtccgccctctccagaggcccacctgccgaccggcgcgatctaggcgggagacggcgtcccaaagcatgccgggccctacctcgcctgccaagcggagggcctcgacctccccggcggacgagtttagcgtgccctgcagatcggcgatggtatgttcggcagcagcgaggcgggcggctaagtcgttttcgcccgcagccgccccgccgctgcgcgccctcgcgtccagctccttctcccgcgcctcgaggtcagcggcccgctggtttagtgcggtcctctcggcgcggacacattccagagtgcggcgcgcctgctcctcctgcgctgcctcgcggagggacaggctgtccgccagccgttgcgccgcggcctcggcctcctcgagagctcgctcccgctcggtgagcgcgtcctcgtggaggcggagtgcggactcctcttcggcacaggcggactcgtgcgccgccagtgttgcctcccggatagtgacggcggcctcgcggtccgccagatccctctccacgacgcaggcgcgctcttccagcgccatggcgcgcgcctcaagggtctcttcgcgccgtcgggacgccgcttcggtctcccccgcccgctgttctcgggcagcggcaacgtcaagcaccccctgggcggcgtcgagctttttccctagctccgcctcccagctcccgtattgaaggcggagggtgtcctgcgcctcgttcatcacgctggtggcaatgagggcagccccccgctcctcctccacttccttggcgatttccgccaacaccttcttacgggcttcaagctccgagacatgccggcggtgtgccttgcggcccacctccaccatggcctccactgagcgccgcccctcctcgacacgcgcccacgcggcgtcgagctccgcccactctgcttgcagggcctccacctgggcactaagcccgtccaacaccgcgatgtttgcggcggccaaggcctgcagaaggggctctgcgctcagcggggcgatagaaggcgtggggaagagccgccttggagaggatgccacgcggctcgggccgccgatggaagtgccggactcggggatgtccctcagacctggttggtcctgggcgtcgcctgagggagtgggcccaagcgacgcgcccgcagcctcgtcgccagctgccccggaagttgtcgcctgagcgtcgcccgaggaagcgggctcaagcgacgcgcccgcgacctcatcgcgagctgcctcggaagtcgccattgcctcgtcctggcgaaatccggctttctcccgagcggcttcctcggcctggtgggctcgggcggcctcctcccgagcggcttcctcggcctggcgggcccgggcggcctcctcccgagcggtttcctcgccctggcgagcccgggcggcctcctgggcggcctcctcggcttcccgtaggcgatccgcggcctctcgccggtcagattcccgcctccgggcctctgcggccgccggatcctcggcctcagactggccggacttggaatggcgggagggacgcgacgggatctcgctgaaacagaagaaaagaccagaagacgaacaagatgggtgagtgaaaactcgcgttgagagaatgaatacagccacgatgggtgagagacgaacctgcgagggggtcggttaaacgaccactttggaggggaaataaggtttccccgagatggttctgtctcccccatcttgcggagccgcttcttcttgcgctccccctcgggctgcgatgtcggcgcggccccctccgggcgcctgctgttggcacgcaccgccccgccccctcggggaggagatgggggaggtgttcctccctgcttcctcttcccccgggcgtcggcagggcggctgctcctcgggcctccgtcgcgagacccagaagcacgaccccctcccggggtagattgatcccccctacggctcccgcctgcgccgtcgtggccctttggagctcactcctctgaggccccgaccgccgtcataatggtcaggatggaggcgcggtctggatcgctgcagagagggaggattccttggggaatgagggacgcctccatggagttgagattcagcacccgttggaccactatcttgaaatcctcaggagcccagtcccatctgactccctggtgggtcctcatgtagtcttcggacccggtgtactcccaggcgccccgagcgcgccgctggagcggcgcaatccgacgacggaggtagtcgccgtacaccatggcccctgtgagcccctgggatcgtaggcccgccaggcggtcgaggacggcgtcatagccatcccccagatctaccggcgcccgccagctggaggcctgcgccgggggctggctcggaagtcagaggcgcgcttcgtcggcgaggggggtgtagaaccagtcgctcttccagtcgtcccacttcttgcggagggcgcaggggatgtagcgattcagcaccggcccccatggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaacttcagaacatccatgaagaaagaagaaaatggcggaaccagccctgccattgcaaaggggagaaagaagacggaccgccccgggtagtctggcgccgggcgtccctcacccagcgtgactatctcccggccggtggcagattccggcatgaagcggcgcggcagcccagcctgcctctcgctcacgatgcgggaaggcggcagcacgctaccatcgagcagagcggagccccgtgccatggcgccggaggaagagaagattgagagcgagcgcgtgtggcgaaagtagagcacaggaaagaaggagttagggcgcaagcggcgaagacaagggaaatgatggcgaaaggaaggaaacagatcctttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccaaagcgacgttaccatatctccagacgaaacgaatcgccatgtccagattcgtgtgctactcgagtaatgtggcagtcttgaagagaccgctcattattgatagtagagttaccattgccgatgtgcgtgatttgtgaccgttgggtttctgcccaattgtggagaccggtcccacctgtcaccaggccttaggagtggcgtcacgcccgaccgcttcccttaaagagggcgatcgccctggcataacgccgggggctactgtcggtgacatgggatcaggagtatcatgactagaggtttgaggcagacacaatcgcccacgtggcctggcaccctcgggggacgtcgggcccgagggtgatgtgttcgccctcctcttagtccccccgagggggtcggaccgcacccgcctcggccccgagggccgaggcgccccgacccctcgtgggtttttgctccgcgtgtatgggttaggtgagcacagcggggctcacctaaccacatttattgcggtttggctgagcgtgtcacgccgcatgtaacgaagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcctagagatggcacgttagtcctggttagatatatgccaggcttcatcctaaccattacaggcaagatgttgtgtgaagaagggccaacatgtagattgctaaactgacgcgtggtggacaggaatgagcaatttgtgaccagtctgacactggtcatgtcgtcagcagacagccataatcccacgtcgcacctgctttcggcggaagtggaggtaggtatgggccgtcctatcagaaggtcattcggacggcaactatacaaatctccgtccatttatgaaaaggtagggtaagtccccacagaaaggagggagatggtgcatgtggtatccccttaagatataaaaggaggaccttgcccacttagagggggggactggactggacttttccagattcggaacccagaacaagggagaggctggctcatactttgtagctccttcatacacagatccccccaaaacacaggagtagggtattacgcttctcagcggcccgaacctgtatacatcgcccgtgtcttatgctctttcgacggtcgcgaaccttccacatacagagagcttagaatttcaccctgagtccccggccgaaccggcaaaggggggcctgcgcggtctcccggtgaggagccccacgctccgtcaggcctccttcggcctttccggcgaaaaaaagttacataacgtggattaatgtttgtttgcaacttatacattttctccaagagagatgcacacaacctttcagagtataaattataatttatacagtttttaataaatccaatgtagatatttggctcatttaaaagatttgtgccacccttataaaaaagaacatatagaagtatttttgtttaaagtacagagaaaaaattgccgagcacacttgccatgtgcactgatattttgtttttgtcatttttgtttttagtaatacccttcttttaaaaaaagtctttgttccttcatcaaggaaaggaacatcatttttttattaaaaaaatcaatatcacacgttatactgtcatcatatccgtatacaatcacttgtgcgcatagtatgcgtataagatcgcttgacacgcagtaattgtcaagttgagcagaccatggaaaattcaacgtttgagtttctagcccagaacgcaaaaacagatgaaaaggtaaagcacatgtttagtgcgtgcatgtaacacaagtgaatccaatacaaagcattattacagttaccgaatggcgtccgatggcacaatcttaaagaaactaaaattaacaataaatcccttaccttacccattaatattcatagtcactaggatttgaacctagcagataaatattcatagccacaaggatttgaacctagcagataacgtcacgcacccataactccttcacaataattcctttggtgcttccccaaatttgatatcgctaacttaagccaataatcgagcatctcatatcaaatttgccagaatacatacagcccggagctcacagcttccggataccatcttaccaataaaatgcactctctttatggagtaattaccaagtttccccttttcttctaacttttgattcgttttcgcttcgatttccaatgaaatataactcatttgtgcacgacaaaactactttgttctactgcttaatcggcgtggcagcactaactgcaagtagctaaaaatttagcaataacgtctgaaggcagaagcagtcttaccattcagtgttcaatcctggcctgccctacaccatatcttcaaacaagaacacaggattgcattgacagactcgagcacacatttttacttcacaatttaatttaatgaaacgagcaacttctcctaaattaagataagttcttaggatctgttatatatttgtattgttaaaaataaaataggggcaaaagtaaactacatcagagtctatttttacaaatctgactaacaatggacagtcttgtatttcttctctcttcagtctgcaaaaaaggacagcactcagcacctagtctgctatcagccatactagaggctcaggaacatgaagtacataaattgtggactagaagtctaaaacatatataaattataaaacatgaaaaaaattcccactcaacgtgggcaagcaaattagcatgatatgcatgaaaataaggtgctagtggataatgctaagtacaaactagctaatgtgaaccagctgacacggtgcctttgttgcttttgtaacgagctagagaagaatattaagattcatacatgtgtactgaattttcgtttttgaaaatatactaaaagagttgattgttttagatcatagaaatggtaactggcatttacaccaactaggatgtacatagacaactaaacaaattaatgggccatatctaaagtaacagcctcgaatacatgtttgatgctctttggtcatttttaatcgaacaagaggtgttaatgttcagtcctctcttacaggttacttgcctcttcaactatatgactgggtgaataaactcaatcctctaaaatattacttgcctcttctgtaaatttaccaagtgcagaaatgtacaatgccattacactacacaagcttatttatactgattacgaaagtaattagtaactagtatcagtacctgtaacaagcttagccttgaaagcctgtctgtgcctttgaataggttccatataataaaaaaaaacaccatctttctttagtgcactccataaccgtttagaataagagtgtcagctatcaccttccttgcttcagaacataatttctcagcatcattcccttcaattggatggtgaataatgagctttactgaacctgaattaaggatgccttccattccagaaggcatcagtttccctgtcccgagaagagtaataggtatcacaggagcaccggtctttgtagccacactgaatgcacctctctggggacatttataaccacgtcagtacaccatgagaaggttaacattatatactgaatataaaaatctcattagatgtaatgtaacctaagtttggttactgaaccttaaatgcacctagctttccatctttgcttctagtcccctctggaaagaaaaatacagatgctccttttttcaccaaatccacacaccgtttaagacagtcctgaattttaacaaaccatttgttatgctcagcatggaatacaatgttgacatactacaaatatataggaaggcgatcatgcattaaacaaaaacgatgctaacattcaaagatagaaataaacaaaattcattatgtggtttggccttatgtgtatgcaacaaagttcttcattttaaagaaggtgctataactgtgtgaacagaactatgttcaaggcagccaacaaagagagttttgtgttttccccaaaatcatatatgattcataaaatcttgtttatttaccaaatactgtaaatgtatatatgtctacttaagaaagcagggatgagactacagccataccagctggctcctgctgtccatacgccgcaaaggaattactcctaagagatacattgcccatccaataattgggaacataaatatacttgtcttgcttataaacttgaaacaccttcctagagttagaagggtatagatatccaagaaactctgatggttcgcaacatagacagcagggctactattcggtggcaggttctccattccctcgacgtcaagcttgtagaacatggaaattgtcagagttgcccaaatctttgcaatgtagtgctgagctctcctccggtatcggtcaaataggagcacaagtggatgaaccacaaccatggcgacaaacaaaaagattgctgcaactgcagtcaccgcgtagaagcaaacccctctgacccttgaaaccacatcgatgtctggtaaccaaatcaacaaacaaaagtaaccacataagaaatgcaattctggaatttggtatgaatcccattagtttgtccatgaacatgattttatttgcatccgcacattacatgtaaactgcatagacatagttttttttttttttgttttgcattatacgtcttagtaagaaatatccattgccgctcaaattccatgaaacataaatgcacaatagctagttttagctgctacaagttctgtagaaagtcttaacaactgccagttatcctcaatttatacttacattccattgacaccttccaagttggtgtggagctaactgttataagccaacaatatgtcaaggtggttaacaagaatgatgtgctggcaatgattatgtttgatttccacaccttcagttttaaaattatagatggcaattttgtcactgcaggttcaaacgatttttctcccctccacaattccacattttgtcaagcaattgccaacaacgttccgaatgtaatgttccagcaaactacattaatggctatgaggccagcccagcgagaggaacatagcaacacattttgcgagaagagagtggaggaggctgcaaacctgagagcgcctgcggcgaatcccccatggtagcggcaccaccagcggcgaaatccgatctcaccacggtctccctccgcctcctccagctcgccgtcgccaccgcaacctgcggacccgggcggcggcgcacccgatgcggctggcactccacgccacggccgcggccaccgctcaccaccaccgctgcggaaaaaaaaaaacacccaaatcacaaacccaaacccaaacaggatgagaagagagatcagcgagcggcggggggggggcctctcgagaggcgcgtggctaccgtgcgcggtcgacggcgtggcgtcgccggcgccggcggcgtgggcgagcggacgcggccggaggagggtccccataggggctcacgcctcctcctcctcctcctcctcctcctcctcctctcgacggcggcgcggcggaggctttggatcagggggcggcggcgatggatgggtggattgggtagagcggagcggtcgccgttggccgccgatggcgatggagagctttggatgtatttaagcggatgataaaattcgttggaaaccaaggcgtcggtggcgaatcgcgatgcgaacgatggatgaacaagccgtgacgtctggaaaaattcagcaaatttgatccttgtttagattccaacaaaatttggccaaaaagatcgcatcaaatatttggacatgcatggagtattaaatgttgacgaaaaaaaaaaccaattacacagtttgcatgtaaattacgagacgaatatttttgagcctaattacgctatgatttgacaatgtgatgctgcagtaaacgtttgctaatgacagattaattaggcttaataaatttgtctcgttgtttacaggcagaatatgtaatatgttttgttatttgtctatatttaatacttcaaatgtgtgtccgtatactttaaaaactttgcacccaaagaacttaaaaaactttacacccatcaaatatatctgtaaggcctcatggagttagggaaaatttttgggtttggttgtcacatcggatatacgtacacacatttgaaataataaacgtagtctaataacaaaaacaaattacagtttctgccaggaaactgttagatgaatttattaagtctaattgatgcttgtatacagaccaatcattttgaaaactaagtttttttttcaatcataaaaaataaagtacaaaaaatatttaacgtttacgataagaatagcttcttttaaaaaggaaaaagtccatatgtacccataaacttttgatagaaattcctctagcatcatgaactttaaaattggatattcaaccccctaagttttgtaatgccatttatattgtggttttcgatagtggtttacttatttggcagcttaaatgactagttttgaatatttaatatagtatattgccaataatcgatcaccaatttatactatattgtaatgtgaattagtactattgatattcctatgtaagagagaaaaagaaaagggataaaatgattgcaacttaagacgaacgtgtagattttgtgcatctcacgttgtcaaactatttcagcatgtatgcaattaaatgaaaaccacttcaggtgtaatatgaataatataaagttcaggtgtaatatgaataatataaagttcagggagggagggagggttggatgtccgatattcaaggtaagatagactcaagtcaaaatttctgaggatattcaaacttttgttatgagtgtctacgtggtggacttgattttaccaaagataatgaaaacgtaaactcaaccatttatgtgttggagggaccgttttgtcttttgtgccgaagctatttataaagcacgggccgaaaccggtgaaaccttcagaaaattacagccatcaataatttattgagtgcttagtttaaaaacaaaggagacaatatacatagactagcctcaaaaagttatgctatcatgtattatgaacttgttactccaagattttataaaattattatgatattaaaataatggttaaccaaatcttgtagtactaaacaataaacatcatgatagcatggagtgtacattctaataaaaagaaatgctgcaatcagagttgcatcaatctccgagatcatgaaaaatcggtatttcaactagggacttcttaacttccacaaaacagagcggaatacggcatttgcaacagcacaccaaccatacacttctacacagaatttgatggccaccaaagtgagagaagacgcagatgatattgcattgctaacatgtgatttattctaagcttcatcagattaagacgtgtggtcacaaggtacaaactgtatggacgtctctgaataactgaaacaccacacactacactgaacattcatccctatgctgttgctactttacacttaattagagaaaaaaaaaaggagggctactcccatcatgctaagaaaaataacatcgctagatgagaagaaaaaattacacaaaacatgagcaaaaacaacaggggaaaacataaaaaaaaaaagaatgaaaccattgttagctcccaagcccactgcaggtcagagtatcagtccatctgcagagccccaggccaagacaaacacttgtgtgtatgcttttttgctgcaaagaggttgttagttgatctgtacaggcccctcttcactctttctatgaaagtttgcatttctcgataacttctgtgacagctgagtgcgtttcctctgtgatcatattgagctgcagatggaacgactgaaagagaaacatgatggattaataaatgatggaagcagaataagctcaggcagcttcagagttaatcaaaatgaacaaaaactagcagcttagataggcatgcactcaaccagtgtgggcacacaatattctcagagtcaagtcctaaatcgcaagttaagaaagagttgtgcctggagtgctaagccaagagggtaagaggttagatacttagaaactccctttttacctctatctgttgtaagagaacatttaattacgtagccaacatgttggcttgatttggtgctgtacttcaactgggagttatcaataacttaactcggtaccagattgtgtctctcatctcaagggtagtgataaaggtattacacaaagtttcaaatgtgacagcagacaatcttacagtgggagcacactagcattttaagggttaaaagtcccagccggaatgttttctccagttgagaaataaaacatcctgttactattcaaacttgaaacaagttcaaattttccttatttatgtgaaattttgcaaacaggcttcctggatgggaagtacaattatggtgacacctcacacctcagacatg

SEQ ID NO: 32258 - DNA, 3299 bp, Oryza sativa
tcctgcagccctgattttgaagataagcaactatggcgtgtctggttcgacaaaaggttttttttcttcgagttcttgcgctttccatcattaaatgaagttccccccatgacatctgctgcataacaaagtttcaagaacgacactaattaaacttatatgaggaaccaacaagataatctgggtcaggaaacatgaaatattaaaaatatcaggtagcgttttataaatattggtgccaccgtgtcaggtcaagttcaacatctgtagtgagacttgaatggcgaccaaactatattgaaacagtgcacagaaaagccaacgagttgatcaaacaaatttggtgtttgttattaccagagcaactctgttgagagactttagacgatttcggatatgtagagctggaaacaacagaagaattctgcagtattgaaagagctgcagcaaaacaaaataggcgtcagactgcaactttaacatactggatgtttaaaacattttattgtgttagcggacatattgtattattaagaaaaatacctgataataactcaataatactgataatgacaccaacaaaagaaagcgaggagcgtttcgggtacaattttctactcatattaagcaaatgggtctgcaagaagcaaaatgagtgtaagagtttatactgcttttcaggaaaaaaagaaaaatgttaagcagaaatacaaagtcacactgtttgcacattttgcacagaacaaatgaggggagaagatggtacagaagaagaaaatgggtactaaactgaaacagaatatataaggaacattaccttgttatcatcgcttagaaatgtggcattttccaatattttcaaacatttcaagaggagagcggcactttgcaaagatgttccttcatttaggtccaaagctgaagttgaggtatcctttatgagattctgatacacaaggtttccaccagaagtatattgttaatttatttattcagtttatcagcgtaatatgattgcattattagttgggggcataaaaagtacacagataggagcaccaagcagtttatctcttaaagggatacgcaatttactccaaagtttatgcaagaacagcaagtatagctggaaaagtaacatccaaatgaataatgtccacttggtgtagatatgtcaagtattattatcgtgggggatataatcatcagaggaatcactgtaagacactaacaccacatgcagaataaaaaagtattaaaaaactattttgcaacatgaaacaacataatttgtgatgcagccaattttccatgtcctgatgaaaatagttactacctcaagcattttccatgtcccaaaatataacaacctttggctatgtatctggacaagcattgctttcatgtggcttcaagcacattaaagctaaaatggcaaaaaggaacaaaacttgcaccatcctttagagttgaacaaaggaagtgtaaaatatgcgatgttagcgagatctcacctccaatgttgaatggcaatccatcataacgtcaaaaatactatcaagaccgcccaactcccttaatgtctctttaaaatttcctccgactctggacacagtgtcagaagtctctgtaacaatcaaatatttgataagggaaaaccttcctagtatgacaatggccataggtgcttctagtgcagtcaattactccaattcagttgtgcaacacggatggaagtcatcaatcaaaggcaggtgaagcaaagggctaagcaaaccacccatgaatattgtaaacaggtgctatgtaacttatggcaactgcttatttggctcataaaaataattataatggtcataaagggaaatcatgaccaagaaatttgattaaaacttaccctccactgaaacagcagacaagcatgccttttccattgtcaacaaagcaagccactttggacacagttctggccttgttgttttcttgtcatctttgtcgagcgacttgatctcttgacagcttaagagaatctcttcaacttttgaaaggatttcctctgaaatgcagtcagaatccttatttgatccattaagcatttgaactttactgattccaagaagtttggaacctatcgatggtgctttggaatcaacaagattcactggaggatttaataatttaagaagaaaatggacacaagattctgaatccaacaaatgattttcttgaacctgaacaacaagaagggagatattggagaataagcacaagtgaagttatgccattaaagaatacgagctgctagcaatattaactgaaatttacaccataaattaaagttcaacttcaaacaaaatgatgaaataaaagcatggactttcttaaataatcttctttgtaatcacatgccaagatattcatggaaaagtggtgaatacttatataactgtactggagaaataaataactttgccatgatgtgattatttttatgggctgttatataaaagaaaacaatcgatatgcgtaaaaaatagaatgaagcatgcacagaagcacaaggatgggattgagaggtactcacatcacttgccaaaacgaatagaagagcagctgcaccaatagtgcagggaggatcatcaatgttcaaaaccaaaattgcatcaataatttgttgcaccaatctataggatataagaaaagaggacacttgtgagtaagaaaacaaaacgcaatgtataataatttcattaacggaatatgtgtttgttgaatggaacaatttcagcaattgaatacatttgaaattcaacaggaaaatggatacaaataggaagtgtgctggtgcgtaacaagttgtacatttttactctcagcaattttatttgtgcacattagcataaatgggtacgaagtaaaataaaaagttgcaagagtccataacagttcaagcaatcaacctcctcacagaaaacatgtcatttgctaacatgaacttccatcaagtgcttcttttattcacagtagattgcgatgtttatacagctcaagtggaaattccacaaaagttttgtgaacattgtagcattgtgcttttggtttataagactctgcctaaggctctggctggcactccttaatctaaagcgattttgaacttttaagaataattttaggtagaactttacctgtctacttagcaatcatgaaaagagagccaggcaccaaaagtaacaaataaaagagattaagtaccaaatagaaactctcctgaaagttcaaaattgactgatctcttg

SEQ ID NO: 32259 - DNA, 43714 bp, Oryza sativa
aaccctaaccctaccaagcaagaaaactcagaacaagaaaacaaacacaagttggtaaatcataattcagaacaagttcttgtgcctaagatgaaggcaatagctacggattgcaacaccaagcatgctgttcgaaggtcaaatgccctaaaggtggttcatttcccacagaaatgccgattacggagccataatcgtacaaaatcccactgtttccgccaagattacgcagaagaaacaagaactggctgcccaatttcataaccctaacaagattcctcaccaagattgcccgcgaagcaagagcaagaacgcgaattgttattctttacttacagcgcagacaagtaagaaaaaaaaaaggagggttctttggtgtaccgacccctgggcccggaggacgcggcggcgcggcgcggaggcgcagatcccgagcagcgcgaggaagctggcccggcgcacccgcctcggcgcggtggcgcgcagcccgtcgagcgcgaagttcgcctcgtccacgctctccatcatctcgccgtactcctccgcctccatgagcgaggtggccgccgccgccgccgccgccgccgtggcgggctccgcgtagtccccacccccacccctcccccgccgccgccggggcggcggcggcgggtcctcgtcgaagtcccacatcgacgacgactcctgcgacggcgcgggcgggtgcgacgactgcgacgacgaccccagcaggacgaggtcgtcctcctcctccccgtcgaattcgaacgcgtcttgcgacgacgagaacccaccgccgccgccgcgctcccctcctcccccgtcggagaaggagcgggatctgcggccgtaggtgcgcacgatcatctcagctgctgctgctgctgctgctccgcctcctagctgctgctgctgcggcggcggcggcggcgcgcataggagagaggagagagagatttgggagtcgtctcgtctcgtctcgcgggggtggggatgtgggtgacgtcgtcgtgggggggatgggtttggatttggatttcgaaattttttgctgctgcggctgcggctgatccggatttgggaattgggaatcgggaaaaatggaggcggaggggagaggcgtgcggatttgggggaaatcggaggaggaaaccgggaatgggacgaggaggagggggagctgaggcgctgagctcggcttggctccggatgtgctcggctcggctcgtggcgttgggccaagctagctagctagccaagaaagggaaggggatttgtaaaaagaaaaaaaaaaggaaggaaggggtgggacccacttgcataggaaggcggttaggcggtgggtgggatggggcgcttcctagccgttggattgttggtgttccatcttggcatctcatgtgggaggatgacgagccattcggtgattttcgatttagttggtgtttgtatcgatcagtgttacgtcggatgtatactaattaaaagtattaaacgtaaactaacaataaaattaattgtataaatgagagctaattcgtaagataaattttttaagcttaattaatccgtaattagtacatgtttactacagcatcacataggctaatcatggattaattatgctcaatatattcgtctcgcgaattagtccagggttatggaatgggtttcatcattaatctatgtttaatacttctaattagtgtcaaatatccgatgtgatagggattaaaatttagtccttggatccaaacaccaccttagatgaagatgaagatattttagtccacgtaaaatgaaacaagttagtaatgattaattgagttttacttttataaaccctaaaagtaaattttatttgatattttagagtaagtttatatacaaaattaaaaaacagtttgaaaaacatgctaatgtatcatgtatcttgatgagaaaagaacataacctaaatgaagatgaagatattttagtccacgtaaaataaaataagtcaataatatatatgattaattgagttttttaaaactccaaaaatagattttatttgatattttaagtattttttatatagaaaattaaaaaacagtttgaaaaacgtgtaaataaaaattaagatagaacttttatcataatggacaaaaggatgtactagtagttgttgagccacagggaattcgtgagtagtgagaaccaacccgttgttgctgggaaattcgtgggaactatagtaccccgttgattgcatcttcttcaacctctcggtcaggttagtggtgctactgttcacgccatggttgacgctggtcaaacgctcgttttcttcaccctcgtcaacgtcccgtcttccatttcatcgttttgctccacagaccacagctgcatagagagttagagacccacctagttgtatcctcctgaaaaacctctacaatttctttctttttgccttttcaggcttttgctgcacggttctcactttataaaatggaggccagtttagggcaaagaagtgccaaaacctcactttaattacaaaaccgagtagtttctttatttactgctggcaaattttttaattgaaatgctttttttttccaaatctcactcaccttcttcccaaatcaaaattatatttcacaccaaatactctatttaaaagggtgtttagattcagggatgtaaagttttggcgtgtcacatcgagtattatatagcttatcgtataggatcaataattagtatttttattagtgcccaaacaccctgtgcgacactatatataatacccgatgtgacacgcccaaacttcacatctttggatctaaagcacccctcagtgttctaaacccccaaataaaccattagaaattcagaataagtcagccccgtacaactggtcgacgagcagcggcggtcagtgtagcacacacggtggtagctgcgtccagtggactcattctatgtaggcacccgatggccagtattttggctgtacgccggaccacgaaaaactgctatcgcctgcgcccactggtttctgccgtctgctggtttcaggatgcttcaggttcaggactttgcttgattgctttctgtttccgggagctgctactactcctgtgcccaaggagaaagaagttcactgtttgtgcagggaggtggagagggataactattctaatatcttgaaagaatattagggcctatttagttccaaataaaaattttcacgttgtcacattgaatatttgggcacatacataaagtattaaacgtagaaaaaataataattacacggttcgtcaggaaactgcgagacgaatcttttaagcctaattgcgtcatgagttgacaatgtggtgctatagtaaacatttgctaatgatgtattaattaggcttaatagattcgtctcgtagttttctggcggaatctgtaatttgttttgttattagagtgcatttaatacttcaaatgtgtgtccgtatattcgatgtgagatgaaactaaatatgcccttgattccttcgttgtttacatgtcatggttcaatattacggaaatcggcatgtattggggaatgattgaattgaaatttccgggaatttcgatagagaaattgaagtttgaatagatcttagctgaatttgaacaagcttttagcaaatttatcatttaaaaaaaatctaattagctgaaagaatatccaggcggagggaaccaaccgacttgaaaattttcagtcagaaatatgggacatatatactagagatggacatatagagttggagagctcagaggcagctagagatgatctttgatagggtacaaaactacaaattactcaaaaactctacagagatcatacaacttaaaagaaaaaccatctgtagttttcgatcacccaagctcttattaccaaaagtaatcccaaaaaagaaaacacttgagttacatcttacaacaatcccatattcccatcccatgatccaccagtgaacaacacaactttcactctgcaccatcatatcgtacacatcaagctgatcattaacagctaagtaattcgtgagaaacgcgtcctacaaattctcctccatcgatctttcttggtagagaggagaagaagaagaagagcacagcaaaatcctagacgaaaatcaatagcacatcactctcactcactgatcgtgatcggccaagccgacgagcttctcgctgagctcccagaccttcttggccttctccggatcggaggcctcctcggagagctggttctcgaacgaggccgagttgttgttccagctccagtacaccccggacttggtgaggctggggtcactgacgacctgggccagccgcttgccggcctcctcctcggagacgtagcccttggtgatgtacttctggaagggcgggaagaggaggcggaacagcgggacgtgctcccggaagaggcccgtggtggcgatgcacccggggtagagcgacgcgaacgtcaccccggtctcgccgtggtaccggcggtggaactcctgcatcgtcagcatgttgcacaccttgctgtccttgtaggccttggcgccgtcgaactcgccgccgtcgatcatggcggagctcgacacgccgtcgaggcccgaggcgagcccccggaggtcccccaggttcgccttcggcggcacgttccccgccagcgtgttcgtgttccctgcattcatcgtatcgaaattagaacgatgttcttatagtaacatgttacaatagaatgttgccgatatgctttcaaatgatatgatattttttttaaaaaaaagttacaactgcacttataaagtttttttttaaaaaaaaatcagcttatcgactttgtaatacttgattcattcgtttatactatcaaataattatcatacccattttagaaagcagtataaggttgtgccctccatgcacagaaaaataatccattaattaagtattatctaagaagaagttttcacttttagaggtttgtgcttgtgtggttagctcgtggttcttgaacgcacacgctggtgcgcatcatcctcgacaacttcctattatgtttttcttgtaactttttctcattcttaatacattcagaaggtctctttcaatcttcccgatgaaaaagaaaaacttaaaaattggattaatcacaacaacttcctataattttttttataaaacatgcaatttttagcagttcagtaattgtagtaattgtgtacgtggagaactacaaaatagtagaagttggaagctttgacattagaacacaacagcctaattctggtgaggaagaaaggttgtcattaccggtgatggagccgacgatgatgaggcgcttggaggggtagtcggaggaggtgaggtcggcgaggagctcgcgggcgaggaggaagtgcccgaggtggttgacgccgacgctcatctcgaagccgtcggcggtgaagctcggctgcttggcggtgggctggtacacggcggcgttgcacaccaccacgtcgacgggcatctccagccgccggacgttggcgacgaactgcctgacgctgtcgagcgacgccaggtcgaggtggacgatggtgtagctgcccttctccatgccggcggccttggcggcgcgcgacgccttgaggaagtcgcggcaccccatgacgacgtgccacctgcccgtctccgccagcgccttcgccgtcgcgaggccaagcccggacgacgcgccggtgatgaccgccgtgcccttgcgcagcgtctgcttgcccgacggcgacgccggcgtcaccgtcggggacgacaccgccgccgacgcctgcgcgcggatggccaccgacgacgtgctcaccctctgcaggagagtttcagttttcgtggcaacaatgtcaagatatatgaacaaactaggcctttgtttttatataaaaaattttttggccaaaaacatcacatcaaatgtttgaacatgcaagaatattaaatgtggggaaaaaaataattgcacagtttatatgtaaattgtgagacaaatcttttgaatctaattatgctatgatttaataatgtgatgctacaataaatatttactaatgatggattaattaggcttaataaattcgtctagtttacatgcggaaccaagtttatgaaattacagggagcaaacttgacagtcttgcagtaaaatcaagtttatgaaatcgatccacatcaatatgaacttgaaatgccaaagctaattaagtagtagtacaattttttgggggtgtggcgatgtcagagttttgagcaactatttctaagtacagcaagtaaaccttgcaatcttgcactaaaagttacccaaattcgcatcactttgcaatgctatatatactcaaactaacactgacataaaatccagatcaataggaagtcaaaatgccaggctaatcaagtataatacaatttttgtggcgctgtcagagttgtgagcaactaccatttctaagtacatcaagcaaaccttgcaatcttgcactaaaagttcgtcaaaattcacatcagtttgcaatgctagatacactcactcagcaagtccaaatgtcaacctgaagttgcaaattaaccagacacaaaggctacttggttgcactaacaatggcggcacacactgatgttactagcaattagcaaagctgcacacctgtgaaaacaaaacaagcccctgacattgtcatagctaaaacgatgagagaatcatcatgatataatctcattagccagttgattaatgccaaacacaggcataaccatttgcaacgccacgggtgctcctaatctgacagagcaaaccacagagccacagtggtaagctcctccaacataactgaaagtctgaaactaataatcgtgaagtctagaaacgaaaacctggcaattcactgaacgaactagccaattacttgtactactcgccagttagtagtaagtactaatattagcactaacaaacagagcatcagcacagagcaagcagagtgctgtaacaacattattacagttactaccttggtgcgaaggccgagagcactggtctccagcttgagcccgtcgccgagacgaacgcccaagaacgccgagtccttcaccgctccctacacccccaaaaaccaacccaaaaacaaaaaaaaaaccatttaaccaatcgccgccatgaacacgaagcaaaactctgaactagtctgaactctgaaatgcctccatggctgaatccccgagcttagagctctcacctccttgcgggcggagagcgcggaggggaggaaggaggtggtggtggccgcctggagagccatcggagatttttctctcttttttttcctctgcagcgaagtgagtgaggctttggggggttggggttctaagctagaagaagaagagagcgaaggagattaggcgggcgttttataccaggtggcgataaggcgatagggggaggagtgccacgtggcgccgagctggcgatggcccggccaatggggtttcgcgggctggatttcccctcaacgggatatttattttttattattattgtttctcgtcgtttttatctcctctatgtgcgctgatttttttttttgggtgtatgttggtcgctgtttcggttggggtcgatcgagatggttcgagtgagttgtgcgtggatggatgggccggttttgtttggtctcgccgtggatcgcggttgaaggaccagtatctgggaacggatgagatatgggcctgttcagctgcttgatacagcccctgcaaggaataagttcacttcatgacccttaaaagtgatcgaaatctaattcgtatccctaaaccataaaaaccataaaaccggatatctcgactcccaaactcttaaaaccggtgcaatttgactccctggacgattttgaagagtggtttcgctgacgtgacgcctacgtgacagtattgactcggtcttctttccacgtggcgttaacgtggcattagaaataaaaaaagggactgcctatacatcatgcgatagattttctagccccctatcatgcaaatttttcaagccataggataaatttaatctcatctatttaaatttagggagtaactattaaaaaaaaagttggcatgtatttacattgtaagttcctaaaattacatatgtaattacatatgtaattttagtgtatttatgatgtaagtcataaaattacatatgtaattttagtatatttacgatgtaagtcacaaaattacatatgtaattataatgtaagcacgatgtaattagtaagcgtggatcataagcaaagtagcagtagaaaacactgctcaaatgcaaggaaaaaaagcaggcgtgtgtttcgaaattgaacggtaaatatgtgagacccacagaacgcaacaacaaagtccacataatgcaacaacaaaagctcggtccatctcaaagtccacagccgtgtatgactttgctcaatccaaatgcagcactaattgtaaacagagatgaatggtcaaaaaagtgaaagatttagcaccctatttttttttttgtcaacagagcactagcgattccgataaaaaaatgtgcgagagcactagcgattccgataaaaaaatgtgcgtgacccattactcattcacacaaaaagaaatgtggacccattgacatgtgaggcccacatgtcagtcctctctttcaccttccttctttctcctccctctctcccttccctctctttctctcccctttcttcttccacttccttcccggcaccggcggccggtgccttctccaaccccatcccggcgagagcgcgggcacaagtcgagcagcaggtcgtcacccacggcgctgtcggcgacgccctccacgtcggcgcggcgcgcggccacggcgggctcgacttcttcgtgtcgcgctcgcacgccgcccgcctcatcgacctcgtcacctcgctgtcgtctgcccgtgtcgtcacgtccaagcagctcgtctcgcacgtgaagctctgcctggtgtgccgcgacgacctcatcttcctcccatctgcacattgctgcaatcaagcaaagaaagtagcaggacaagcagtagcagagtaaaagagaggacgaggcttcattgaagtcacataggctagattctaagggcattagcaattcgtccgccctcaacaaggagccaaagcctccacgtaggcaaaaagcaaaacgaggctttcatctccacaatgcgcgtgtagctttggataggccgcatcggcatcgctccatctccaatctacgcgccgccgctagcttcttccccagcttcccgcttcttccgggctccggccggcgcccctcatctcctcccccgaccagcgcccctcccgtggccggcgagcggacaagctctgtggcgtggaccgcggagactacgcaagagaggcggcggaagcctggcggagaggcgacggcgcccgggcggagaggcgactgaaccggcgacagcgccggccggagcggaggcccagcccggggctcgctagatctagcctcgggccctctccggcgcggatgcggcttctctggcgacctcagggtggatatggctcggacgcccctcctatcccgtctccggcgagcttctccggcgcagatgtggctccctatcccccctctctctctccggttttctccaaatgggcggatgcgattttcctggcaaaaagttgatttctctgacgaggtcctcggagccaatgttggtcacacgaacctggagaaggagcggtccccactcccctctctcctccatgcatacactttatctaggtagacaaacattgccacacgccacgtgtgtgcactgtgaatggcctaaaaagtccccggccattgtgcttcttcaaagttgaacctcgactaggagtaatgttcaacttctgagcgtaagatataagatattaggcctgagtaattagttgggccagatgttaggtctagcccatttagcgcctagggtttagggagcaatatatttatgggtgttttcgggtgcctctttttctacccctcgttttccgcgcgcacatttttcaaattattttttgcaaataatttctatatgaaagttgcttaaaaaaattaaattaatccatttttttaaaaaaaatagttaatacttaattaattatatactaatggagcgctactttttccctgtgcggagggttcagtttgggaagtagggacagcgaacacatatcttctcctcttcctcgcaccggccgccggcgcaacacatgagttagggtttcgacatttttgagagggagggttcagggcgacggcgcgggcgcgatgccgttagagatcgaggggcaggcgatggcgaggtcttccgtctggaagaagaagaagcgcgccaagccgatgcctgacaagggttggaagaggaaggggaagggatcgaagaagaagaaggcgaagctgcacgacgtcgacgacgaggtcgtggtggcggcggacgccgccggatccaagtacgaggaggctgccacccatccgcctgggacggagacgacggtgacgatggagctggatctcatcgaccactatctggtgggcgagctcgtcgcctacatgacgggcgcgttgctatgcccgatccttcacctcaagtccatgaactgccccttcgtcgaccccaggcacctcgctcctgtcgagaaggatgtagaattctccgccaacatcctcaagcaacaccgcctcaccaacggccccgtcgagctccagatggaccccatcaccacctccgatgaccatgaccaccacgacgacgacgagctcatcgatatgaggggctggataaactggaggacaccggaggagatgaggaagaggatggtcgaggaggaacaggaggaactggaggaccaagcttaaggaggaagcttaatttatttaacaatctgcttgctgtggctttgtaatttgcaagtttctgctcatcattatactagttatatattatactagttctgctcatcattatgatgtaatcttgcaccttatatcttgctaccggtgattcagatatatcaagttaaaaatggatgtagccactctctgctacttaaatttgttgtcttgttgctactacctccgtttcataatgtaagactttctagtattttccccattcatatagatgctaatgaatacgagaaatactagaaagtcttacattataaaatggtggaagtatctattaatttatcgtcttgcattaacaatttttttgggtgcaaattgagccgttttttttgacaaattgacccttttcaaaaacttatttcgaaactaacccctgccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccttctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcgctagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatgttaggatagggaagaaagaacttatagaccttaatgaaagtccactcatagaatcacccattagctgtcacgaactgtcagagaggtgtagtaggaaggaagaattgattgaggaagacgtggaggggggcgagggagtaaatgatatggcggatgtggaggtcagggaagagaatgacccggtaagggaggaagtcatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggattgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactatggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcagcgattgtcgaggcagttgagcaaatatggcactatcggcctacgtatggcaaagcatggcgtgctaagcaagttgctatgaaggtcatttggggatattgggacgaggcgtatgttcgcttgcctacactgatgcgtgccatcaaagcaaagaaccctaccatgcatttccgtgttgaggctcatcccgagaagtccaggatggtggatggagtacagaagcgagtatttggacgtgcatattggatatttggccagtccatagaagcattcaagcacttgaggccggtgctagcaattgatggcactttcttaaccggtaaataccaaggtacattgctcatggcaataggggtcgacgccgggttacatcttgttcccttggcgtttgctctggtagagaaggagaatacatccaactgggagtggttcatcaacatgttgagaaacaagttgatcggtcctaatagagaagtgtgtataatttctgatagacaccctggcattttgaactccatcatccacatcatgcctcatcacctaaccattcaccacaggtggtgcatgaggcacttctgtgctaacttctacacagctggagctacgactgatcagatgaaagatcttgagcgcatatgtcaaataaatgagaaagcattgttcctagatgagataaaacgcctcatgggtgtggtcggagagaggccaaagaagtggctagaagaccatatgccacttaaggtcaaatgggcaagagcatttgataccaacgggcgctgagtgtcccacggtcagcgccattatggctggcgctgaggtcccagcccgcaagccatccagaaggcttgctgggctgggccgtttcggctgggctgggccatggccgaaacggccaagtcccacctcagcgccaggtgggctggcgctgagtgtcccacggtcagcgccattatggctggcgctgaggtcccagcccgcaagccatccagaaggcttgctggtctgggccttggggttgcggccaagtcccacctcagcgccagtccggttggcgctgaggtagctgccacgtcagctggggatcggcccggccgccacggtggcacaatatcagcgccagtctcgttggcgctgacacggccaacgtcagcgccaatgtgtttggcgctgaggcgacggcctatttttggttgaagtttttggcaggggttagtttcgaaataagttttctaaaagggtcaatttgtcaaaaaaaaacggcaaattgagtgcttgctggggacttgagaatgactggtgtttatatatatgtatatatatttaacccagcatgctgctatggccaactggaatcggtatagctcattactcaagacttgtatttgattaatttactcttcttccatactgtaccttgtgctgcttgcagatttatattgaggttcagtcagtggtcttaaagtgacgccaagtcatttaaggactcgtataatctttactgtcttattgccacgcttttaatttccctcgtgtgtcatactcaacattatgtacatggttcatgccataacatatttcatctttttgttttggcatggtcctttaagagcacaaggcttcagaagcacaaggaagggcaacaccgaaggcaaggagagcttgatcacaccccgcaccacctattcatgtcacaggcagcagatttcaggttggctagcctttttccctttgtttttgcatgatgatattttagcaaatcaaagtgcccgattaatattccgattctaccacatcgcacacatcggaaacagaaagaaagaagtttctcattccgtgcttcatttttacttcctccgtttcgttgtattgtagggcgttttgatttttttttcctgtagtcaaacttttttaaatttaatcaagtttatagaaaaatttagcaacatctaaaacacgaaattagttttattaaacttaacattgaatatattttgataatatgtttgttttgtattgaaaatgctactatgtttctctataaactcggtcaaacttataaaaaattagtatgaaacagatggagtattatgtttccttctgtcttggattttcatgttatgaattgaagttggttggtcagtgtcaggaagagaaacttgaggtttttgttgaaatgtaaaggggtttattgatgttttcttttaggtaccccttaattaaattaacttttactcttattagctgacatggtgttataagtacagggtggcacatgctgaggaaccaaagatggcaactggtaaagaaatgtcaggatctatgaggtcagtatggtctttttgcctctatatctttctatttagggtacccggtaccaactgatgtcaggctatatctggtaaatgaaagtgggatctgttttgcattgtcatgggaagaaagtagtgaggttctaagattggtgcatatccttattgtcagtggcggatcttgatactttttaaagcccgggcaaatacatatgtgaagaattatatacactgttaatcactgaaaatttaaggtattgtaatggtgtgatccgccggtgagtccaggcagctgcccggagttgccggaccttggatccgccactgcttgttgtccagatatattgtcataattgctaggtgaagctgaaaaaaccaaaatgttttcttttatggatctgtggtagtctgccgtcatgtggtttatcttatctacacggtttcatataactggtttctgctctgctatgtataattcttctatttaaatgcatcatactgatagtgtttagtggtatgacacgtgagaataatcagatttgtgagttaatatagaactgtgggctgcaaaattagtcgttgagcatttagatgtttctacgcctcgcaatggcacgtgccctatcaggtaacaataagcatgttgtagcagacaaaaggatttatattttcacttgttgacaaattagaatgaactatagaaaaaaatagtcgttggttacatggagcattgtactcgatgcagaacaaccttaatgagagcgaatgccattggggggcagaagaacatgttggtggtgttcttttcttctaaaaatgaagatgaagatgatgattaagttttttacgcaaaatgaggtagtattaacgtatgattgattgagttttaattattacaaacttgaaaaatagatttgtatgatattttagagcaactctcttgtagaaagttttcgcatgaaacgcactgtttagcagtttaaaaaatatgtcacgaaaatcttaatcttcatccaactttattggaggaaagaacatgaccaagttgtgtgattgggggcattgagagcgaatgcacgagatgattgcgctgttatttcagtatgacatcccgtgcagaccagaacgtcctacgaatgtgctgcctatggtggacctggtggatggaatggtaagaatttgatatgaatgtgttctgctcaaccatctgagagtttcaaactgatcaacagatgctgttgaacatcaattgctttcttcagagctcacacaatttctgtcaattgtgcagcactcgtcgttcgcagctcagggtcagcattggtggtgcctcatgactgcaagcgtcttgacaccaaactaatcatagagagcagtacagattagtacgtgtctgcgaatacagcctaaatttatcaggattcaggaagaaaatgtttggaatttgcaaaggatttgtagagctggaaatgggatgccatttggttatatgcagaaataagctgcaagcctataagcgtatatgtaaggtgccatcaaatgcggtgtatatcagaagtttgtaacgaaagttgcagcaataaaacggtactcctgccactatcttatatatgtgttagtatgattattagtcaagagttatcgagtttgattttcctcaaaagagagagggtgccatgtaattcgggacggagggagtatggctttgtttagattctaactttttattcttcaaactttcaactttttcgtcacatcgaacttttctacatacgcaaactttcattttttctatcacatcgttccaatttctttaaactttcaattttagcgtggaactaaacacaccctatgtcacattgttgctagctctgctctagctgacttccttcgcttgaagcggaaagcgcaccaatgagacattgtcactagctctgctctagctaacttccttcgcttgaagcggaaagcgcaccgatgcactcatcgatgatcgctcgcatcctggagggctcgaacttcttcccggtggtagagcacggctcaaacatacacatcggcgaacaggtccagcgcgaagcacgtgctcaagttctgtgagttcgatggcaaagaggacacctcacgtagagaaccctgatggggccaatgcgacatagatggtgttgtccgaaacgatggcggcctgccaccagtcgcctttgcccctccctcaccagcgatcgggaacggatgagagagagggaagatgggagtggaataggagatgggaagaggggaggctagaggaataagaaatagacctgacacgtggggcccactcaccacatcggctaaaatcaggctctatactgcttggaatatcgggtacaccggttttgcaagtggagggcctcgttatatgtacaattattacggtttgaggacgaaattagttactccctccgtcccataatataaaggattttgactttttacttgcactgtttgaccactcatcttattcagaaaatttgtacaaatataaaaaagaaatattgtgcttaaagtactttggataataaagtgagtcacaaataaaagaaataataattccaattttttttaataagacaaatggtgagttaaaattgcttatattatgagacagggagtatttcaacgtcaagacgagagatctaaagtgaacttatccctatatgtaattagttggacctgtgtggtaaaggtccagcccatttagcgcctagggttaccctctcctctctacctcgcagtggccgccgccgcaacgcatactcccttgtcctaaaaaaaaaaaagacaaacactggatttccgtgtcaaacgtttgactgtccgtcttatatgatttttttttataattagtattttcattgtattagatgataaaacatgattaatactttatgcatgacttgtcttttaattttttttaaataagacggacggtcaaacgttggacatagaaaccagggtttgtctttttttttttgatggagggagtacgtgagtgaagggtttcgatagggagagattagggcgacggcgggcggggcgcgatggagagggatgagatcgagggaatcggcaagctcaactcccctgagaagaagaaggagaaggagaagaggaggcgcaagcacaagcccgacgaggcgaaggaggagatggtggtggacgccatacccaaggaggaggagaatctcaagtcccccgaaaagggatcaccgaagaagaaggagaagaggaggcacaagcacaagcacaagcccaagcccgacgggacacaagccgtactcaaggaggaggaggagagcaacagcaagtccaaggccccggcggagggcgagaagaagaggaagaagaagaagctggtgacggtgaagctgagcgacgagctgatgggatacctgcggaccaaggaggtgatggcctacctcgcgcgcgagacgcctcgcccgctcccgatcgatccgggcgtcgcgcagcacatgttcgtcgaccaagaactcaggcaggaaatcgccgcccaggttcacgagaacagggaattcgacgccttcgtcctctaccagtaccgcaccaagggctacgccgagatccagcaggaggtcaccgacgacgacgacgacgacgacgaggtgtagctagaatcttgcagggaatcaataatggttggtggtaaggagcaatgatctgtgatccagctaaatatactagagtgcttctgctcattaatcattattaggatattactatgtctaatggtgttattattattgcccgtatctttgctacttgtaactaaacgtgtgggaatcacaagtaactgctttcgtagttaaaccgagtgaattgctaacgtattggaatgaatgggattgcaactgtgatttgattctgattggcatagtacttgtcatagtagttgtgatcctaaatgtgaatgatcttggctagctaacccgaacgcttcatgttactctctgtttgtgctaaaagcgattcggatttctactatttatgacttgttaccttcctgatctcgttaattctctttttgtgtgatcctattcgaattatgtttgaaaaacatttcaattatatcgcctcatgtggccgtatctcattcagagcagcttcttctataatgctgtttttctctgcgcttttgccattcatctattcattttgattaatcttcaaatacctcagaagtgtgaatcttctgcggtattgttcttttcttcatgtgccaacgcagtgtggtttggtgctttttttcatattgtagtagatatcactctcccttggttatacaatcaaggactttttagtggaggaaagagtaaagattccattcttttgtacatttgtttatagaagcaatacgtgtgctgcaaaactttgtgagccttatgcatcgtactgctggctaaatgttttcatgtctaatgaatagtacactagaatgagaaatgccatgaagacctacagtaatattatgttgtcactctgtaaatgtttggcttgctgtaaaatcattggctgggtcgaaggaacaacgaagcattgttgattccctagggccccatgccttttctgtacaggggataagaaaatcttgctacatggttaacaagccggagaacaactgatgacatcactgacaactggggcaggttctgctcatcttctctgtagtatcatttacataatacttgagtttttcagtactccctcgtttcacaatgtaagtcattctaacatttctcatatttatattgatattaataaatctaaacatatatatctatctagattcactaacactaatataaatgtggaaaatgttagaatgacttatattgtgaaaaggaggtagtactgatcatgattgcgctgttatttcagtatgacatcttgtgcagacgaaaacgacaaatgggctgcctgcctatgctggacctggtggatggaacggtaagaatttgagatgaatgtgttctgctcaaccatttgagagcttcgaaccgatcaacagatgctgttgaacatcaattgcagatcctggcatgcttgaagtgggcgatggggagatgtcttaatcggagtaccgctcacagttcagtatctgtgggcacaatcataggtaccatagcatgttttgtgtactaacagttttgctgcaatgttgaatattttcttttgttgcatttcctcacagcaagctttgcttcaactgttcaggctcctcttttgattggatgtgatgtgcgctcaatgtggccccgtttagtttcccaaaaacatcacatcgaatctttggacatatgcatgaagcattaaatatagataaatgaaaaaactaattgcacagttagagagaaaatcgcgagacgaatcttttcagcctaattagtctatgattagccataagtgctacagtaatccacatgtgctaatgacggattaattaggctcaaaagattcgtctcgcggtttccaggcgagttatgaaattatttttttcattcgtgtccgaaaaacccttccgacattcggtcaaacatcctatgtgacacaaaaaaattttctttttggaaactaaacaggcccgagccagcagatgaaagacatactcagcaactgggaggtcatcgttgtgaaccaaggcaagccttctctttcacatgcttagatctagccatattctttgatatttcaccatactcatataacaactttgtgcagacagactaggtgtccaaggaaagaaaatgcaagctgacaatggattggaggtaatccctgttcatctgcatcagtggttttcaagtttcagccttgtctttgttccatgctctgaagctggcaatactgtgttaatttgtcgataggtttgggccaggtcactcagcaacaacaggaaggatgtggtactctggaacaggccatcactgcgcattggtcgagcattggactcactgggtcagtggctgtcactgctcgtgatctatgggcggtaaacttgctttcttcagagctcaaagtacaacatcactcttcagaattcagagttcataacatttctctcttgcgatttgcaaggattggtagagatggaaatggatgccatttggttatatatatgcagaaataagctgtaagcctgtgcatgtaaggtgccgtcaaatgcggtgtattgctgaagtttgttgtgaaagttgcagcaacaaagcggcattcctgccactatcttataaagaaatatactcgcctgaagacaaatctgtggcaaaagccttcacagtaaagagttgagacattgcaagacatcacaactagacagaatgcaaaacacattgtggatcaaaacaatatcagctacaactaaggattgggtttgcaccagccaaatcacctgcatctgttgcttcaacaaaacaattaatatccacgaggctgccgtctccgcctccccgcccaccggcgtcggaaggatccagtccgttggtcagtacggccgtgattcaaggggcccatatctgtcgggccggaacgggactctgacttagatgtgcccatgttatttggtctggaagagattttgatttggaataaatccacttcgactccattagctagtgagcgaatctgattggaaaaagtatacccaaggtccctcaacttgtcatcgaattgcaaaatcgtcctccaaccgtaaaaccggatacaacttataaaaccggtgcaaattagactcctaggcggttttgactccggttttatccaacgtggcagctgactcagcatgggacccacgtgggtcccatatgccagccccttcttcccctccctctcttcctctctccttcttcccctccccatgcagggcagccggccggtgggggagcgcgggagaccggcaacgggcgatgggcgacgaggcggcagcagcgccgcacggcctcctgcgcccgccctcctagccaggggagccgggggaggagctgggtgcggccgtcgggggcggagcggggctcggctggcggggcggagctgggcgcgggcggcagccggtaggggaggagctgggcggctgcggggggggagggcgggcgcccgacggcctcgatgacgtcctctggccggcgacatgcccatcggcgccaccctcacgaagatggtggccttcgtcgacgacgacttcgaagtctacaccgtgcccaggcccacttcgacctctcgctgcaagatgccccgaatgaaactcagcagctagcctataaatagtcctgacaaattatgggccaacacttcttgacaaaaaggccattaaaaccatcaggactaggaggcctggcaatggacaattttttcacataaaaagtgcaccgaaggtccctcaacttgtcatcgagttacaaaatcgtcccccaaccacaaaaccagatatatgacatctctcaagttacaaaaccgttcaatttaggtccttcggtgattttgatcccggtattgtccgacgtggcagctgagtccgcatgggacccgcgtgttagattgaccacgtcaccacttcttaccctccccatcaactcacttcctctctccttccctctccatgggcggtggccggcgaagagcagccagggcggcgcgacaggacggttcggcgggcgcggtcaccggtgcagaggagcacgccacggtcgggcgtcgccatggcctctcttgtccccgtcaaagtcaccccgctcgacgaggtcggcggcggcgagcatggtgtcgcgtcgcggcgtgccccgttgaagtcaccccggtcgacgaggtcggcgcacgcgagcggggaggagcgtcggtggtgggaccacaggggtagagcgaagggggagctggaggggaacggtggtggcgaggtggaggaggaggatgccgctccgacgaaactcccattcagggcgagggaggagcggaagacggagacggcgacagcgggagggaagtggggatggaggcggcgaggagggagttggccggccgacgcgttgtcgccgccgccgccgccgttgtccttccggccgttgctcatccgcgaggccgtccccaacaagccgccgctccggccgtcctcccccgttccagcgccatggcagccagagttcttcggcgagggtatcaccgtcaacggcaaggcctggccgttcctcatcgtctaccgccgccgctaccgcctccgcatcctaaacgccatcaacgcccgctacttcaacgtctccctctctaacagcttccccatccacgtcttcggctccgacgcgtcgtacctctcggccctggacaccgtcaccaacctcctctccctggccgagatctttgacgtcatcatcgacttctcctagtcgccgacggccgagatcgagttgctcaactcggcgccctacccgttccctaccaacgccgcccccggctcgctcaatggcagggtgatgaagttcgtgaatccgcccgcacgcggctcctcccaccgccgtccgccgcacgcgcatgcttccacctttgcgcccatccccgcggcgccggcctgcgcccggcccgccgccgcagcgtcgccacgccaccccgccgcctgtttcctacctcgccctgccggccggcccgcacgaggtgagcggggaggccggcgaactcgcgcgcgccgctgtgggtggcagccctagggccgtccccgtgtgagagcaaagagagagcgagaggaaggagagaaacgaaagagaagaggggaaaggtgagtaggtgttgacgtgtggggcccacgtgggtcccacgctgagtcagctgccacgtcggacaaaattggagtcaaaaccgccgagggatctagtttgtactggttttgtaagttaagggatgcgttgtatccggttttgtggttgagggacgattttgtaactcgatgagaagttgagggaccttcggtgtactttttccaatttttcacaatattatcctagcgtgggccgtgggcgtgtggcccatcactgggccttttccaaaccgacttttggcagctaaaacctgtcggtgatcgatccgagccgcgtcgtgtcgccttgcctcgcctcgcctcgcctggacttcgacttcgccaccgtcgagggcaccggagatggccaaccaccgccgccaatgggcgtcgtggcagacgttccaccccgtccacccgatggaggatctcatgcccggcggcgtccgcctccccgaccccgacgagcagccaccggaccccatctacgccttcctcgaggtgttcgaggagctctacggcgaccagttccctccccacgtacgccgtccgccgatcaaaactcgatcgatcgattgattttggcctttgatttgctcatctgcttcaattccacaccctgcaggttctcctctacgactcgggggatcccaacggcggcgacgacatggaggagtctgatgacgacgtcgacggcggcggcgagagtctctccgccatcgtctatggcggggggagactgcacccgtcccggcgcccgtccgtgccgccgccggaggagaggccgagggggtggatgccgtgcccggttcttcctcgggcgggaggcggccatggcgatgccgacgccgcggccgccgaacaaggggtggagggagaagggccggccggacgcgtggcagcggttctacctcgaccgcggcgccggcaggcacgcggcgtcggaggcggaggccaaccgggagctctggatcgcgttcctgctcgaccgcggcgccgcgaagagcacctcgtggtggaggtcgttcgagcggcggttcgaacggtgcgccgccgccgatccctactacgccgccggcgacacgccctgcgccatggtgacctctttcacgttctgcttccagtaataggccttggtaccctatgtacgtctttcaatgggagagtgattaatttcagctatagaatcataagcagcattggcacaatagaactcgtagcgttttgtaagtagcatactttgcaaactttgcgtttgtttagttcgcgaaaagaaaatttttgggtgtcacatcggatatttgaccggattcgggggtttttgaacacgaataaaaaaactaattttataactcgtatggaaaaccgcgagacgaatttattaagcataattattccgtcattagcatatgtggattactgtagcctttttctagaaaatgcatacattgcgacatggtgtcctgaactcctaatacaatttatttctgttttcgtgggccaatcagtagtaaactagtaatctattttggaatttgaagatgcaattgatagtgtagtggtaagggtatgtgttgaaaccacgctcataattctttctcaaatgaatgtttggaggaacttctttgtctccaaatattaatcctgttcttttttctattattaaggaattccgaattttctgccaatctcatgtctcttttctgctgacattgtctggtgtcataaaaaagtatgtgttcaactgttcatggcttcaaatgctttccaaaccttttcttcagagtatgtatgtgatcttttgattggctaacatatgactggtaattttggagcacggcaaatgtaagagagcaagatcggggtacttgagcattggtatctcctcgtagtgcaagagtgttgactgcacgtcaattgacgataattaactttgcagatgttgcctggtgtcagcctgtcaggtgactgcccctctttcttttctttctttcttttttttttgtgatggaagtttctactctagttttgctccatggagtatgctttaatcttaaagcagtttgtctacaaattccagtctccaaattaaatgtttagagtaataatttgggggaaataacctccatttagcaaaagggaaaaattataaagtccatggtcctaacttgtccttgtggaatgctttgatgcatgccagtgtagacattgttttgcatacggccgagtgaaccaaattaattgaacagcttatataactatatgtctgttttgttatttctatatcctatctctgttttttttaatagatggcggcgttaaattttaaagtaaaatgctatacgtactaactttttattattaaaatattactaacattgatatgctataagtacatttagatattttttataacttccatctacctaaatcaaacagttgagatggttgttagtaaaaatttagtaagaaaaaattaatacgtgtatcagtgccgaccattcgtagattttcaaaaggttagtgtaaatatgataaaatacaagtcgattatacttaaattttctttaataataaaacatgccgcaagaaaataaatgatatttatattttttttataatataataaatggtcagatattatgtaaaatctattaaaaatatggaaagagtacattattaaaagcgtgttgatgaaaaaaatacatactgacttgggagatctgcttaactccaatgcagatcctaaatcttgctttcgaggacttgggatatctgcttaactccaatgcagatcctaaatcttgctttcgagcttaaatgcatgccagttgatttgatcctgcaatcaacaagaaaggaaaacaagaaaataaggttaaatccgtaaacgatagccgatcggctaagggccgatgacatatcgttaatcactaagctgatgtattagcattagatcggtaatgaagaataaagccgatcaatgtggctcctaattaataagatacaactgcccctctgtgggctcatcccaattgcggcaatacttgtgcagcacgtcaatcgatcccgaagatcaatattaacttctaatttggtacatgatctaccaatttagtcgtcaacaattatacaccaaagataccagcaataaaacaatcgacacttgaatctaacgattaaattagcggatttacaagtttttttttgagttgtgatacaaattcatttgcacttaataaaggccagcttctgccgtagtggagcggaggcctgtcgccgggaggcttgggccggatcgtcatcctttttagggttccaccatatatatacctcttgtaagccgttgtgcggcgttgtaaccccaccctagatatagtgaagatattttgctggctggcgcccgtggttttttctctcctactttgggagggttttccacgttaaaatctcgtgtcttctgtgattgatctattattctttatcatttgtttgcctatcgtttcctaacactttttgcccccaaaacttttatatttgtgaccatcggatcgcctcgagatttgagcatgaagagaaaaaaatgctagaaagaaatttttatacatgtcatgcataagatcctagtgttatctaatcaaaccattgttgaatgcaagttttaataagttatatataaaagttatagtgcagttacagtgcaattacacttcagttatggtatagttatatctgaatgtttttgacccaaaaaatttatttgtgacagttttttagatactctcaaaaattagatttgtctcccaggaattgagactgcaggtcaagcatatgatctcctggcccatttccgaaccattttgcgaagctggtccgaaattaagctctgggtggctacgtttctcttctcttttccatgccagaatcgatcgatcaaaaggcatatgcatctcctgtttctgcatgcgccgatcaagacggacgcgtggtgacttcactgtaggtatatagtggaagacttgagacggcgacggcggcggcgggaggcgacaaaaacgcttgttgttttcagtcctactcactcggcgggcgatcactcgtggagcagagcacggaactgatcgagagagagaaaaaaggggccgggagagtgccttttgcgcgccgaccatgtcctcctcgccggttcctgtcgccgtcgccggccaccacgcgactaaactaccaatatacaccacgcccatatacctacgtggtgggggccgaccaatcgggctagctttgctagtcttccagcgcaagaaaactctgcacttgtatctgtccgtagtggcggagccagtactgccgcaacgcataagaagatcgcacgtcaatatattagaagcggaggtgaatagtaacgttttccgatgaccgactaatttttatacgtgtggacggttaacgataatggagacagacatatcgttttaggctgcccgacatgccggggagctataactccgccgctgtgtgtctccggctctgatcacggtagcggcggcgaccgttgttcaggaaccgctggaattgataattggcggttagcgggtggtcaacagtggttgctcaactattgaagcacaggaacatttttttttactttttaattatataagagaaaattaatgtagtatttcttttgtcccagaattataacaaattttagttataaaccttaacgagtatgtctaaatttgtactgcaactgctgcagccagccgctggacttttttttttcttgattcactgttcgtataggctacagtagctagcgctgcagcccttgcctgcagcggaacacacccattgtaacactttttggatttacatcgattcatccattgatcatatatatatatatatatatatatatatgtatgtatgtatgtatgttttgtatatgtgtctagatctattaacatctatatgaatttgggtaatgctataaagttttatgttgttgaaacggataaagtacttaaatattgttatagttgtaaaaggagatagtagtatattttctcgagagtgctttcttttttttttaagaaatcaagagtgcaattttgttcaagaaaatgcaactactactgctatatcactggctaaccaacttttgacccgtctacggcgatcaagagagtgcagcactcagtggtatatatcttaattgcgctatctcctcacagattttaagttatcttatcagtccgtgttgcaaattgttcaaataataaatcacactttttttcttctttccaaagtgcaaatcatgtcgattatacacatgtcatgcatgcagaagtcttctcttcctcatatgtctgaattttgattctcgatagttcggtccgatgatatcgttaacacaaattggttttatatgtaagtttcacgttttgaacgaaaaccaaccagaaaccacgaaatgtataggtgttttgacacgggatgagagcagattttcgagtgaaatttgaatggtttctgataattcaaatattgtgaaaacttgaccaaaatcttatcaaaatttgattaaaatggcgaaaaccgtcatattaccatcagaagtccgtatctgttgctcaaccgaaaaggtgaaccaatccttgtgtgctcgctctacagctcagggtttttgcaccgtccatcactggtaccaaacttgggaacttgtcttgatgctattctacacctgtttgattaatgcaatacagtactagtagtagctacccgccgatcaccaggcatgtgtaacttttttttaaacgagaagatatagaagtgtcaatttaaaagaatataggaagaaaagggcattattcatatatatatatatatatataagagataaaaactaagaaaatagttagattgtacaaggaactagctagcagcctaaagtaacatctctgttagatacttggcttttgccgccgtttaagttcttgcctgttcctctatcctcgctatactacctgtcgtagggacggatctaacatgagagcggcgggctctctgagcccccactactggcgtgatgactatgaaagcccccacgaagaccctactaaaattttttaccatatatagatgggagggggattgtaactctatctagtttgctcagaccccactgctattttttttgatctgccactgatctatcgtggttagctcttacttctctttggtctataaaagctaacctaggtgggaatggaatataacctcctctgttcagatttgggttttttttttacggagaaaatatgtcggaaaaccattcattactagaaaaaacatttttctaggcgggcaaaagtagtttttccaggcgggggaaaggagcgcatgtacgtaaaggcttgcgaacgcccaacggcacctacaaaaatcattttcgtaggcggttgatccacccgcttgtaaaaatatttttagcgaaaataaaaaaaatgccactggtggcctcccccttcggcttctccccattcgggagacggctcctcctccatccgccggcgctgcccgaggggcggccgccgttggttcctcctccgtcaccgccgcatccaccacccccgccctcccccgtcggcccctcccttcggccgccaactctcctccccctcccccagtcagatatgggaggaggaaggagggagcgttgcctccgtcgctgatggccggctcccctcatctggccggatttgggagggagggacggaggaaggggagcggtgccgccgactctcctcctagttgtcgtgcgccgccgtgcctctggtggccgccaccttcgccctcatgccgcctccactgctactgccgccgccggccggttcccctcttccggctggatctagaagggagggaggagagcgccgctggccaccgccctccccccttcctcctcgggccagatctgggagggagggaggggagccatagccaggagcagcagccgccaccgccactgccctcccccctccctccggccaccgcgccagggtgcgccaccactgccaccggtgggaggggagaggggaggagaggtgggaggggaggggagaggagagaagaggtgggaggggacttagaaaactttggctgcgagggaagaggggagagaggtttttaaagatgcttattttcgtagatggacaactatctcgtctcacggtttttattttcgtaggcggcaatttagtttcgagagacctacccgcttgaaaagaaaataacgcccacgtctcgaaaaatgatttttctagtagtgattttgtatatctccctacttagacacgtgtaatgtgatggaccaaaaagtgtggtcctccactttccacacctgcaccgctgctgcagcacacaccgcagcaggagggtcgggtggctgcatgcacgcatacattgttcagtccacgtttgcttcggttcgcttttccgtcgcgcgagctgatcatcgatcgccgccctcgtctccactatgaccttagtcattaagcaaaagaaattaagccccctcttcttccacacacacctaacctcagtgctccctcggtaattgtaaaggaagttgttttgtacagcgacacgttctttaaaatataactttaacctttttatttctataaaaatatttattaagaaagtgatatatatgtatacttttataaaattatttttcaagacaaatctatttatatattttttacgttttcaaacttaacaacttgagaattattcatgatttatattcccaaggtttgacttaggtggtgtttggttggagggactaaagtggggctaaacttttagtctctaatttccaaacaccctcttaaacattgtcctaaacaacttcctttacgagcaatggagggagtatacctcccctctcgcctagctatataatcaaccccgacaccttcactgaaacacctccatggctttccaccttcgcttcctcctcctccttgccctctagctactagctcacactgtcacagtcaccacacagctactagaagtaagatttagctagattattcattaatctgtactaattgatattgctaagcagctgcagcagcagcagctggttggggggaggaagaagaaggagagtgttcgatcggcggcggcggcggctcaccggtccgacatgcgcaggggttcaccgtggtacgactactactactcctcgtcgtcgtcgtcgtcgtcgtccccggcgcggagcaagcgcgcgcaggcgcagctcgtcgtcgtcgtctccgccgccggcaagaagctaccctggccctcgccgcggcgtcgcgggagccatgtcgtcgccgttcctgggctcttcttcctcttccgcttcgtcgcccctctcttacctgaccccgcctaggcctcctcctcctcctcctccccttctcatggtacgtcacggattagctcgatggttgactgatcttgacgatgagctgatggtgttcgacgacgatcttggcgtgcaggggcagggatacgccgctgctgccaatggcggaattggcggcggcggcgtcgaggcggtgaacgcggcggcggcgccgaggcagggtggcaggcacgccgggcacccgccgctgccgaggccgccgccgaggcagtgcccgcggtgcggctcggcgaacaccaagttctgctactacaacaactacagccgcacgcagccgcggtacctctgcaaggcgtgccgccgccactggacggagggcggcacgctccgcgacgtccccgtcggcggcggccgcaagaacagcaagcgcgccgccggcggaggcaaggccggcgccacagcctcgacggcggcttctgcccatgtcgtcgcgccggcggcggcgccgccgacgtcgtcgtcgttccccgatctcctgaggcagatgctgatggcgccggctaccgccggtggcggaggcggctacagcatcgacctgaccgcgtggcagcaaatggcggcgttcgcggctccacctcaggccgccaccggcgatgtcggcggcgcggtcggagcggcgtcgacggcggcgccggacgcgaactgcggcggcggcggcgtgcagtactggaacgggtggctgcaagatgacatgcccggtctagatggttcatgttaagtaacccgtgcttgtattgatacgtatacgtatacggagctacggatatatataccgaatacgtatacgtatatatatgtgtgtgtatatgcatgtatagcctatgtatgcatacatgcatacacatgcgctatgaaagtatatacgtatgtcgtatgcgcatactaaattagcgtaacaagagcctatgactgtactagtgtagtttggattcaggttattaactcgtgggtatatgttgacctactgtagttaaatttgtgtatttgtgcgactctgcccatttctagtttgtacgtgcatctatgtgttatgctttttttttcccttttttaagtactactcccaccgttaaatattactccgtataaacttagttaaactttgttaactaagtttataaaagaatttaatgacatccaaaacactaaattagtttcattagatctaatattaaatatattttgataatgtgtttgttttgcgttgaaaatataactatattttttataaacttgattaaacttaaataattttaactagagaaaaaactaaaatgacttataatatgaaagggagggagtacaaagcaaattgtcagacagaaaaacaaaagtgaaagactgctatgtgcttgcttacatacataaaagcactagttatggttcaatgtaagtcaaggatcatatcttgataagtctcaagccagtgggtatattccattctgctagatgctctgatattaaccccatcaatttgtgaagcgatttcatagcactttgctataatcatctacagtatatagctctgaaaatgagcaacgagacacgagagcagaagcaccggtagcagggaacccacaggcaagcagaacaactggcaaaaatcctctgcaccaacagaccaacaacactttgtgtgcaaaagacctaacaaaataaatttaaatcacatggttaccaaaactgtcacagtattacacagtgatttctctctctctgaatatgcattgtaataacagactaattaagcacaaatagcagagacaagatcaagtgaagtgatggttcagggtttcagctgtacgggctcatgccgatggtggcttcccggcgggcgtaggagacccgcgacttggagaagtagaagtagtaggctccggtgagcacgcaggtgatcagggagaaggcggcgccggcgccgaacgtgccccgccgcaccgtctcgcagtccggcgggttctcgaagaagaccttgcggtagcgggtgtggtaggcggactgcaccagcccggccagcaggcacgactccgcgatgaggaatgtcaacctgagtagaagaacatcaggcagaatgttcagtaccccagtgtgcaaaaactggatggtttggatgaaatttgtatagattcgctggctgcttaactgggtaattcaactgtttgatatatagagatcattggatgaataaattgaagcatttgaagatgtcatgctatgattcttatgccttatgctgcttgcaatttttatgcttttgttttgggggcaaaagtgagaattcaataaattcatgcgttcatatagcagtctaattagtacagaatcatggcagtaaaagtatttttcagatgctgtaatacatactaggtgctacaatgaacaggtaacacagtacccatgtcaccagcaggtgtatgaaagaacacaagtagaaacatatcaatgccaatcgtatctgaggaatcatagataaacccctgttttctctagataaaaaggacagttaaagggggcgttcggtaaagattgtgtgccaggggaattatcaaagttagggccaggtcttccaaaatagaaaatttgcataatatttctggaaataagataagtgataacccatgaacacgcctagttctacaacaaactgagtaactgcctggagacaaaacaaaaatattttattttgataagtaaaacaaattgactatggttgttcgggtgcagtcatgagaaaacgcatgcctgacttgttagttcggtaaaatgtttaaacttaattctgcagcaattaagcaattatctatattattactttaaatgatgctagtggtggtgtcagcgtctgcctccaacgtcacaagctaacatgtggggccataagatccatacacatgaatgtttttgctttatatatggcattttatgcctaatcaactaactatgctaaatttaagtttttcttttgcttttatctcttataatatccgttgcaacgcatggggcctttagctagtcagtgtagaaacaaatggttcataaacaattcatacaggtagtctgaatttcagagctcatacatataccactgtcataattgtttacaatgtgttgtgcaagaagtttgggggaaaatggtcatataactagactgtatcactggactcacagattaccaatagaaagtaccgactccaaacccaacaaatcagaacagtttagtactagtattaactgaaagctactcgttgattagttgatgaagcttgcccttaatcaatgtgggacttggtccagccggccgtccaacaatttctacaaccactaaagcactaaactcaacggttgagccttgatcagttaacactgtgaaggacatagcaagcaaatggcaacctttacattttgaccaattcagcataagaactccaagatgaccaaagctaattgctaactgtacaaaattcaagaccaaactcccaaccagtcaatttatttattcttaaaaaccatcaacatcatagtttgtattctaccatagcctgctatatgctaacattcctacaattttgccccgtgtgcacccctaaataaattagcatacaatatcagcaatccaataatccgaatgcgcaagcaaaatttaacaaattacatgacattctagggaaaatatcaaataatttgcatatttcctcttcttgagaaaatcttagagctagatgattgatgattcacggatatagaacaactaatttgtatatttcagcacgaatcgcatcaatccgcagggatttcgtgtaaattttaccctcaccaatcaacaccccaattttcccaatccccaagtttggctgagtcgttgatccaacgcgctttcccctgcaccgatctctagtttctttctgacttttcggcaaccccaaacatggacagctagagattcccaagctaataatccctgaattcgcgctgctttgcttgattaaacaacgcgagaaacgaagcgcacgactcgcggggcccgcgcgtcagcctcacgcggggaggtcaatgcggcggcggcggcgagagccgaatcgtggagaggatggggaaggggaaggggggatcggagttggtaccaggaggagaggaagaggatgagagcgcaggcgcgcgcgccgccggggcggagcgcggcgccgcagcagaagcagcggctggagacggcggccaccgcctggccgatgagcagcagcgccagcgcggcggcgcccagcccggtcgccgcgtcggggcggtacacgcagtaggtccactcctgcctcgcgtccgtctccaccctcgccttgccgccggagagagagagagagagagcacaggagcatcatcagcatcagcattagcatcagcacagaaagtcagttcgtcggaggagggggagagaggggggcgcgcaccgatgggcggctctgctcggcggcgatggcgaggccgaaggcgacgacgtcgacgaccaggatgacggccagcaccctggtggagtcggccatgatgggggcgcgccgcgaaacccgaaaccggcggcggcggccggagatctcagatcacctcgtcgtcgtctcgctctcgccgcgggctcgaatgaattggccgccgtttcgtattgtactgcctgccgtttttaaaacaaagcgaggttgaactgttcgggtcgctttttttatacactccgcgtgcttgtttcgaagacgcaaagcttaaaaaagaagtttggaatttgacgatattccacttcaaatttaaaaaatcgacgcaactatttatgtggtgtttggatttagaaactaaaataaaccctgtttaacactaagtcgttctagcatttcccatattcatattgatgtaagtcattctaacatcaatataaatatagaaacgacttacattgttaaacggagggagtaataaaactaattacgtaaatggaaactaatttgcgagaaaagttttttaaacctaattaatccataattagcatatgtttattggcattacataggctaatggctcaatagattcatctcgtgaattagtccagaattatgaaatgtattttgttattagtttatgtttaatatttttaattagtgtccaaatatttaatgtgacgttaactaaaattttagtccctgatcctaataccaccttagtacaagcactgctgacgttcgtgaaaaatacatgccgatgtctcaagattcgcactagtgctgttgatggaatagcaatacatgccgatgtctgaagattcgcgctagtgctgttgatggaatagcgacgatttgatgataatttgataagagtttgaattggaagtttgacgagctagcggagtatcgtcaagtcaaacattctgctcatggcaagttgctcgtatactgttcaccggtttgattttttaagaaatattcacataaaaattccttgtacgaaacgtatttgtatatcagtttagtataaagctcacctaaacagctcataagaacggaaccttagtaacgtgcattagtacttcatcatccaagcagacctgctttcgatccattcatcgcttattcatttcggcctttgggtcattttgtattacgaaaattcttaaaatcaataacatatgatatatacaaaaaaaaaaaactgttcagcaaaatggtggcacttaggtactgtacttaaccataaaaaatatataaatatgtaaagaatgatacaccataaatataacgaatgaactattttttatctgtaaaaggccgcgacatgtctaaccattgccattcaacttaacgtttagaacagcacgcaatatcattttagacttaacacttacattttatctacacgtaaaatagtttgctgtctatatatagctaagtcacatctctctcctattgttctcctctattttcatattttcacatagttttttttgacaataactttcatgtctttttttaaaatgaaataattttgatcccagattagcaataactctataattaacacagtataaagcctcatgaagataactcgaaatctcgcgggacaagcgcaaatattagacgcttgggtaaaagttgaatggtttttctccgagcaaaaaccattgaaccacctgtgctattctgtacgttggattcgaaagaacctcaatgaacggtccgatctaccccccctctctccccacttgttggcccaccatcggcccatggaccaaaaagcccatttcctctcgaaggccttaaacccctcgcctctcctcctccctctcccctcctcctcactagggttttaccccccaccttcccgccgaaacgcgacgccgccaccgccgctcgccgccgccgtcgccgtcggcggcgctctccctccctccccctctcccccccgcacgcgcggccatggcggccgggaagagctcgtcggcctccaaggaggaccagtacgcggcgctgcgggagctgtaccggccgcacatcgactcgttcgactacttcatcgacgaggggctcgacaagatgcttcagtccatccgccccgtggagatcaccgtccccaactcccccaccaccctcagaaatatccttcctgcttttttttttttttaccttttgctcgtcgcttacagttcagtggaccagttttttgtgtgctagtacgaatttaccagtttttccccacccagcatccaaaattcaattcttatgtgctacgaatttaccttaagacagctctcgtgctttccgaacttagctgacaagttgttaataaagccaacacccagtagttccaacatagagttactaaggcgcaggtttgaattcgttttcactctcttacgaggacaccaatagatgaggtttggaaggactgctatatttgtggatgctaattgtttgtgtacggaatgaactatggaagtaacttggttatcatctcattttcccttaaccgtcgtctatactatccttggagaaaggtcatctgttcccaccaaagagggatggtcggttggatgcaccgctctacccccagcaggttttgctatatggacttatcaaatccctttacatatcattttcattttaaacacaagacatttgtttaatctattgaaaactttggacgttctttcctgtttggatgagcagtgcaggcaggcacggacgacgtatcatggggaatttaaagtggatactttcatccaatgtaatgacggaccagctgtcaggcaaaccttcaattttggttacttgcctattatgttaatggttgttaccccttctttgttgtacttcttatcacatttttttcgtaagaacttctctaggtggattttggaacttgaatgagcggctgacagcttagttgagtagtagcatccacatatgagtgcagcttgttatctgcttttaggatctagcttgtgtttctacaattttacattagtctggcaccccaataagtcttggttaagttcacctgtctctttggtacaaaagctacttctgcttcttcaagtcaaaaaatgaaaactaagctatctaatatgatatagttacctggaaaaaaaagagacttttctctatcagttgggtggaaagaatcaaacattatgcactttattagtgtcatgatgttttgtcagtttatagctttataataggccaaaaatctaaattaataagcatgattatgcagtttttgcggttcagtgctgctttacaattctgacactaaaatgataaataatagctgctttgaataatttataatcagttgttcgtgaaagctgatctgcaattctgcatgcatcatactatgctgcaattctgtagagttaggaacacccaaagcatcgatattaaaaaaagtgcagatacatcacattttggtggtagccatagacaactattattgtttcttccttctggaagctatgcaggattcatttcacgttccacttctctctacaccaccttatttgttcttatttgaccgatggttttgatttaattagtgtgaattgtattctattcttgtttatgattttatgctcatgcaattccagtcaaagctttgccatctaagaggtgcagattctgaaaaattgattttccatggtgaagaggcaacagaaatgggcgggtgagtatgttatgaacttgtttatttgtttacattctcttaattatgtcatcttcttccctttctatcatttcttagtacaccgatcatttagtctagtcattcaacttgttaagactacctgtggatcttattgatcgattcattgtgttatgattatatcacattcactcttgattcttctactgttactgaacaaattttttgacactgtttcctatgttagtgtattcattctgatgcattttgtaaaattttctttcaggtacttcatatgtggtgggatggagagacttgtacggattcttattttacaaaaacgtaactatgtaagattactcagcttttcttttagatttatgttgcaaggctaatattagaaaaaaaaaacccagagaacattatggcaatgaatggtttggtgtgaattttttcagcctatgggcctgatccgtggctctttcgttaatcgtggtgctgggtacactgacaaagcagtgatcataaggtgccatatacttgtctatagctgcttatgttactgagtttttttgctgttgcaagtatacttgtctgtgtatctagttgtaccttttttatgttataatccatatctagttttttttgacagatgtgtccaagatgatcagtccagtgtgacaataaagctgtattacctcctaaatggcagtgcaaggcttgggttctggtaagttctgcactggcaaattgtgagtggaaatgcttgagtttctttttagtttttggaacttgattcttgaatttgtgcaaaattcaggttgggaggcagagaatttctccttcctgttgggattgttctcaaggtatatatttccttcatggggcttattgttttctaactggaaattgagttaataagctttctttgtgcatgatcaagttttacaaatcattgctactatatattgttggatgatgatgcaatctacagtgacgacctcaagccctttcttgaaatattccatatttttcatttattgagtaattaagctgtattttacaaactttttttttgttctaagcgtttcattaatctttcctctttctgtagtttattctgttaccttaccagataatttgatttatactctcactattttatttaaaaagtaatattttgattgtgcttctattctttgatatttagtgtaggttggcagtattcttaatgtaactttaacagtacattgacctgattgtgaatttacaaatgataggccctaattgatactagtgaccgggaaatatttacaagcttgacatgctgctacagtgatcattatgaaagaggaaagggagttgtcagcactcaacttattggtgaaagggcacaaataattcttgacgaagtcagagacctgtctctttttactcgcacagaatgcttgttgcatcttggtatctgagagtttaatttgttctatttgcacaaatttttgaatccttcttagtcactgacatcgataattatctttgaaatgcaggaaagtacttccgatctgtgatggaaggatttgagaaagatgattttgaaactgtaatattggatgtttaatctgcatttgtctttgcatgttgttgaaatttggatcgcttcactttggtcattccacattgtgtaggttgctgaggcagttcttaaggactatatttttgttcacctgcaaaacaaccatgacaaatttaatttattgatgtaagttgaagttttattgctcttttctgtgaatttctatccttttgaacctctttaatgatgtgtatctcttattacttttcacttcttagatttatgctgcagaaactttatgcgattgtagatcaaactgcgtcacctgataaagctgatgctctacagtaccaggaagttctcttgcctggccacctgataacagtttttctaaaggtcactaaaccctctgccgtcaagctcatgaccttttttttttcctttttgaaaatcaactccatagtactacaaaaatggcattcaatgttatgtgcttagtaaaaacaatactataacataaaatagcataagttttttgtcttaacctttctacccttgttcaattctctgcctctaccttctctgttacatatttgcatggactgctggaccatgaccaattgaccagtgttagttacaagatggatgtttttaaactgcttggagctggtgctgatgtgttccttcaagcataggtgctaaggtagaacaggtcatccagcacatactatgttg

SEQ ID NO: 32260 - DNA, 1132 bp, Oryza sativa
tatcacaagtcaacaccagcagttaacaatgagaagtaaacattactaaacacatagtaggccataccaacaacatggagtagatcaatcctcatccatggcggctgttgctgcggcagcggcggcggagatcaccttggccttcttgtggtggtggtggtggtgctgctgcttgccgaggaaggcctcgacgaacagctgctgggcgtcgagcagcgtctgggtgcgcttcatctcagactccatccgctccttctctatctggagagagatctccagcctccgctcctccatgcggaggaacttgtcgccgacggcgcgcagcgccgaggccacctcggccatggcctccgcctcggcgtcctcctcgctcttctccaccttgatggcggtgggttgttctcgctgcgccacaggcttggagcgggaggccttggggatggtgaagcgcaggccgctcccgctcccgccgttggagatgaggccgtgaaggctcctgctccgccccgcgtccgccgccgcctcctcctcctcatcctcctcggaggaaggggaggagacgggagaaggggacgccggtgagggggaggcggccgcggcggcggggcccttggattgatcttgatgatggggttggggctagggtcgggcgcccccccgccggcgaggtcgtggaggagcgggaagaagggccacttggggcccttggaacggccggcggcgcgcgccctctcggcgcggtaccgcttccggagcttctcgatcttgtggcggcactggacgccggacttgtgcgtcgccgtggggaacctcccgcagcgggcggtgacggcgccggcgacgtcgtcccagtcggaggctctgaggttccccttgcggagcccctcccacctatcgcggtaggcctcgatgagcgccagcgtctcctcgtgcgtccagcacggcgggggcagcctccgcccggagccccccgcgccaccagatgacaccgcggcggcggctgccgcggccgccgccgcgggggcggccagcggggggaggtccggggaggagagcgcgtccgggttgggcggcggggaggaggaggacgacatcgtcggcggcggtgggagctagggtttggtggtggagg

SEQ ID NO: 32261 - DNA, 965 bp, Oryza sativa
tccctcatatgtaccctttttgttaccttttacaggggaacttaattggtcgggcagtaattgagtactgcgatggtggaccaccggtaggtgaatctagttcgcttcctgatgttacaataataatatattttatatggtttgttattaacataacaacaccaaggtgagaaatttgatgtacttgtggtttaccatatgcgtcccaacctttcttgatccaaatgatgccttggacctctcttatgtacagttatagtttatttgctgactgtaacaggtaaagaatttcatctcgattggtggtcctcatgctggtacggcatcagtaccactttgcggtgtaagctcactctatcctcccctggtctccttcttttgcatatgcgtatagaccagtatttaagagtagactgcttggtatgaatgactgaaggtttttcatgcatataaatttacacactcttaatgtttagtagccaatggttactaataagcaacaggtagctatttgtagaatgacctatagttaaaacattactccctctggtttaagatatatgttattttagctctatccaacactgaaaaaaaactaggaaaagctaatgtcatagatcttgacatagagcaaggaacgctaatgtgagggggaaaaagttatataaaaaagaagttttttcccaaagaaatctttgctagaatggcataaaaaaatggaccggagacacttattgatagaacatgaatatgtcatataacataaaattttcggggatgatctgtagcattggccaaaacatgttggatgcagtttatgcttgctaaccatccatttgcacagctatcttgactcactggagaaaaacagcaatgcattacaagtgaatagtgataacttctttcaatttgccagatttcaagggagggagaaagcatgctttgagttctgtatgaaatatgtt

SEQ ID NO: 32262 - DNA, 15227 bp, Oryza sativa
cgaagctcgtattattgcatgattaattaagtattaacttttttttttgaaaaatagattaatatgtttttttaaaacaactttcatatagaaagtttttgcatgaatcacaccatttagcagtttgaaaaacgtgcgcgcggaaaacgagagaggtgggttgggaaaatgggggaaggacacagcctagtgttttaactaactcagaattcttattggcttgtatggctgtacattggtatctaatgtgcaatagaaggttgagtcccaatatattcattaacgtgcatggttatcctgcatgggctattcattagtacaggttcttgtggactgcaaatctgtctgtaacaagatacaacttacagctgtaaaaataccactgtaccagttaattaactactcaatatatgtaaccattaactgtgaagcccattttgacctttccaccttgtttcaggataaaactgagctattttgatttacatgcatgaacaaaccttttagttagtttaacccatcttcttaattctccaggatatgacagattatttgaagggttgcaagtttcttccaaagcttaacaatgagataccaagtgaaagaaatgctacgtataaacaaagattcagcagcctggaaaatctagtattgattatggtaagatgaacacgtaattgttgctatttgacatactctgggttgggtacttgtatgtggtgtagatggaatatgctgtgtgcagtccttgttaactttatatatatagcattatgcattcaaacgatcatatcgaacaagataatgaattaaaagttgttctacacaaaaacaaaagaaaacaaatagaacatctatttattttttgaaggcacaatacatctatttatgatcgcgatgtgtaaaacaatatgcttttagtaagctacataaaccttttagttcattaagtcacacatgcattttgtctcgtgttttgtataaatgttgttgatttatataatcttactgaactcaaatgccatttatgcatgcccaaagcaaatggatttaagttgcaacacattcagcttagtttttgtatctcaaatagctgatttttaagataaaggattacaagaaacatgaaaccatactggaccaatccatctgctgatacccttttgaactgctaaacagtttgaggacgacgcagtgttaataccccgggaaacggcatggttcgggtactatcccgatggcgccttcagtccagtgcagccacctcaaaaggtatatgtatatcttgagttgttgtacagaagacatagcatgctttttgttttaaactactgttatttaggggtgtgtattaagtaaggccatttttgtgtgatagacaaagttgtacacggaggactggatcggcttgaaggctttggaggaggctgggcgtgttaagttcgtatcagtgccaggaggtcacctgagcatctccagaagtgacacgaagaagtacatagtgccatacttgaaaccggacggatcatccaggttcggcattcgtcgcatcttgtcggattgattcacgagaagaaggcgttccgagtgaccagttctaacgtcacatggacatggattgtatgtaagctctgaattgtggacttaattgttgatgccatgtaaataccttggtaaaggtaatggggtaatggaatacgtcgtgtactgtagggcaggtggttagcgtacctgaactgcagaactggcgatgctagaattgtgctgcctattagcaaaacgcaattgtgggcttttatgtagcagacctcactaggaaaaagtccaattcgacaatctcgtatatagttcggatttaattcaacaacagaaacagctataatgattcctccagttaggcttcctccaatggtgccttgtaagctatctcataacatgtccacatcatcatgtatcctatgtggaggaaagagaaggcaaaaaatcaatccatctatctcctattcccacgcctatctcgctcagttaccgatgccgtatgagcctgtgcaagagatagcagtcgactcttccacaccaaaatcagatctcgtgctcccttcccccaaatcgccccgccgcacctcccgcccacccccgcacgctgcaccccgttcccgcacgatcccgcgcgctgcaattcgctcccccaccccctggcgcgccaatttgctctcccccgcgcaaatcctccagccacccgcgcgccaatccttcccttgcaccctccctccttttttcttctccagtgtgtgaaatcttcctcggcggcgtcgacgtatccgtttccacgagcacaacgacgaatccactcctcttgccaatgacgacgagctgtagagcaggatgagctgccggtccaaacgacaagtagctccgcggccgccgccaccgtcgtcgtcgccgccgccgccgccgccgtcgggatctacgactgcctctgggtgcttcgatgctgcctcgtctgccttctttcaggccagtactgcaatggctcctcctctaggaggccaaccaggtactgtaccgtacactcaaacctgatggggattgcagtggctctgccttgcttgcttcctggatgttagagtagaacaataagctgatgatgctctcaacgatgtgcagggttgtggaacggatctttgccacacaccaactcctttgaccctgcatcctcagattggtaagaaaccaatttgcttgtgtgttgtttctgcaagaaacaagcaaattcctttttgttgagactatttagattgtagaattaataatgttttagcacagataggaaatgtgttgtttcttcctcgctcatagtcatgattttggctcctgatatttcagtggtatggatatacatccacctggtggtttcctaagcatgttacaaagtggtcaacagccattagtcccacctcatgttttgttcccagcaacatggccacctatgccacctatggcaccaacaactaattcaggcactatcatcaacttagatgatggtgacgatgttaggactgctaagcgtcttacatgggcatcagatgaggacttgcggttggtgagtaaaattttagacaacttgcagggatttgtaccatcattctgaaactttactaacacataatgctaaatgtaggtgagtgcatggctgtaccactctaatgatccgatcaatggaaatggcaagaagaatgagagctactagggagatgtagttgaattatacaacagcactacacctattaaccggaaaagggaagtaaagcatctcaaagatcgatggcaaaggattaagagatgggtgggatttttctgcgcctcctggaagaaggctgcattagtttatactagtggatattcagatgatcagttgagagactttgctaatcagttttatgtggatgactatcctaacgaaggtccattcacagttttgcactgttggaaggttcttcgtgatgaacccaagtggcatgctgttttggaggagcttgaaaagccacacaagcggagcttggatgatggaagtgacacactatcacaaaaagatatcggagaaaaggagcgcccaatggggaggaatgaagctaagaaacaacgcaatggcaaaggcaaaggcaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactgatgagataagctgagcacgtgatgggtctcaagatgttgagggagaaactgcttggtgatataatctaaggtattttctgtcaatcaccatgcactttattgttagtcaatgttcaacaaatgaccatgtattgtaatatgtattcttagtcaatgtaccacaaataaccatgcattgtaatctgtattattagtcaatgtaccacaaataaccataaattataatctgtattcttagtcaatgtaccacaaattaatctgtaccatgtgactatatattgctctgttatattcagtctagcaaaacaatccagcactgtcctcctctgttccttctatccagtactattcttcctattctattctgcctcatttgttccttccatccagtccaacacttcctcatctgttccttccatccagtaaaacatgtcggatgagtttgacaattccatagacccagccgagatttacactacagatatgttcatggcagagcatagtgtccttaactcttttgccgggcggatcgacagaaggattaaggccagactagaaggaggtacatctaggcgtacaagtggtccaaggaagtacatcaataggaaccatgaaggagcccatgatcaactatttgctgattattttgctgaagatcctctctactctgctgcaacattccgtagaaggttccggatgagaaggcatgtgttcctacacattgtggatgaactaggcaagtggtcttcctattttacacatagagtagattgtactggatgccttgggcactcaccattgcagaagtgcactgcagcgatccgtatgcttgcatatgggactgctgctgacactcttgatgagtacttgaaggttccccagagtactgctctagagtgcttagaaaattttgtggaaggtgtcgtcgaggtatttagtagtaggtacctgcgtcgtcccacggctgaggatctcgagcgtttgctccaagttggagagtctcgtggattccctgggatgttgggaagcattgactgcatgcactggcgatggaaaaattgcccaaccgcatggaagggacaatatacccgaggtgaccaaaagtatccaactattatccttgaggctgtagcttcatatgaccttcatatttggcatgcattctttggtattcctgggtccaacaatgacattaatgtgctcaatcagtcccctctgtttattgaagcaataaaaggtgaagctccccaaatccaatttattgtcaatgggacacaatacaacacgggatattatcttgctgatggaatttatccggaatgggcagcctttgtaaagtctataagatctcctcaactagagaagcacaagctgtttgcaagggaacaagaagggaaacggaaagatattgagcgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaaaaatgcttctatccgagccaaaccaatccatagccagcttaaaaatgacttaattgagcatatttggcaacggtttcaaactaggcaaaataattcagtataatgtaagctctagtgtacaatttcattgtaattttatcttagactgactgtatttatcactttcacttactgtacatgtttttctctctaccaggggcgaacagattcgatgtcttttacttgtttttgtggctgcggtccagcttttggtgatcttgttcaaggaatgggataagcacttctggttgctgtccagcttttggtggttgtcgaactcttctatcacttctgtgacgtgatgcagtcttttttttcccttcagtttgctcttttccgcattgtactaaagtgccatgatatggctatgatgttatctagttactgttgtggaccgtgagttggaagaattgcacttcattgttatatactctaagtcgacgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagagttcattagagaaactatctcttgttctatctcttagatgtgtacgatttatgagctagcagttgtctcaacctttgaaggaggccttactaaaataagtgcagtgcagaatgactcagtagtcaggatggtatgtgacgccgacgtagcaactagtcataatttttttataaaataaagtaaggctcccatgtcatcctccccctctcttcctcatcccttgctgctcgtacagtgccaccgtccagccacgccctcctctcatgccggcactgctgtttctgcctcctccgttgtccttgttgccgtcaccgtccattgcgaagaacgccagctttggtgtgtgccccgttgatgtgcatgcatgtgtggttctcagagtacgacaaaccgagtacgcgtgctaggccgagatggcgacgatggagccgaagaggatcccgacgaacgatgcatggagaacccccccccccaccccttccggagggggggggtgggggttcctgtcaatcgtcgacgcatgtacgtactccatgccgaggccggggaatgcagaagagatcgtaggtgtcgagtgaagaaccccatgccgaagaagaagacgatgttgggtttgatggcaccacagactgtcgacgaagggaccgatcaaggtgatgtcaatggaaggtttgcacggcgggaaaaaaacacgccggcagcgatggtgcctgccatctccggcgacgcccaccaccgttgccctctcctcgcacagtatcttgtgtggcgccgctgacgtacggtagagagtagtacaactacctttgttggtaaaaagaactacgaggcatgcatgttcccgtgcgtccgcgcttctcaaactgttaaacggtatatcttttacagcaattttctgtagaaaaattgctttaaaaatcatactaactcatttttcttgctttaaaaatcacacttaattaatcgtgcagctccatttttcttgctggaggtgagggttcccatccctcacccaagtactccactaagcaccagttttcactgtacaccttgcaaattccagaaacataaactttatatagtaatcagtacatttacaaagttacagcgcaggtggagcagcctagtctggcaccaccacacctcattaatcaacaaataaacttactgtataccgcatgaaggtcctgaattcccatcgccggtgacatttcaaagttacttttacacaccaaatgaataaaagaaaattgcacacgccccccacgtcgcaaacaaaaaaggcaagaaaaactactctatgggttcccctcatggagaggcatgaagcgactccccaaccctcccgattgcctcgttcatgtttactcagctcacagctctctttaggtgattctacctacatcccgaaacaaacagcctgcacatgccgagtggtaatgtgacacaagctttgaaagccaaaacattaccttgggccgcaattttgcgatgttttgaacaggctgagaaggctgctgaagaaatgccttgttggaagattagcataagctccactgctgtgctttcatgttgaagtccctgtctgatggtgttccaaatttctgaggacaattcttgcaaagactttggcttcgatagaagcggtcgtggctgctgctgctgcgcgcaagactcgagctgcccctgctttctgcaggagacccgcatggtgcactgcgtgccgacctccagggattgtgaactgcattatgttgggagtattctcattagatctataagtatgttttgctggatggtaaaatcattttgcatcaaataagagcagatggaagtcctcttgtgtgaatgtctgagtattttgtgtgcgcacgtgtgtttgagagataaaaacacaaatacatgcaagcatgatattaatcatgaggtatggttcctcttcttagaacagatcaatggtgctcaactttcataatgtcttgtgcatgcggaatagccaaggaatacgttggttctcaatagataggggtcttcagaatattaagatggtacggaaggaaacaaacctgaagaagggcaaaggcagcacaagcgcgaagaattgatgcaggattccggagcatggcaacaaatctagcgatctcggcaccactgaagggaagtaaaggactatattagtactacattcctcttagctacattgctaccaagacaggtccaaaataagatgaacgggacaagcatgaatccggtttaaaatgttccacatgctctgcctaaagaatagccagctaaacttcaggaatagtaaaactttagtgaaagaataaagccaaacctgcatctcaggtgtccagcttcttgtataaacactgcatcagcaatctgagatagtgctgctgaggctgaggaggtggaagccgtagtgaaaacttgtgggtccgaaaatgtcagaacaaaagtctgtatatgcttcaaagccattctcctagctccctcaacattaacactcttggaactgccctctgatgacgtcccaaccaatgcaacctcatccattctgtcatttgagaaaattcagttttagactttgcaaatttcttattaagataatattgcacatcagcaatggcctatgcactacacgttttttgtcaagcaaaacacagtccgattatacaagtaatctgctagccatgctagtatgctgcgaaagataaagccaagtacatcacattgtgatactgtgttagcatctacagttaactgcttttcaagtaagtagtacaaggaaatgggaactatttaatataaaaatataactattaaatacagaaagaatataattcttaatagcaacaacaataaaaataatgctgtcaagtttcaatgcaaaagaaaccaattcaaatactgctgcaaaaaaataaatcttatttgccaaaaaaatgccatgtgcttgcacaatttaatacgacagtaggaaagttagcaggggatgcacaccaacaataggctgatctacaatggtaagttaactttttaattcctcagaagtggtttttaccaatcattgaatacagacgctctctctctctctctctcagagagaatatgtggagcccttaaagtatcaatgtatcactcatggatgttattcttcaataaggagagtaaggagttaaggtaactatagtcagacattactaagaaaacaattaacagaagcaatatatacaaaccaacttaaacggagcttgtaggctcatagctacaaacagaatgtcaaatgagccctaaacttgcaatctaagttgctgctgaaaaataagcaacttggtgattaattgaagtcaccaaactcttttataaaccaatgcatatttttctgtgtgtgtagaataactaatcgtcataataaggctcgaagcactgtgtatattgcattcaagacaaaggtatatcacaaagaacatgaatagatagaattatgaagataacactactggatcaatcggcattctagaataactgtgtgctgttagcctgctggtagagtttaaagtccttatacaaatcaaaattgaatgaaatacaccataattcaaaagcaaacagataaaataatcggtttgaaaaacaacataccttccatcgaacatataagcaagggctagcgcagacatgaaacgtgccatttttgaccctgatgatgagcaaagccgcactagaataggaaccccaccttcttcaacaatacagagagcattaccagaatagaaagcaagattccatagtgcccctgcagctgtctcgtgaacatcctgaataaacagaaagtcgtcatatctagagtaaggaatagcattcattcccaatgacagataaaacatttattcccaacgatagatataacaatctacagtaactgtcaatgccaacgttccttgttttatccataattttatttttttttcaaaaaaaacttacacccgttaccatattaaaaagagagagaaaaactaccctcttatcaaacaatgggctgggctgtgcactctaacaaacaaacagaataaattgacgtgagatcaaagtactatcaaaccattagagaacaaataaattgcatgcctgcagcaggcagcaggacaatattaatactcaaataaatgatgttttccccatcagaatatgttctctcaagcaattggaataatattatataaactggaataacattatataaacagtggcacagccaggattttcctaggcatggttagaaaacaatggcatgaagcaacaaattaagttgaaatggattaaggatgtttaaatctgataagataaatgaatgtttttagtcacttggacatataagttgcatacatgtgcgtatatgttagtaaaagcatatacttgatcttgtgcccaaaataaataaataaataaataaaatcagggtacaaatatatccccatgaatcatcgccactggatataaagttgactaaaaaagtttaatacatatactacattgaactcctgaaaggcatgtacaaaaagaataacacgacgagtggtagcttcataaaaccagaacattaggtaaaagcacaagctgaaggtggcgcactaaccatgaaattacttataatcaagtagctacttcaacaaactcgtctgtttgttcatggacaatactagtcaaacgtatctcaagatatgacagactacggcatggagcaactaatatttccaggtgccaggcagaaggtctatcataaagaaaaaaagtgatttggagtccctaagtaacagaatgtattcgcacatcaatatatgatgtatcagacataaagaatatacaattgtaaatgaaacttacttcaacatctgattgtgccagtgtgagcaaaggtgcgacaccaccctcctgtccaattgccatactgaaaaaggcaaataaaagttgtcaacaagaatgttggagaaaggaataacaagcgatagatggaggaaattatctggtacggaaagacgagagatgcagttctctttattgcagcaagtctgtaaaaaaggccaactagggagagagagagagagagagagagaattgattacaagttgcgacctaaaaggggcgctcctcattcatttacaggcagttatcagacactcgcctcacactgtgcctacacttaccctccagacaaaaatttcatccatcgcttgcacatatgatctggaattcatcagcactaattttccagtagctatattattaacccaaaacagaccacaccctgctactaccatctaacaccagggtcaccaaaaaagtctatggaaataggaggcaatctacaaaaaaaatggttaaagtggatcgtgtgctaagataatgcaattcaaaataagcatgcagtgcaaaccatccaccatctatatccatcaagccatcaagagctttgaagttgagtgcgagattgaagtgttcaagtgtggtcctgaatttagcgcaggcacagctgtcattaaggctgtgttctttccccttctttcccaactcacctcccccttttttcgcgcgcacgcttttcaaactgctaaaaggtgtgtttttcacaaaaagttttctataggaaagttgctttaaaaaatcatattaatccatttttcaagttttttaggctaatacttaattaatcatgcattaatgggcaacactgttttacatgtggggaggtggagttcccaactccacctcctgaactcagcctaagtgtaagtgtgtaactaactttgatatcagcatattttcatcatgtgtgaagctatctgatatgaatgttaggaaatatagaaactcaggaccaatctaggcataccacaatgtgcaatttttaacaattgctgtgcatgacatctaaaagtgaactgtgaacggattcaaatttgacttaggagagtaagtgtttttttaaattattaatacacttttcttgattgacactaagctagctttcactaattccaaaaaaaaaagtgcattactaagtttaagtgtttatggacaatcaacttgtacacttcatcagctaggcatgtcacaaagaatatcttaaaaataggtcaatctggtagttggtgcaagttcagttcatgagcaagcatatgaagttacctgttagcttctgaaacagatagtccccataatgcgccagcagctctctcctgaaggccttccgaagcattcaaacattcttgtgcaagtgaaacctaaaatatgaaagccatctatgtgaaaaatataaacagcttatttaagtctatttatgaaaagatgggaggagcacacacaaatgatctttaaaacattgtgtcctagaaccagttccacgggtaaacatagaagatttattattatttagttgatagtcggtataacacagtactaataaacatattcaagagaatatgttcaatcagaattaatcaaataactagaggtttctacagaccaatatttttattcagaactgctatatgaaaaactttatagagggattgcatctatttactgaactagatgtactgcttaatacaatgttgatcaaaggatgcaaagctgtgttaaagcacaaatggggcacgtaccaaagcttcaacgccacccgcagcagcaatgccttcacggtttctatcatcaaatgacagattccacagagcaccagcagcttcttgtctaattaaatgcacaggaatcacaatattaaattaggataatataaagtataatttaatggcaaaatcaggcgttgcaacttaaaacagcacatcagctagaagtataccttacaccctcattttgagagcttgttagctgcactaatgcctcaagagcccctgcttcctgacccacagcggcattattattgttgttatctccatgtgcggctaagttagctaatgcccttgcagcctacatgaacaacagtgatagtattagaaagtaaatgcagtacatatacagtgattgtgagcatgtaaaagacaaagcactaggtagcaagttagatggagcatttatttgtagagcttaaaacgcagcaaactgctactataagaaaatagcaattttaagtggctccacgacaaatccaattgttttaaagcagatatagattgtgcaagttgagaataaactgtatcttggaattacatgtacatggtaagagtccagtcagcatcccgacaaatcatttgagataagtatggcaggtacagactttcctttcttataggaaattgggaatccacgtggctcatgccatgagattgagcgatctgataaatataaaaaatcatccaagtccatgcatgaaaagttgcacccagtgcttaatcaatgaagtaggcgtgaaccaagagatcctcatttggcaggataaagttcaatatgcaagcataaaataaagatagcatgtgcacaggtcatcccgttttgtctttatcgtgcttcctattttgtagatcttgtaccgttagttgtattatcagagctagcaaaaaaagctatggtataactagctgactagaacgaatgcgtacaagcatgacgacatgatgtacccgctcacctgttctaggacaccctcaagtttacatgatcgagcaagcatgaccaaagcatggacaccaccagcctttgcaacttccatgctacacttgtcatcagcagctaggtttgcaagtgccccagcagcacgttcctaaagaaaaagagcaaccgttataaaaaatttattatccagaaaaggatagcaagcagcattgaaattactgaaaattgagaagtatcaaagatacatacaagaactccatcagtcccagcaggccagcggagtatgagatcgaccaaagcctttataccaccagctgctgcaatggctgcctgaaaaagaataatcaatatattgttagtaccagcaacacatcagacattgcaatcagagtattcagcatccaaggagtgacaaccttgtgctcctcacccacggagagattccaaaggccaccagcagcttcttcagcaacaagccgattcattgacctggccaaattggttagtattgtgatacctccctcgtctgcaactgcctttgcaaccttggcattcaccgataagttggcaatagcctgaagtcacattaacaactgtaagaaaatggtaataccaaacatagtagatatcggcaattagatccagggattcagctaaaatggacatcattacctttgctgcttctgactgtgcactctcccttgaacaccttgcaaggtccagtagcattggaatgcccccaacacgcatcactgcctctgatcttgcagcatccacattcgcgctctcgtcatcaataaccacaaacgtagcaagtgtggtagctgcacgctcctgtacatcctcctgagagctcttcaccaaactcagcagcatatctgcgccctgctgcagccagaagtcatccattccttgcgggttggactccgctatccgtagaagtgtctgcgacaggatccactcgagccagctcatcatatcaccaagtgcattgtctttgcccttccagttacattcattgaacacctcattctccttcacaaccttatcaggaaaaagtgagacgaccgatttgaaaatgtggcttgtaatggtgagtacaagcttgcccttggagttgctaaatgctccaggattgtgtgcctgttcctcctcaacagatttgcagttaagcgtgcatataagcttgagggttttggagtgggagatgagcctagagatggcacttggtgagacatcggtgcgggacacatcaacggcaacaagggagggcagctgagcccaggaggtggatgctgtagcccattcaggttgtgacatccagcgacggagaggaaccggagggataggatgccggcgatggcggcctcatctacggatccgcagtcgaggaaggcgacgtcttctaggagggggca

SEQ ID NO: 32263 - DNA, 39337 bp, Oryza sativa
  unsure (1)..(39337): unsure at all n locations
tcatccgccgccacatccttacccttcccaccgtccttgcacagccggcggcgcacccggcgcgtcatccccacccctcacgccgccgggatcaagtagggttcggtgccactcgagccccaattcgggggagggggatccgattcgcgggcacgcgaatgcagaagaaggagggcggtggtggtagctccgattcgcgcgcggcggcggatcgtgcgggggtgggtggatcggctcgctcgctcgcgcgaggcgagctagcttccctgccctttcctcctcctctgcggtgcggtgacggcaaggggagaactggaaggggtgggcaatttatatatagcgtatgcgggtacgcgtatgcgtattccgggctccaaaatacggcgacctgggctacggagtatacggtaatacggtatatatatatagcggtagtagcagtacgcacgtaacgtcaaggcaaggtaaagctggtttatgtacatcctgcagcttttgatcagctcgagagaggagtttttactgtgtttcagaagaatgtaaataaatttgatcagaagagaatcgtacttttggaattggaatccgagtaggaaaggcaacttcactgcattgtagctaaaaaatgggttgggaacttgggatgttcaaaaggattttgacgacttcatgcacaggccatattagcattcaacgctggaaaacggatattacacgttaaatggagtaaagattccacgtttactgacatctacaaaaaaacaatctagccagtttcaaggagcgtagggtgtgtagcaaagatggtttaagaatatcagatgcagcctacaacgacagcgtctctatgtgttttaaagcggaaagaaacatgtgtcttccctcccattgttagagcaaggcatacaaagctcacattcatcttctgagctatcatcagatcgatcagcaacttcagaacaagctgttacccaggtacatctatcgatatgatacaaatgtagatccactgattaaaagctgcacatcccattgttagagcaaggcctgcaagttcattcatcttctgaggtaacatcagattgatcagcctcttcttcctctggcaaaggagagacaattgcggcacagcagaaagaatcacggtccttcaggaggaggcaagttccatctgagttccatttcaagtccacaacccgaaagtttggcaacggaacgttgacgcagcatgcaccagatggtgtccacatgtacaggtgcggactctccgtgcagaaaacaaggcgtgggcaattagggtcccaagcggcagcacggattggatctttctgaacaagaacagcagcaagatcaaggcggcagatatcccatatccaaagagcagttggcatattgtcattccgagtgaagaaatagtgactgtcgctgctccatgacagcatacctgcacatgaattgcaaggtgagattagttcagctacagagaaaaaagaacccttaatagtagaatatgaaatgttaacaatgcagtttatactgaaccatattctactagaaattcatgaatggccaacacaaatcacgcaaggggattttagtacttagaagggttatcgataatgtttatagtaggaaccattatcacagtttacaaaatgaattagagatctactgcacatcagatacagaatgtgtaatagtaactacagtagttcacaagttcatgacactggtcacaagtgtattagcattaggaaaaagcccaacatcctgatccatatgcatgagaaataggagcaactacccaattccctgcttggggttgggcttgtctgtaacgggtttctgtgaaggcaaagtgattggagcatccatcacagcatacttaactcgagaaccttcctctgttccattttctgaccacaaaaaaagatcagtctccaaaactaaacataaagttagcgcctgccctaacacaaggcatcataaaacatgccaaataatttatcaaaaaaaggaggaacaagatgcgatataaaagtatcgttagtaatctcaccagcaccattgccttgcatgttacgggagaatccttcacttaggcataactctgacatgtcaagctgccatggatcatccacttcctgtgacattttgtagttacaatcagataccatgaacagaaaaacacagatctgctaagatgtcaattagtgatagatatcagtaggcttaccttactatagcagcattagtaggatttcgaatagatgctgcgtgtgagaactcagcaaaagttttccatgtcaggtggttcaaagtccgaactgcttgatcatagctgccaactgctaaaaactgtccacatggtgaccacgcaacagttttcacacctaatccactttcatatgctaagtacttgaacaggcacctcccatccggtgaatatatcagaacctgtgacaatcatgttcttaggattatcagtttaaatccaaaaactgctaacaacaacataagagtagaacaagagattagtatccgttgagatgaaccctatattttatctaaagcagaaaaaaaaaacatagctctataaaaacagactgggatgaacccttaagagtacaataagaaattagttcagctacagagaaaggagaactattaatagtagaatataaaataagttcagctacacagaaaagagaacccttaagagtagataagagattagtttcgctgcagagagaaatgactcaatgagctcttgaacaggatattggttaagaaataaccctgtatgttttgggggagtcatgacccaatataccaactgattgatcattaaagtccaactaataaccagatccgtcaatgtaatcaaatatcaaccgagaaacttgagtaaaccagaataagcaaaaaaaaattgttataagtgccatttgaagaaaaggtggtgtggtttgccatacatgcaagataaagtaattcacaaccagtgcccatctaaattctgaagtaaataagtgaccctaccaacaaaaagtattaacaagttatatgcatatataatgacatacagtaaatgatgatgattttcaaaagtaagcaaataaaacaacaatgggagtacaatgaagagatgcaccttgtattccagaagtgaatcccagaccacaatagcactatcatctggtgaccactcaacacctgccaagtctaccgtgtcaacagcaaagacactcattatctcccaggaatggcatgacagcaaatttacataatccttgcagtcacgcctagtacagattgcagcgaacttcccgtctttagtaaaagaaacacctctggaggcatgctttggccactgtacatgtatgcatgctgtatttacaagagaccaaacagtcagacggagctgaaactctgatgttgttagtatatgacgactgtcagggctccagcgagcatatgcaatcccagcagggccctcatcaatcttgcaggtccagtcaggctggctcagtgaccaagcctgcaccatgggtcgcttgtaaagtccacatagaatatactctgaatccggtgcccagtccagaaagcttatcttgtccacacatgaaaacaactgcaccacctgcataaattaaagcaaaccatacattgttgtcaattgtattctctagatatgactagcagttcttatataaatctccccagaaacagcatgcactcattagccactatacgataccatttggtattaacatttctttggtccagccatactgccaattactcatgaaccctggctacagatcaggcaaaacaaggaacatttcatattttctgtgaattagaaggctcaaattttagctataccagatgacaataccccctatcacaaattcagcaactactccagaaggcccaaaacttttaagcctgcattccaattcccaagcactaagtgtgtgcacccaatatgatgcccattggatgtcagtacatactaggagatgattgtgaattggtaatctctctcctacacagtttcaacagttattacatagaatatatggccgacagattgtcttattaatacaatatattcctagagttatactgttcacaaatatgcaaaagatttgtggggttatataatagtacaatgtattcaggcatttattgctgtgatatgattaaaggtatgttaaagggtcagtgttcaccaaggcactatcagatagtggatcagtacagtccttgcccgcccagccagatacaaagctagaaatgagggaggggccagcaagaaggccaaaccaagggagcagagagttgagcatccgcagtacaagtagcggcgccaattagccaattacagtgatggggctgaaaaattcaggctgagtggaggcaaaatctggtgcctgaaagatgtacttctcacctcagatctggccaacttaaagtagaacaacagacaacataacctgagaggtggcatgcagacatggtggtggaggatgacgatgccatggctgcacccctacttgctcgctcagtctcagtctcctatgccagaatgtaatgtaatgccgctgctctgtgtgcatgttgtgacgggggtgggggtgggggtgggggggatagcctattttgtcgcttttgagaaaacattaatgctaggcctaggccttaagcttgcctactcccttgtacgtagtccgtatacgtactagggcaatgccagctaccccaaattgtctattgcctccacctttgccccattatctactttctcataggtacttcctctcctctaaatcattccccttcccttcccactcagcatctccctatcacagggcccgtcgtgcccaccatgcatgtctccataccttcttagatcatcgagaaggatagcaagtctatgatgtcaagctctaccttagacttcctacagccaccctaggcaagctgacctcctagcgcacctattttggcaaaatcgtggtaggagggtgctgcctaaaactagaaatttccatgtcaatcacaccaaataaagaaatattttcactgtttagttggtgagcctatattatacatatctggcttatcgaatatagatatcatatctacagaagtatttgaacaatgagtaggctgatgattttaatcgtaggtattaaaggcacagtacaacatatagtctcattatcactctcctcaaacataaacatgcatatcatggtatctagtccgcacaattgagcaggtaatctagctagcttggtactgatttcgtccatccagtacaaacctaccctgaaccctaggctacggatcgggcaaaactaggcgcaattcctgaaccagaacactcaaaattgagcccagcggtagatggcatttcccccaaccccagattcagcgactactccagaaggcacaaaccctaaacccgcattccagttccggaccactaaaacaggatcaagcgggggaggaaggaggtgaggggggggaatggcgcggataccttgagggagacgacgtcccggacgacgaggcggtagtcgacggcgacggcgaggtagcggccgtcgggggagaagcagcacggccccgtctgcttgtacgcctccgtgaactccatcccttcgccttccccttgtcacgcggcggcgggcgggcgggcccggcgccggatcgggcggcggaagcgagaccggggggctctcgccggcgtcgaggtgggggagaagaatgcaaatctactcgcctgaaatttttttttcccttgctattttggacgccccgtggttggaatttgaaattgtttggagggtagagatgataagtgggaacgtatgtacgcgcgccaccgcctaacgagtgggaacgtttgtctgtgcccgtagagcggagcagcggtaggctcctccaggctccagtgcacccgatcgttgtcgttgatacggtgagaatcgtgtaatcccaccttaaaatttttcagcatgtcatatcgaatgtttgaacatctatataaagtagtattaaatataaacgctaaaaaataactaattacacatagtgcgactaatttgcgagatgaatttttaagactaatggctccatgatttgacaatattgtgctatagtaaacgtttgctaatgacggattaattaggcttaataaatttctctcgcagtttactaaacggcttgtttggtaactcgagggaaggggattgggagtttacacgagggaattgatgatgagattaagataggaatttgatttttaatcccaatatcttgtttggtaaaggtgatggaaattaatagggagtttaggagattaggtcattaataaaaaaaggatggctgagattcgtttaaacaacgtaaaggaggaattccctcccaattacctgtccctactcaagtattgaaaaggagggagttccttcctcaattctccatccccatcccactaaaattctcatgcctcccatccaaacaaaaacacttaatagcatcatctctctaaactcccaatccctgctaaaaactccctccaaccaaacaggccgtaagggattatgtaattagtttttttattagtgcccgaacaccccatacgacaccctatataatactcgatgtgacacgccaaaactttacacccatgaatctaaacacccccatactcctacatgagttgtaaaaaaaagattattacttactatacaattttctttcatgtatttatatattttgtaatttgatcaattattcaaatgtttcaaatgactgtgttgtatggtgtgatttttggagaaaaaaatgcaatttacattcttgataaatcattcaaaggttaaaaaataattgaggtgatgtggtttcatgaaataaaaagataattagtattaactatatttagtagatatgaactttataggtatatacgatactttgtttgtcgatgttttttagccttctatccacgattttaaatgtatacagtttattacccctttgtttcataaaagtacatataattttagaccggcaatgttttagtttcatcggtcctgtcttatatcaaacttatatgaatattaaagaaaaagaaaggacaacatattacttaagcatattacgttcaccatgtaaattccattcataataatcaaacaactaaaagatatcaatgatctaatcaaagcaattattagtcaaaacagccaaatacttaaaaaaaagctaattattcttccattggtaagaaaacagtcggaatcagcagcatctcttcagaactaaccggtaattgaccatatttatcatttaaactactcagtatcaacattaatacgataaaaaaattagaaaaaacaaaatttaaaaatagacaaaaacggtacgatcggaaatagtaccccttaaacagaaacgacgtctggtcgatcgagaatttccgtgaccattttcatccctaggtaagtgacataagcatcgacagcgaagtgtctataataactcattgatctcaagatacgtcgacccattatttgaaggaaatcagataaatatatgcgcgtatttataggagttagcgtgcgcgtgtttatataaaaccatgagtcataccatgttatttgaaaaataaattatgaaaagggaggggctatagaggacccatgtagaacgtgacaatgtcagccaaggatatagaaaggctgcatccatcttccagcccaggaacacagtcgcaactcttaatctcaaaagtccaaaaaacacccttgtagtcttcttagccagtggcaataagcccaagacccaacggcgggctgacggctcacaattcccatcctgccgccggcggctaccgcgggcggtgctcgactcgacctcgatggcgagctcgcgggagcggaggcttccgccgccggcgtaccggatggagaaccccttcagcgtgaaggtgctccaggtcttcaccgggcttcggcgtcggctgcggcgtcggcatcggcgtcggccgccccatctacctaggtatagcaaagcttccgaagctaagtgattccgccgtttcctggatagtttgggtctggggattgggatggacatcgatccggtcggccatgagtcggtgggtttcgcatttcgtcgagcggctgagggttgtgattattgcccgcccctggcttgtggccatttcgtcgaacagttcgtgtcgtgtgtcaccgcacatagttccattgcttgaactgtggataagatagtagatgataaaaatgggatgtttgctggtgcataggaatacagtttacttttagttaagtctactagtctgtcgaactgacactggtattgtgcacttcccctcttcacagactacagaccacagttactgccccatactgccatactatagggcatttagggctcgatgattaatttcaatgactttaagtagttggcttctgtcttgatggataggtgtcataccggggcttaatcaagttatgaccgcaacaaggggcgcaacggatgccttttcaggcgtaacaaggcatgttaattccgctgtaagtaaagataatccttgtgtaaccacgaataattaggtgccaatcacgttagtaggatacttttgacttatgttaatctaattatgtattttggacttgtctcgatctaattctgctgtttttcttccttatttttgtgctctagctaaggaagtcagggttaaagaacattgaagcaggcattggctgtggagttggtataggccacggttttggaataggtacatattgcagcttttccatgtagttagtcctctaaattttcttttggtgctgtcctagtaggaactattgtcagtcaaggtcatcttttgtgcttgatatcctcatatcttgagcatatctttcctgtttattacttttgcagtgatcacgccattttttttaacatttgtattatcagaaaccaaaacatgtgttcttgctaggcggtggcaatgtcatgctttattcatagtttcttttttatacagcaatcagattaaatttaggcacctggtgaattggtgatactttgattcttttgtatgttttttattttcattgactgctgcagcagatctatcagttcatctaatctagtccaaaaatgaagtgataattgaggggactcatttaatagaaccacatttcatactttcgcacctagcatactagcacactccctaaataggatccatggaaatatctataatatctgcaacgcttccaggtcattgtttttgttagtagaaatcatcagctgccaagcctctgctattttactcttatttatattctatatcaaatgctacacatctgttaaatatttttcttgcataagcatgcaaacttgtttgatctgaagctgaaccattaagtatctcaatactcaggaattgcattgaagccacaagtaattcatggaattcagtcaaccgttggagtacaaacctaaactttgatcacctgaatttttctttgtttccctttttggtgtatgaattctaagggaactttttctctaggaacttatgtctaagttcacttctaggctgaaggataccccaactttgtcatctgcaccaaatatggctggttctgtgcctagcaatggacaagctcccaatggtgtgtccattgatctaaaggctaagaccacgaaaagtaatttccaccatacaagtaatgaaacatcacaagtaaaaccagctcctgggttgcaaagccagcatggaatgcaaccagatatgactgaaagtcggactgaaaaggttgttgccaactttctacagtctcccctgttccaggatgaaaccaagatggacatcagagatgtggtatgcactaaaacattacctcaaatatctaacctgcactatatatattgcacaattatgggttgcccctatgcctctcgctgctaaaatttgcttagtcagacatgttattcatggactttgaacactcttttctttgttctttttgcaggctagaaattcacatgggatggataatgtgctggaattggtgagtccagttatacctagtgtttcttatgctatactccataatcccactcttgcttggttgttccatcctcattctttgaatttgatatgttctactcacgccatcccatacagcccccttaacatgaagcgcctctaatagtctaatatttttaacaagtaatgtagcattaaaacatgatttcacaagtaaagttctataacagaattttgtcttgcatttgttttaaaacttagttctgtatagtgtacagaatggtccacggttgtctttctacctatgtttatgccttcactgctgtctgctaactgagcttttcatttctgacccagttgctgaagcaccaaagaattattgacgaactgcgggacgagaacgacaagctccgtcaaatgctcatagaagaactcaaggtttcaccttccaagttacaattagatcataaaaatggagtgaaggcctacaacccatgctcggactgctttgattgccggaggcgaagtcgaaaaacaagaagatgataatggaattgcaggattgcattttggctattttcgcaatcctttgcaatttcttggattcttcagtagctaaatagttcatcggattagctttcgacataatatcctcagcagaagatccactcttgttgttcaggccagttatgttacctatctcctgaacattcgtgaacacttgatccaattgatgcgttacttctgtgctgaacatgcgcagactgatagcatcacagcagtacgtgattttagttctctctttggattctattcaatgcagtcaaatctaaaatcattagtagatgcaaaactattaaggtttaaaatataaaatttatattagtagattatctgtgaaaaactcttttatatagttatattttaaatattttttataaatataactttttatagcataaccgtatagtttgagaaatcaatgacaaaacatttgtaccggaggcggtaatacctttttcttttctgccgaagtagagagttttctttcctttttttttttgtgataggagttgagagttgagacgtgccaggtggagttctactgcagcaacgggggaggctgcttttctgtgtacgctggtgtttgggccgtagcaattacaagcccgagagagggaaaaccgcgcgggaaacgccacgtgctcagatccacccgctccccaaaactcccacccccccgcaccaaaatttttcccgcctcccgcccaccaccaacccacaaaatcgcacaactccaaggtccaaatcgcaaaaaaccaacccctcctcaagtgagaaaccaactccaaggaccaaatcgcaaaaacaccaccccctcctcaagaacaaggtagtagtagtgtactagtgttccccccattctctctcccattccccaaatcctccgcggcggcggcgcctcctcctcccatgccttccgagcactagcgcggcagatccgatccgagccccctccgccctatctccgatggactccaaggctgcggctcgtcggagatcgagcgggcgtggcacctcctcaccgtggtcatccgcctcggccggcccgccgccgcctccgacgtcgcgcgcttcgcgaccgccgacgacgtcgagcggctgtgccgcatccccgggtcgccgcttcggctctccgggggcgtcgtggcggcttccgagacggccttcgtggcgttcctgaggtacgtggggttggatgttccgccgccgagggtgagcccgagggcgcccgatgatgtgatgaggtggcgcggaggcgggtgcccgttacgtacgagcgcaagcggaaggcgtcagatgcggggcgcttcgtcgcgaggaagcgtctcctggcggctcccgatgcaggttactttgcttggttttctgtactgatgttggtttatgcggagccatcagtagtgtggttttgaactccatttgggaaaattttgtacagatttgccggaacacgagctgcggcagtcgcagcaactgatcgtgcaaagctgtgctccagttgctactggagaggtgtgctatctctttcaaccttcaagtttttctagtcgcaggaatatcatggtgcagtaacacaatgcataactgctctagtagctttgctgtagataatgcagggaaaattaggttatcacactgagggcttgttcggttaatccccacgagtacaggattaattccatacctaatcccctccgaagccccttgtggagggattagccaaacaaggcctgaatctgctgtcctacatttctgatttactttttgctcgataattaattacaattggggcttggtctgctccttctgtggacatttctcactgcaaatgacgagagagatttctttagttgactatttgactattttggtcactaggttgatgctacctattgaattgacctgcaatgttctcagtgattttatgaaataagctatgcagtccaatgctttgatacacatatttttatggacatatcatactctcaaaatggatgaccccatgaaagataattctcttgaatatgtctcaagtttgtatgttagtcttgatcttgaccctccaagtagttaaaactttcattattagtagaattcacctattacttcatttttctcttctttctgtgtcttgcctcaggtacatcaggaggctacccaagaattgcaagacaggcttcctagtctcaacatatttactgctcagcgttcctttgaagtttcaattggctctaatgtattttcagacattgaaattagcatgccttctcttccgtccaagattgaccagtttataggaggcaatgatggcagtgttcttgtgagcatggcttctgcactagtgccaaaggaggtgacagacatgtctggctgtatcaatatcttccatgctacagttgacagagagagtactaggattggtgaacctgaaggatcagcttcactttgttgttctagagtagaggaccgtgaggaactagaaaaggagtccaccctccttactatggcagttggcttagctgtgggaaagaaaaatgggattgagcaggatctgaatcttagacctagcagtcctagaaattgtagcacaaaggcaacagatgatatggaaacgttcgatgtgatttcgaaagaagctgaagctctacaatattgcagcccaaatgctcaatacccacagaagatcctaacttgtggtcaggacagtgatgctctagtagttaatgctcatgtggcaattcatgagaataagatagaagacattacattccagcctcctgaaggcaccaaaacagaagctattgtacatgaaatggtccatgaaactatgggaagtttgtgtcaaccttcttcaaacacaaaggttgaacatgcagtgttgccactacaagccccaacttatggttgcattagcaatgagaacttgaacattgctgctgaaaacagagcaagcacacatcaaaatcatgtggagccatcaacacagaacgaagtggctgtcagattatctaagaaagagcaagatagaaagattatgaagcaaagggataagggcaagaaaaaagaagcactgcccaaagaagataaggatcaagttgcagcaaaggttcaaaaggttagtttgtccacatgatgatgactcaactgttgctatttcaggttctttctatttatgaacagtttcatgcactactgatgtgttgtaaccatcatgaaccttgtatttcttttgaaaaatagcttatactgatcttcaaaaaatgatttattgaatgttgctgcttgcagggtcatacagaaccaaaaccactgcctaacttcaaaaattttgaaattgaagaagaggaaggttcaggtgagaatttctaaatattctgttaaaactttcttggtttatattgattgctgaccaatgtgaatgtttacgcatactcagggggttacgggactgtttatagggctcgaagaaaatcagatggaagactgtttgccataaaatgtgtgtacatctctttgctagtctcgatttgatgttttttcatgtggatttgttgatctataaatgtatcttctgttgttttgtcttttgacagtctcagtcatctttctataattatatggctaagatctttacaagagttaaccctgcacctgtattttttttattaacaggtcctcatgcaaatgctcattcacatcatgtttacaatgaacagaagatgttggaacgctttgggtactaataagttcatgtcctccgaaaattttataatgatatttttcttgttccatgcagtaactttaaacatatgtatcatgtttttctgctgcagaggcaagaatttcgtgattaaatatgagtgctctcttaggagtggtgatctagaatgctttgttctagaacatgttgagcacgatagaccagaggttgaaacactcatgttgtctctgatgtttatttttccttttattggctattcatattggtccatcttttgttgaatatttcttttatctctgcagaatctgagaaaagaaataggtttgtttgatttaaggtggtatgggttttgtctgttcaaagctctggcaagcttacataagcaggtctggttaaatgcatgttaccttagtcaactgctaacttgcgtttgtcaccagcttatcttggatatctgatatttctgtttccaggggatagtgcatagagatgtcaaacctggaaatttcctgttctcccgtaaactggcaaaggggtatcttattgacttcaacttggcaaatgttagtgcatatacttatctcccaatctgatgctcgccttctgttttctttatgctaattttaacattttgtgttttccctgaaaatccatgcaggaccttcaccagaagttctttcgaaacagtaagttcactttctaagtttcgaattttgttttgaatttcgatggttaattgcagtgcattgattgttatctgttctgtgttattgcctcttccagttttaggctctctgtactgaatatagctcttgaaaatttccatgccgctaataatatcctgggaaatattccactttggagcattttatcttagtgttggcatgttagcattattaaattattccaacagttagtccaaggtttggaatgattaggctatttgaggtggtaacgaatttattttttgaaaatgcattctgcttcttattaaatgcatttcaaactcttcagatttggaatgttttaagactgttgctgactgatattttggtttaattggttaggtaaatctgagacaatctcacgtgggaaggataccatatctcagcctgcactgaagtctaccccagtggttcaggccaaagaaccagttgccgattcaaagcagctccttggatccaagaggaaaagatccaacagaagcccagtgggtagtgcacctaagaatgataataaaagtaggcatggtatccaagctgctgatgtgtctggtgtaacctctgccaaggatcctacaagcacgaaaacatcattagacaggttgaagcagccaatgccctacaaagggcggaaggaattaatgaacttcttgcatgatgcaatgcaaagtcctgacaaaaatacttcgacagcacctgtttcccaaaggaagagggttgctgctcctctcggaaatgtggatcagaagctctttatactcaccccgatgcccctgtgttcgggtggtagtgctattgctggttctggcatgcttaacagcaaaggtgtgttacaaactttataccttctcactgaacccagcatcctctgagatgtttcatctatataaatatctcaatcttgcaggaaatggaaaacatcgaagagaaggtccatgtgttggaactaaaggatttcgagctccagaggttttagtctctttcaaaccatgagagcttgtctttcagctttgcgggccatgcatttatgtggtgtctttacctgcaggttctttttaggtctttccatcaaggttgtaaggttgatgtctggtcagcaggggtgacactcctgtacttcataattggcaaatcgccttttggtggagatcctgaacagtgagtttactaatgcattttgcaaagctctgattcctcaacatgttaaaggttgttgctgatgatatatcttctcaaatacaggaacatcaaggaaatagcaaagcttagaggcagcgaagaactatgggaggtggcgaaactgcacaactgtgaatcttcctacccatcggtaagtgttgataacctttgaacatcaaggaactgtgaagcttaaccaaaagtgttgataacctttgaacagctttgccgaaacagaaacagcggtgattcttagaacatttctcattgctttcaggacctattcgatgccaaatcgttgcgctcagtggatctcagggagtggtgtgcagccaatacgcgcaggccggagttcttcaagtcgatacctgactcattgtttgatcttgtagacaagtgcttatcagtcaaccccaggtgcaggatcacatcagaggatgctctgatgcacgacttctttgctccgtgccatgatctaattcggcagcacaggcttgctagaaggccagccccttctaataatctgccatgtttgcctcaagacaaatcggtcaaggcaaacgagtcgaagcgatcttcttccaccgtgccgactactgttaactctgtaagttgattgcctccaccagcaaattaaccagtgtgccaatagtcttaactattttgctccctcagatgttgatgtaaccatgtaaatactatatataccccccaaaaatatgtaagatgtcaaatgtaccaatgtttgctccagatggcagcgtgatgtactggtgttgaattcatgcacgatgatcatgtgctacttgatgtacctgtcaatgttgatagactgatagtgggtcactgacgtgtgggcccaacttttgtgggacgtgggtcactgacgcgctcctttgtgggacgtgggtcattgaagtgtgggcccaacctttgtgggacgtgggtcactgacgcgcttctctgacaaagttagatggacgtgggttactgacgtgtgggcccaacctttgtgggtcccacatatcagtgacaaagtccctctgactttatgtcagaggagactcgtccagactgataataccaaccagtagaccattttgcttcctggaatcgaatggggaaaaaaattttctccacttttgttcattattgttcacttcttttttatatatgcggtgtacatttcgtgcgtaccacacggtatacgtggtctaccattgaaccgtatacgtggtctaccattgaaccatccgcattctgcttcatcagtcaacatcattcactcgtatgtactccatctgccatgccatttcgcagcaattgcaacgctttgctcaccacgcgtcgcgcataaccctcctgatttcttatccaaaacgattttgtcaaatactaaacccaaacaaaaccaccgtctaaggggctattcactttgatgccaaaataaatcttactaaatttttacaataccaaaattttggtaaggttgataatattgccaaattttggcaagatagctattttagatgtgttcactttattgctaacgtacatgcacccaattttggtcattactatgcagttgccaaatttctaggatatttaccaaagttaagaaatcaaacagatgcacattttttttactttattaaaaaattgtatggattaaaatgacatcaaagtaaacagcccctaaggctgagttcggatggggggagatgggaacccaactcctgcgtacggaaaacagagcagtctattaacgcgtgattaattaagtattagctaatttttttcaaaaatggattaattttattttttaagcaactttcgtatagaaacttttttaaaaaaacaccgtttagcaatttaaaaaacgtgtgcgtggaaaacgagagagagggaatgggaaaaggtgcatgcgaacacagcctaaatgttgtccacttccccggctgaacggcaaccagatacaagtaaccaccacaagccgttaaccccgttgtttacctcctccttgataatctaacagcgtttaattcccttcaaacaataatattccgttggattcaaaacactaatccaatatacaggattcaaaattcaaaatggatttgctccaaaattcagaatttgtttgtatttcggatggatactgtgtggtgtgtgtgtggctgaaaccgcgaggccgccgcgagagtcgagaagcagcaacagatgcaaaaggagaagaggccgagaagggaaggcaagcgaagcaaccacaccaggcaccaaggcaccaaccaaccgcgcgtcgaagcttctgggccacgccgccacaaaagccgaagcggaaaggaaaagcctccctcgatgcctcctctcctcgcctccacctcctccacgtcccctctcctcctcgcctctcgcctccgcggaggcggcggctgcggctgcggcggcgcccctctcctccaccggacgcgccgcggcttcctcgcgccgagcaccaccaccacccagacgacgaggacgagtttcgcggcgatgagctggctcgggaagctggggctgggcgggctggggggaagcccgcgggcgtcggcggcgtcggcggcgctggcgcagggccccgatgaggaccgcccggcggccgggaacgagttcgcgcagttcggcgccgggtgcttctggggcgtggagctcgcgttccagcgcgtccccggcgtgactcgcaccgaggtgggatacagccaggggaacctccacgacccgacctacgaggacgtctgcaccggcgccacctaccacaacgaggtcgtccgcgtccactacgacgtctccgcctgcaagttcgacgacctcctcgacgtcttctgggcgcgccacgatcccaccacgcccaaccgccaggtcagccagccacagattaactcgattcacaaacctaatcgcatgatttcgtttaccgtaccttgctctatgcttaatttcgggttctttgattgagtgggtggcagggaggttcagaattggggatttcatttacgataatttcgtgagggtttagtggaattgaagaattaggctactgatattactagttcagttagtaggagtcactagacagatattctactgcaaatttttacagagaagaagaattcctcgcgagtaaggtaaatcactctatatacgaaagaaacgtgggtgctgtcgtgcacagtaagagctcaaacctgtgacaagtgcggcatagaattgactatcagtactgcggtttcttaattagcttgcaggtcacggctgaccggaattattgatgagttcctcaccaaccaaaggagcttactttggccttatgttctttacgcagttttggtttacagcaagtaccacaatcccataatcctgagcactggcagagaatagactgtcatagcgtcatggttgtgttaggctgtgggcactcagcgttgattgtcctgttcatgggaccattgggcccaatgaatcaggttctgttatattggatcaagaatttgcagcatcccagctgcagtttgcactttcatcatcaaagggccgaataccaagtggctacctgcatattaatcttgagcagtcaatgttatagtgtgggtactgttagcaagtatataccatcatattggtgttatcggttggtttgacaagcatctaattttgtagtggtgctgagtctagcatgtcttgcagtgtttgtaatgcataaccttgcacttgggcagcgctatgtaattttgcaagatcgattgcctatagtatgtatcattttgtgttcactaatttatgtataacttgcatcttgattctttagattggtggacaattgactgctaccaaggagtgccaccaaaaataacaaactaactgaaaaaaaataacttagcctgttattttgttctgttttctgaacaaaccaatgctgatttgcattagataaacttgttcctagacaattagattctatttctttcaagcatccgtttgactgtttgacataactgaagtttctgatcacatatactctgaactctttgtatgcagggtaatgatgttgggacccaatacaggtcaggtatctactactacacccctgagcaggagaaggcggcaagagaatctctggagaagcagcagaagcttctgaatcggacgattgtcactgaaattcttcctgcaaagaggttctacagggcagaggagtaccaccagcaataccttgcgaaaggcggtcgcttcgggttcaggcagtctgcggagaagggttgcaacgaccccatccgttgctacgggtgaagggcaagtttgaaccagaacgccacacaagaacagtgcttgaataaggataaataatagccagacaaaaattatgcagcataatactattttgttacctttgtttgtatcaatccatcgattgtaagagatgagctgaacctggaccatgatacttgccgctgattatgtacaaaccaccttagaaaacttgatatagtattatccttttcgatgcgggaagaaaaccactttttctgattgaattcattcaaatggcaatagccagtagcacttcaggaaatgcagtgtgctctccaattcaagatgaaagtcactcgctgagaactcagacactacagtgaggtcattgacgaaaaatgttgaaattcacctgtaaaaaggtaagttttctaatcttctcatccaaaaaaaaaaaaggtgagttttctctagcgattttttttgcaattgtgttcggagttacatgattgcagtgtggtagtggactgtagtagcattttgagttgtgatacgttctactgttatggttgctgataactgttatttttaccatcatctttttacaaatactccatccatcctcatccatcctaaaatatacaggacattggtaccatgtgatagtacgaatctatctataccaggtaagatataagtatgaattaactgttatattttattgagtggtctcatctataactgttgctatattttaaaacatatattttgttgttatattttatcgagtggcctcatctataactcttgctatatattttaaaacagagcaactaatttcgtgagaccataaatcatgatttagcacttcactacataagcaagagcatgccaggcaatgtttggttggtgcctatgctcacacaatgaaggttaggcaaggcttagctaacaatttattggcaataaccaatatcgacctagttacactaatttacgtataacctgtatcttgatccactagattggttgatgccccacgttactgacctcttagacaggtttgcttagacaggtttggtttcctaacgaagagttgcaccaaagagaacaaactaactgaaaacgaacttgttatgttcaacacaacttgttgccagcactcaaatgataaggcttcaaacaccatgcaatgcaactccacatcaaaggattaaagcaataccatatatcaagagcaactggtaaatgcatgcataacatgcaacataatgaagaaaaacttcagttcgcacagacaaaggttcttgagatgctgatctcaattctcaactataaaatagcagctaaatagcacggtagatcttcagatgccaactctccaggttcatagtgacaaggcattttagacctcatagatccatgggtgctggttgctcctccactcggcgatgccctcagggaaccacagagcaatctccttcctggcgttctcgaccgagtcgcttccgtggatgacattcctgcaaggtatgaggtcatctttagaacttggattctggatacatatttaggtctatgaacagatgagaactcaaagggataacatgagtactagtagaaaggtaaatttgaaggactctagagcaccatttggtgttctgtcgaccatacttgtccttacatactccctccattccaaattgatctacgtatagtttttctgaggttattcctaaatgatctacatatttgtgttcacttattaagtctattcgttatttgtgcattggagtaaatgaacattgatgcatgtatccatgcacacaagtatttataacccacatgcaatatcttaatttgctattgactaggaaatattggggatggtgcatacatcgagtttgttgctagagtaaatatagtatgagagagttattagtttttcttggtcttggtgtacctatgaaatatgtagatcaatgtggaatagagggagtacaaggcaatcattgtgatagtaagatgccagtcctaatgattgttttttgtttttgctggtcgaaatgatgaagtgttattgggccattgaaacattcacatggtaaaatgcactcttattcattaagaaagtatatattttttctgtggaccacgaattagacttggaaaatttggatgcaaggttaatcatggtaaaccatgtagcacatggtgctgtcccacagtggacccataaagtgatatataaaccaaaattcaatcaataagatactagtagtagaatgaatcagcacggttgcaattatttggtatgattggacagtgtatcacttggtacttcaaagtgcataaaacattgcatatggccctgtcagatgctctcaccatgcttaagctagacagaactattcaacagggagtcagtcaactaagctcccaggacagaccaatgctatatattgcacaataaaataaacaacacaccaaaatgtactttagaaacataagtaattttgaactacacaagccttcatgtgctacataagtttaggtgtttctccaaaagcatttaataccatgcctcttgggaggaaaaaaatcattttagcatctgtttctgaaaataaagcatcttagaataactgtgatgggcatctctaattatactccagtggaatttgcatttgaatctggcgcacagcaacatatgagcaaatcaaaattaagagtgagcaagcagtggaggatgcaactgaattaaaatttatcacccactgatgaatgtaaaccacagagtgaatgaacgaaacctgacctgccaatgtcgacagcgaagtcgccacggatggtgcccggctcagcggccagggggttggtggccccgacgagcttgcggccggtggagacgacctgcttgccctcccagaccatggcgacgacggggccggagacgatgtactccacgagccctccgaagaagggcttggaggacagatcggcgtagtgcttctcggcgaacgacttctccacgttgatgagcttcatggctgcatgttcagatagcatatcagcaaaaagaaaaaaaatcatcgctccccacagagcaatcgatgcataaatcatcaaacaagccactaattagacccacggagtgaggaaagatcgaagaaattaagctactcaacaacaaaacatgcttagtttcagagggagagagagaaatccttttaacacataaatagcatggcacatcgtgttgtgtagcacaaagattcaatctaatcttctcacggtgcagcgcaagcacaaatcaggatcattggcaaggtgggcatggttacctttgaggtagaatcccttcttctcgaagcggccgatgacctcgccaatctgagcaaaacaagcaaaagacaaacacattgaagctaagcactagccaacaccaaatcgatgcgaggggaagtgaaaggtaagcttacgaggcccctctggacgccgtcgggcttgatcatgatgaaggtctgctccaacgccattgctaccgaaaaaagacaagctcctcgagatttcggggtctggttttggaggtggtcggcgccgtaggttgagggagaagggaaaccctagccgtgggtgcccctcccatatataggcctcctgcactgtccggcccaaccacgtgagacaccgcatcgatctccacccaaccctagctagactcgcaaacttgggcccaaattagatctcgtgggcctccaaaacggcattcatggcctgagccatttcacccctgtctccatttcactcgacattatagagagtagtagtaggaactatactaatcacttcattcactcatctcaaagaaaaattaacaaattcttcccggtgtacattgtttgattttttttctcttccggataatgaggtgtatatgctgacagttcaacttgcattactttcggtaaatttctgcgttccgaactagtagtgaatttggaacgagggagtttcgtaggattttcacaagaaatagttcattgacaccaaaggaggctttaggttcggatcttttcagcttattagtcggattattgaaacggatggtttacttcatacttgaaaaaataagtttttttttacttggacaatttgtttaagttagttcttaaatttatttctcaaaaatatatatatatatatatatatattgttcttataataaagttcataatctgcaacaacaatatccactgtaaaataaatttaaaaaaaaaggcaatagtgtttgtgtcaatgggaatagttttgctggcattagctgactttacttgcaagtgtaccggcacaaagagaaagagaggtaggcacatcagcacatggcaaattttgccaattagcaaatgcatcggtgaagcgaaggcgacggcgtgtggaggctggagctggaggaggtgcgaccttgcaagtgcgacttccaggaagcattggcgttgccgttgcgttggttgttagcagttaggtgcgctcgtctctcacggtcgcatggtacgattggcaaatggcaactacacttccacattcttctcgaagaaatggagagaaaaaagggtataaaaccaacaaacttcttggaggtagtacggcattgcaggaccatgaataatttctgaacttgaatgaatgcagcaacgacttgattcttcagtaatttcagagatcatcagattcagtggccaaaacacagagtattctctagtcatttcttgcaaatgtattaggtatttgatcaagaactcaatattggtcaatcctctattgctacagaagaatgaatgccttaccaagaaacctctcaattccttttctcagatcgagttgagtctctctcactatctatacattctacggatgattttttttctctctcttttttttttcaaaaaattctatgccaagattgactttatcaagaacagccaggcagatctggccaattacctgttgaatcgtatgatcaattagctatagctcgtagtaagtagaagtgtttgtcacttcggcgatcttggcgccgccgccatggaccgccgcgtcggccctgcctcgacgtcgccgtcctccttcttctccaccacggccgccgtctcctcctcgccgttctccgccgccggggacggcagcgagggcccctccaggtcgtcgcggacgcggaaggaggcgtggagcacgatgaccgggacgccgacggcgagcgcggcgaggaggttggcgatggcgccggcggcggcgaggtcggcgaggacgagcgcgacgaagacgagggcgacgaggcggcggtcgaggaggcggcggagcagcgccgagttggggaacacccggaggagccccccgtagaggaggaggcccttggaggccgccatgaggaagagcatggacgccctgtgccgcggcgcgagcgacgccaggaggagcgcccactgcagcgcggcgtagtggaaccggaacgtgcggaggttgcgcacggcgcgcaccgccggggcctccgcgtcggccgcggcgccgaacgccgacggccgcggcgcgaaccgcgccagcgcccgccgcgcccccctcgccgccgcgcacgccctgtccgccgccgcgcacgccgcccgccggatcgcgcccgcgcccgcgccggccgcgcccatatcgccgagatcgcgctgccgccgctcggatcccccgcggcgtcggggtccttgcacggctcgctttctttatttggaggcggagtctgagacacgggaggagaggcgaggtcaagacgcggtttttaacgggtcgcgcacttccgggagacgaccggcgcgtcgctggcgctgcgaatacgaaaagaattccggctgcatatcgccaaattttaaatttttaagctgattttgaggggttttttttatcaaaatttatttttcagtcaataattttaagtcacaaaagttttattcataaattacttctcgtttgcaaatatgcgggccgttcggccccatcttttcctcatcagctgctgctaaaatttaattttaaagttaattattttgtgaggaattttaaagtttttttcattgaagttattcttttaaattagtattcaagtcactaataacgtactccctgcgtttctaaatatttgacgctgttgactttttaaaaatatgtttaaccattcgtcttattaaaaaaaatttagtaatcattagttcttttcctatcatttgattcattgttaaatatacttttatgtatacatatagttttacatatttcacaaaagtttttgaataaaacgaacggtcaaacatctgctaaaaagtcaatggcgttaaatatttagaaacggagggattatatgtataaaagatttatccatattttttattacgttatacattatacggcgtattatcggtatttgaccaaactatggagccttcgtcgccgtatttgcagaaaaaaaaaaaaaaaaaacggggccgtttccactagtttttccgtggaattttttgttgcgatcgccaccgacctcatggtgccatggaccatggtggtgtggttggttcttcccaaatgttcggccgagtccaccaagacaccaacatcctcttctggcgcatgctagcccagctgtttgtttcaattttttatttacacaccttaaaaaaatcttactaaagtcttaatcgtttgatttaacttacagacaataatgatttactcgcagcatgccatatgagcgtgtataataagaatttcataagaaaaactttacatatagcctttctttattttgtttcccttgatgatcttttttaaaagaaagaaatatttttgtcatattattatgttggtgttggagcctaaaaaaatatagatttgacaaagtagtaatgcatgttagtagtagcaatcagtggtcgggctctgattaggtagtattttgtttgcagactggctgactgagttggaatattcagagtttcaccgattcagtcttcagacagtaacaagcttgattactgcagagattggggaacagtgtgctaaaatcagtgaacccccacttgattgggttcctgctttcttgcccagaaaattggaagggtgtactaatcaaaagtgagtttttttttaatgatttttgctccggtgccttaacggagacatcacggtttttcgctgaacaaccggggaggtggatacatcaccaacctaataacaaagatgagagcataagggaaaaaagatgctaggtattgttctttgcttggtcgaagaacactatcagaagagtctggacatctaggaaaacgattgcttaacattcactcaataaaacattgtattaaaaataatatattcactcgagaacaacagactgtgggcttgttcttttcttcaggttagcctgcgtgcgtgcgtgtgtgtgttgtgttgcccaggttattcagagttcagacaatgagacacttttagcctgcgtgcgtgttgtgttgcccaagacgaccttttctttctcataccacaacattcagtcaaaaaacagcatagacctaggcttcctttttccccttttctctgaagaaccttataaaaatcagcctggctttacaaagtcgtttcactccaacaaagaaaacttgcaggatcattagacatatagttcctgcttactaacttctactcctctgctagtacaatacgagcttctttcagcgaaaagattgcacgatttgttggcgataaactctacaagcagatcatgtattccagaagaaggtacatacaaaattcatctagaaaaatcgtacatggagaaatctacatggatcaagttatactgggccctgcctgagcttagtaggcttctcttcgataagtgggccactttgggcctttcctgcttcccctggtattggacctgagaggccgtgtcgctgttcctttttctagctcgggcttcaatagcactaggccatgagcctagtagggttcctagtataaaatgctcaccttttctctcaacaatggaaaatggtaaccacaaactaaaattcaactgaaaatacaacaaaggagcatatgagtaggcgacagttccaagtcgaaaattcaggacaacaataaaacgtgccatgcaaagactctgtgttcttccccacctttcccaactcaccttccctcgtgttccgcacacacttttcaaactaataaacggtgtgttctttacaaaaggtttctatacgaaagttgctttaaaagtttatattaatccatttttcaaaaaaaagagacttaattaatcataagaacatacgtcgctccattttgcatgcgaggaggtgagttcccaatctcacttcccgaacacagccttatgtgagcaggcaaaaaaaagtgggatatactccatatcagcggtactccgtattaaggaggaggtgactttcgaagccaagctagttagtgcgttaagggtgtgtttagttcgtgtaaagaaaatttatgggtgtcacatcggacgtttgaccggatgttggaaggggttttcggacacgaatgaaaaactaatttcataactcgcctggaaactacgagataaatttattaagcctaattaatctgtcattatcacatgtgggttactgtagcactttatggctaatcacggactaattaggctcaaaagattcatctcgtgatttccatacaaactgtacaattagtttttttatctatatttaatgctccatgcacgtgtccaaagattcgatgtgacgtttttggacaattattttttgaaactaaacaagacctaacttatgggtctttctataggctagcatcatgtgagtgggctagttagcctgggttcaagactcacctcctccttaataccattgatatggaaattttggtaaattttgttctcagtttattgtctagatatggtaacccctcttcaaaccgtaagagagatgtggaactcgtgctgctgtcaatttttttaaaaaaaaataaagagagaggagacgaggttgtaatcacgtagggtagtagtagtagatgtatctgttcatcttgttctgagatcagacagttggaacaaatacagcgcagctaggggcagcaccacacccagcaagccaagtaatactgctgctacacttgcctcatgctgcttggaagggacagacaaaccgaaacagatcgaccacgcatgctttgctaattgctgtgctttggcgttttcgctgtaaagtctcctcctcctatatccatttctcactccctcacattgttaaacaatcaattaattaatttgacagctaatctaacaacagatgcatcactctaagatgctactactaatctccctgtggcatggataagacacagacacttgtaattcataacatgagcatatgcatgcacactgaatgagtgtcatcacagcattagatgggatcagggtgtcatgtcatgcagcttcatgctagctactagtagctatactaactttctctctatctttaacaaaaggagataattaaatccttcacttagaccggatgattagcatctgagggcgacgcaatgcagcatatgtgcatgaatcatgatcatcatcatcaggctttctgctgtgacaggacctggaaaaaaattattctagtagcttttggttttgtgtttaactatatatatggtgataaattaagccaccctgatcacatggatcagagtctggctggaccacgggatcccataaaatcggctattaaatcgcaaaagggggcaaaaaacaatagcaatattctggatgaactgccaaggtgtctctcatgtgcattcttgtgggtatattccttccctcttctactagttttcgtccaaactgttccatccatctgcatctttcttcagatcagttcacaatatacttgtactacctcattggcacaggcacattcttgtgggagaaattttggatagagaaatggagatgatgctcctgatgctgggaaagaacatcacatgcttgcatgctcctcgacgtgatgagcaacatgtaagtatatgttagtactgcagtagtgcccttgcagcatcgatcaccaaccaatctgtcgcctgcatggcagaatctgattgtctgttcctcacaaacatgtcatattctgatgcctcctagcaatctgaattactaccatattaaaattttcacccctcctgatggtgttttcaccttctgttctgacacatatgttaagatttcaagttgttcagggaaacacttgtgatatgtatatccacccatcccaccagggttcaagtcctgttgcccatgaatattacagacatactagtgggcattcaatagaatttagtaagatcagggatgtgttgtggattcccgtctctttgagcatgtgttagatggcgcatctgtcattgtgtgagtgtggtgttacgtgtgtagtgttgtgcatgcatttacatctgtcgtgtaatcgcaaaaagatttcaggttgttcaggtgtgtatgtgttcagtgtatctctgaattgatctgtgctgttgctgcatatgctgaagctgacacacatatgttcagtttcagagttcagtctgtttcgagtgttcaatgtatctctgaactgatcactgttgatgctgaatatactacgctgaagacgacactgacattttgactaactgggtgcctataatcagcacggaatacacgaggaaaaacaaaaaatgaagcgccactaatcagttaattaccgtttcaaatgatccatcattagccaatacatgcatgaatttttcgtgcggaatgcccactgctagaactgcgaaacaccctaattctcgctgaatttgtgtgcatgtatatccatccattcatcgttcggctgcctaacagctggaaaaatgactttgtgcatcttgtgagaattgcagctaaagtcaggttagctctgaaagtgctctaccctgcattcttgccaaggttaaattcttccaaccaatacacgctctcgaatcgaaccttatcactcttgtcataaattaagctgcaagaatcagatgattccacagttcagataaccctcaagaaaagaacttcacaagttcagaattcagactgacttaattcaccaggttgccgaaaattcactgcaagtactaatgcagtgcagccgtacgaacctatctgtacggtcgatacgaatttaagcaaaaatccgatccatcattataatctaaatttgagagtctgatcaaacccagatttaaactaatttttaccaggttgctcaaaattcactgcacgtactagtgcagtgcagccgacaaatccatctgtacagttgatacgaatttaaagcaaaattaaatccatctttataatctaaatttgagaatctgatcaaacccagacttaaactaatttttacctgcttgctcaaaattcactgcaaggactagtgcagtgcagccgacaaatacatctgtacagttaatgaaattttaaagcgaaattcaatttaaattcgagagagagaagaagaagaagaagaagaaagacagactaatcatgccaacttgcaagcccaaagacccaatctttccttagaaatttaatttttttttcatctctttcctcgcgttttccctccctttataaccaccaccaccatctcgtctccttcctcccgctcgcttactgctcgactcgtcgccttcctcctcgtggcgagcgatcgatgaggacgggggaggtggcggaggcggtgccgagggtggtggcgatcctgtcgtcgctgctgcagcgggtggcggagcggaacgacgcggcggcggcggcggcggcggtgggggagaagacggcggcggtgtcggcgttccaggggctgacgaagccggcgatatccatcggagggtacctggagcggatcttccggttcgccaactgcagcccgtcgtgctacgtcgtcgcctacatctacctcgaccgcttcctccgccgccgccctgccctcgccgtcgactccttcaacgtccaccgcctcctcatcacatccgtcctcaccgccgtcaagttcgtcgacgacatgtacgtcgctgcaccaccactctctctctgtttttttttacttcctaattccccatttcacgcgaattacgcacgacaacgccaccgacagagttgcttgcttgcgatcgtcgtcgacagaattgtagattgattcaacggtggcatttgttcgtagcttctgaatttcaaattttgaaacttcaagagcaagtgtagataaaaaacgaactctttttctatcttgaaaacacaattgcataaacacttgcaccggttagattaaaaaaagttgcatattcttgtattatctagccagccaaatcaaatcgaactaaatcaacctgaaattctgagcaaagttgcataatgcagcagcagcatgatcgcataattcgaccttttttttctctttacaatcgcacaattcgactttagtagcgatgttgcttggcgaaatgtgatcgaccaatcctttttctttttcgttttttgaaccaaatgtgatcgaccaatcgatggatcgatcgatcccctttggattgattggcacacgagcactgctgcacagccccaccactgtaccacaggcatgtggtccccactcacagacctactagctaatcccctttttcacctagcaatagcattttccaactggcattggcaatagcatcaaatccaagccatcgagttggtcacaaatccaaaggacagttgtcgaattcgaggttgatgcggcggccattctactaccaaattcgccattcttaccaaagtgacagacaccttgggtgtgtgtgtgtgtgtttgtcctatctaccttctcacaggctcacattgccctcaaaacaagccactcggttttgtccgtttcgccattgacaagagctattgcttcggtgacatgctggctggcctggccatcattgatcagtggtctaaaactctgaatatgctcttcttcttgtcgtagtttggaatatgttttttttttaccgggttcgttttatctttcggttgaactggtcggtgcatacaattcaacctgatgaccgtcacaatgcgtcgtcgatgcagatgctacaacaatgcctacttcgcgagggtgggaggcatcagcttgatggagatgaattatcttgaggtggacttcctctttggcatcgccttcgacctcaatgtcacgccggctgccttcgcctcctactgcgccgtgctgcagagcgagatgacctacctggagcagccgcccgccgtcgatctccccaggctgcactgctgtccgtccgatcaggacgatgccggctgccatcacaagcagcagcagcagcagcaacaacagcagcagcatcagctcgccgtctgaatgttcaggagttcagaatcaatgagaagttcagagctcttcttttttgtcactggatgtggtgtcaattngccnctcttttttctcttcntaaatcttttttttaccgtgcttggtacataggtgttagttaattgtggttagtgaaagaattgagctttgattagataggtggatcatggttcatggatgggtcagcttcttgggatatttttttcgccattgttcgttcgatggatggatggatcatggataggtggatcagctttgggatcttgccattgtttaagtgatgctaacttgtgcgcatgtgagtcacagcacattgcatgtctcttgtttgcttcctttttttttctctcttttattttcctcttttctgaacattattcgcggcaggggcaagaaaagggtaggagagatatcatgggattgtggcgacaattgggttattggtcagaacatggcatgtttcttcaatgtttggacgaaaatgatcagctcagcatctctcatgaaaatgaaaattttcgattatatatttgatgggcatagaacctgaaaactctgaataaatgcagagagcaactgaaagttgtcagtctgaaatagtagtcagttgatggtactggcataaatgtcactggagtacaattccattaatatggaaagtccactagggcaagaaagaaccaattgtttttgttcgatctaccagaagagaagaagttccattgctttcttcatactccagagctctcctactagtttagttcgcgaaaaaaaaaaattttaggtgtcacatcgaatatttgacaggatgtcagaagaggttttcggacacgaatgaaaagactaatttcataactcgcctggaaaccgcgagacgaaattattaagcctaattaatccggcattaacatatgcgggttactgtagcacttatggctaatcatgtactaattaggcttaaaagattcgtctcgcgatttccatgcaaactatgtaattagtttttttatctatatttaatgctttatgcatgtgtccaaatattcgatatgatgtttttgggaaaaaaaatttagaactaaacaaggccttaacagcaagcaacaaacatgccagagttgcatcaggggttacaggagcagaagtaaatgagtcacaaaaaggaaaagaaaaaaaaagagaggaacacaattaaatgcaatgtcaattcacctcatgtacttgtccaaaagggccaagtagatgagagattctactacaaggagatggagagattctcatggcagcagaggcatcttgggcggtactacctctgttcacaaatataagctattttagaacaatactgagtcaagtatttttaactatgactgccagtaaaataaaataaaaatcaatgacttaagaatgatgttacagcaattagagttaaacaaactatcataatatgcaactctttttatttgaaataattatttttaaaaaatacttccattgatcaaaataacatattggtgaccatgtccaagtccaaaatcgcttatattcatggacggagagagtatatcagacaggtaattaaagggtgccattaccatgaacagtagatgcatcatgtcatatactatctatgcagatgttagtagtggagagcaaggaggaggggtgataagagaagagaagagaacgtggtgtgcatgaggtttgtagggctaaggcagtggttgtggagggcaaacactgcgtgccaacttttgagctgggggtgtaatatataatgcctttggccttaatgctgtgagctggacatgaacatggatggatgccggtcacaagaaattcggcggttgcaaatggtgatctgatgagatgaccagtgatgcagggcgaggtgaggtgaggtgaggcttaattgcagccaagtcagaaaggagaagtagtaaacgattccctctctagtctctatgctcatttgacattccaggtgaaggttatgtgcatcctaagctaatgtgctgtacttagtgatctaagctagtgcacttatactatattgtaactagcttgttcttaattgcggcaataacagcatacacaattttattacagatgtggtttgtattttgtatttttttaaatgaaaaggtcaaaataatttattttgagctattaccttatggtaagaaaattggatttgttagagtgtaatatatttgggggaagatgtgtcggtgggtaaatgtttaagctgatgaagcgtttctattggtagaaaactattatggacaaaattaaatatatgtggtgagaattggcatgtgggtactgaaccatgtgactccagaactgccaaagccaatggtatttgaacctgtgatgtgaagcctagctagctagctagcccatgcaatgtggatcagtggcctaaagaatcacaggagtaaaccatcagggacagtgatgattctttgggcatttgcttttcataaaggcttccatttgctttggttgttcccctgtgaaatggagatggattttggttgggagcttaactttatctatgtactttgatgccaatgcatgtgtgtgcctttaatcattcttgttgagttgctggtacatgtcttctgaattccatggcttccatcctttcttatcttctggaatagtgacaagtgcactaattgtggctcctatgcaatagaagtgaaaacagggatgtcatgagctcaggaccaccacaggggatttactaggggttgaagtatacagtaaaaatagtttcttttcttaacatttgaactcacaatatgaaattgatcgatgcatgatgcatgaaactcaacaatcaatttaacccgtctccagtaaatttgcacaaccttattaggtgcaaattttgtaaggataggcaggtggtaaacattacagaagccccaaaacaatgaagactgtactttttgatgttaaaccctgcagcacagttttcttgcaaagataagttgaccatcaaacaattaatgggaaaatttaaatcatgccacacaaaatttacaaaatttatgatataccaccctgacccacatgtcattaactcatgtgggtcctatacgtcattgagatacgggtggcatatctcaaattttgtaaaattagggtggcatggttccatcaaacccaacattaataccctatttgattaataccctgtctagaaacagtgacctctggcagtctaggatattgcttcctacactagttgtgtacaaccatgactactacagtaccacccagtagatcaccatcagataacatggaagctagaaacacttgcacatgatcgtacccagctcatacggggtgaccagctcagtacaagatgacaaaaggcactctatcattcatacttcggtctaccatgtgtttatttgaagtggacactattactctctatacataagacttcgctctttaaaacttgcgaagtctgggccgttagattaggatccaaagtttcacatatcctcttctctatcaatcgcacatcctcctatccggaggcatgattttgttaaacaggagagttgaacgatgtaattttaaaattttattaaaattcaaatttaatgtttttttctttagaatttgttgtcatgtgtagggcccaagcctaagctgacctacacgttgctccttctcatgctccttctatttctcaaaaatgaaagtgtataattctatatcggacatacaaaattggcattactagaattaccatatgaaatgcttttgcaacagtaaggttctttttttaaaaaaaactaacactaaggtttcttgaaccacagttttccgccttacctccctcgtttagtaaggttgccaaccttagctgttcgttttccacgcgcacgtttcctaaaccgtaacacatgtgagaatgacaagtgggccacagctgaattccaaagcctaaatgttaaggccttgttcaatcgcggcccatccaaatgagccccaaacggcaacacgagtaggcccaggaaaacgtaaaccccggcctgctagtagatctgggcccatagtgccgctcgtgtgaaatcaaacagatctcgtgctcctctcctcctcgtcgccgtctgcctcccaccacttgacaacaacaaagtctctctctcttctctctctcgcctcgacgccccaaaccctagccatggccgacccagccgctgccgccgccgccgccgagttcggggatcccgattcgccgcccgcgccggccgccgaggaggccgaggcggctgcggcggtgggggaggaggcggtcccggcggcggaggccgcggcggcgaagaggtggcccgggtggcccggggacagcgtgttcaggctcgtggtccccgtgctcaaggtcgggagcatcatcgggaggaagggggagctcatcaagcgcctcgtcgaggagaccaaggccaaggtccgcgtcctcgagggccccgtcggcgccaccgagcgcattgtgagtgccccgcgctagttagtttatcgagtgcctatgtagttctttccgttcaatttgtcgagtattttagaagctctaaatttgacattaaattgttggattgtctggtaggtaggatcttttcttagagatgttatttagtgctctgaattagagattttgtgagttagctgcttaggttgggtgtatattcagtaaaaattttgttgattgttttgctttgacttatatatgttagcctatgagttgctgcaattgttaattgcattttttgtcatgtcaaataatagagcagaggtggacaggtggtttatattattcttaaattggttaaaatttcaagccaaatttagagctgatgttgattgcgtgtagtattggtgtgtggtggtggccttattgtaattatgcttgttagggtggtcttatcctgaagttattggacttgttattgcttacgattgtaggcagttcatctctcaagatgatgggtagtgaacagatggcattcaatatgttttcctgcatttgtatctcgcctggtttggtgtgactcaaacagaacgatcttatttataatttggttcaaattgatgaaagcaataatctatcattctatctgttctctgaatgtgttcgaaattttgtattgggcactcacattagtgttgtttgcattattgtttagtcgtttgatgt

SEQ ID NO: 32264 - DNA, 7962 bp, Oryza sativa
taacgtatcatgtccattctactctggtcacagtcagtagaaaatattgtgggaaagtttcaaattagcacataacattgttgcgtagaaaacccaaaggcttaacttttctagatgtagaaagatatcaagggatcaacaaaaatgaattagtacaattttgtacaaacaaatgcgtgttgatggtattgtacttaaacaccctctaaaattttcaattaccctgaaaagtgacagcaatatataatatcaacttataaatttatgtagatgagcgagagcgacctttctatgtaattgaagatgaaaggatagttgagatccagggggaaacagagaaagtcctaaaagcacttcaagcagtttctaatcatctccggaagtttttggttgaccatagtgtacttccattgtttgagaagactgtaagcacatttatctcatgttttactttacccttcttatcaatcctaatatatgccgtttctgatttgtttctcagaatgctacagtaactcaagatcgcagcactgatgcttggactgatatatcacatccttcaattgtttctgcacaaataaaccaaccacctcctgtggttgatgaatatattcttccaatgaagagagaccctctgtttctcgaacgggaaccattgatagaccacaatattcatcgctcaggtgtttcgctttatgggcgggatcctgccttgtcaacattacgaacctctggaatacatggtggtggacctggtggccctctactttcacaggtatggttgatcttgggtttcacatgcatcttcattttttttttctgatgagctgtttgctggaacaaacatgattcatgtggttctttgattttgaaatctgttgtaatttgagtctcttttgcctttgattatgcatcctatccattaatatatgtttgccagttattatttatcagtacaaatatttatttcctcgtactgtttactgactagaacacgtggcacgcagataactcaaacaatgcaaattccccttacctacgctgaagacataattggagtgaaaggagcaaatattgcatacatacgagctaacagtggtgcagtcgtcacaattcaagagagtttggggagccctgacgatattactgttgaaatgaaggggacatcatcacaagtacaagctgcctatcaactcatccaggtaataccatggcatatatatactccttaaaattttgtattttcaagtttcagccataaaaatctctaatgtcatgtcctcctccctcaggattctctggcggcacatagggattctgtcaggagcagctatgcaggattagatccagtatataggccaagctattcacagtatggcagctcgacctatccgtcgtcgtcattgccatcgtattctagcatggatgggggtggatattcgtcttcaggtctcggtggatatgggtcatcttaccggtactaagcagttagtcgataggcttgttgccgccctgtatccatccctgggccatccttgtactgagccagcaatagatgttttgatggcttttgttcttctcggctgtagtcctgcagaaatcattgtgtcccggcaaatgtttttggtatatctgcttttgttagtgtgacagggcatgtggtttatatctcatcatggaaagatgcccctaatttttcatagtttagttgcattttttgtgattcttatggttgtgtggtctacctgtttgtgttgaaaacggatgagtcaatgcacgtgttatgttcatccaatattttcatgctgtaagcatatgaatgaaaaggaaaaaaaaagtaccgtgaagcataactgaagcataaagtcgctgttacatgtaatactttgatactgtgcccttctacaaaatatatgaaaaagaaatagccgtgacaactagatgatacttcaacaaaatcatttctaccaatacgatcttttacgtacaaagatagcaaaactaagggactttgaatcaaaggatttatataggaattttataggatttaaatcctatagtaaattttactatttggccctttaatttaaaggattgaagctttctaaatcctatgaaattcctatggaatggcacattgcatgtggattttgggggaaatttagcaagagctccaacctcttggaaaattttctttgagtctatctcttatccgattcctgcgtttttcctgcactccaattaaacgatcattcctgtgttttgcaatcctctgttttacacttcaatttctgtcagaatcctatgtttttcctattcctccgttttttctaccttgcgattcaaaggggccctaaagcttcatatttctagatgtacaaagaatgtgagaatatcactgcctaccgacaatattaagttgattggaccttcaaattgatcccgtatcccaatactgttgttgtaacgatgaactaatgaagaacacactaccgagcgtaaccacttcatcgtaccctgaaaatatgggctctgtgaaacaggcttttactgtggattctctggcgttttcagtgatcttccagtgaccaaaaaattagtactcctataattacaaggccacatagatgagccaatcattcaagggccaagcgtacaggacatattgttatccaaattacatctccagcggcacaaataggagtaactgttagcttctaaattgctgcaaaaaaaggcctacgaggaaataaatatgaagattactcttcacttgcatacaatgttgtctgtctgttaaagttgaccagcatgttccacagttccactagcccatcctgtagtgacaagaaaaacagtatatcagtcatatcgaattgttttattgaacataaataccatacttctgagttcaaaacatacggaacagggacgaaaggaaataagctgctgtagctacatgacacacttcaaagtttaggcaattcaactgactactcatctttcagtcatagcaatcctactgtaaaccttgtactcgctgacaaaatcactgaaaaatcctgaccatctggaaaactccgttccctcaccatatacaaacacacaacgggagagggaggagggatggagaaaataaaaggaaaaacacaacaagattcctctgttcagttttttttttcaacaaataacgattcctaccaaagaggcaacaattcagctctcctgcaaaagcacattgagagcctcagccgtctttcctgtataacaggaagaggatcttcataatctagaaaacagaaacaaaaatatgtttgcatagacggaaaacaactcgcaaggcaaaacatcactgcaaagaaaacaaacaacttcataagagatatggatgattgtaagggaagtgcatactttctctttctaccaccctgtccacccatgacatttctcatgtcgttctttgggatattggtgccaggggttcctgcaaactgcataggagacattgcagatgcaccagctgctgacataggtggcaaagatgatgatggtgcagcaacaggtggaaccacggtcgacggcactggtgctgctgggggcactgttgctggtgcaggtgcaggtgcaggtgccggagttggttcaggaggagggcggggtaagatgtgcttcaacctattgttcctatagtttttccagaagaaatattgctgcctatgagcaacttcctgcgaataatttgatggaaggaattagtttgtgctactgatgctaataaagcacaacagacaaaacagaattacgaatatgcagtacaatatgaacaaatgatatgcttccaatttgttcagttgccccctaactaattcataaacaaataaaggtgcccattcataagtctgtaagaacaacaataataaagttttagctcatccccattcactaacaatctacagtcaaagtaatacattccaaatacacttaataaaggggaaatctgaaaggatgttataggcggtactataaaaggttgaaatggcacatgtgtactaggaaaaagggtttcaaagggtcaccttgcttgctggatgggccattgcattccggaaattcgcattttggaggagctcaagaaagaaaaggcagtgcggatacctacacaaacaacaaccagtgtgaccaagctattttgtcacagcaagcacctactagcaaacagatctaaattatacggccactcacattatgtatttgatgtactccggacgctgccagtatttgagatacttgagatacccgataaatgcctcatcctcaaagtacctattctgtgctagatctgtttcaacataagaaatattagccaaatgccattttacatacagtattaatttcagtactcatttaacaagtttgattccattaaaaatagcagaagcattgagagtaattgggcataagcaaaacataatccagacatccataccttcctactgatcaacatacacttcaattatgcatccaatctacggtaccagactaccagcaaactaattactctaggcagtgtatcacgcttgctgaccaacacaatcaaattgctgtttatttttccttaactaataccatcaagtcaaagattaaacactaatttgttcaataaacctaatgaaaagatccgcggtaaaaccccaagccaagtgaaacgagaacgaggatacagtacagtacagtggatgtaggtagggtttgcgaggcactggatgaactcgagctccaacaagaaccgctgcctcgcgtcgttggggtcaggcgccggcattgcctccggctccatcacgcagcaagcacctgcaagtgttggagagagagagagagagagagagagagagagagagagagagagagttagcacgactgctccggctggatccccgatctactccggctcagcatagcaaggggggaggaatacctcgaaggccctggatgcgcgcggcactcggacgggaaggggaagccccgccgctgctcgcgctgagagccgcccttctctctctctctctcccccccccccttggacgaaccctagagcgaggcagcagcagagagggccgcggcggcgggcggcgcggcggcggcggcggcgtactcggcgttcccctttgcactggcgctcaggcggcgagggcaaaagtgaggaccgattagatcagggacaaaatcgtccatgaaaacaaactaagagcaaagataataaaaatggagtaaatttcacgatactacataatactttgataataaaactacatatttaataatgtgtttcataaaactatagatttagtgtcaaatttatcatggaactaatgtattatatcatataactatagatttaacaactattttatcataaagctacatatttacaactttaaataaataatagtgatacgatctaaactctagaacatgtagttctttgataacttcatcactaaatttgaagttttgtgatatggtgcattaaatctgtagtttttgtgaaaagtttgacgctaaatctgtagttttatgatactttgatccaagtgtctacaattttgtgaaacttactataaaaatgagaaaataaggagagaatggcactaaccggaatcattcgtaccgcgggacatttaatttattgctactttaagatgtggcaattaattatttgccactcgctatctataacatgtcagccctcatgtgtctatgacatgtggatctagtgataaataatttagcaccactcgtaagagtggcaaatagttaattattctctgaattaatagatgtgaaatgttgtaagacgttagtgttacatactagtaatttcttcgcatgagaaggggacacgatgaggatgagagaaatacacaatgcttcagcaaatacatgttttttgaaagttaaagtttttccctcgctattattttccaaccttccattgcacacaatttgatagtagaatctcatattgaggaaagatgcttggttgatttagatcacataggcttatctccaactataagggcccctttaaatcgtaggaatgaaaaaacagaggaataggaaaaacacaggattctgacaggaatacaattataaaacagaggattgcaaaacacaggaaaaacacaagaatgatcgtttgattggaccacaggaaaaacgcaggaatcagatgagagagatagactcagaggaaatgttccaagaggttagacctcttgctaactttccttcaaaatgtgcataggattacccatcccataggaattttaaaggatttgataggattcaatcatttgtttcaaaggccttcataggattttttttttcatagaattaaaatcctccaaaattcctacatttttcctacaaatcaaaggggccctaaaaaaagaaggaaaacctagtgcgtaaaaacggatgttaagttcatccttatgtaaacttatgggacgagaaaaaaaaatataatgcggttacactgtatgagctgcaaaattgtatgatggtcttgacactcaaaacgatacaaccgaacaacagctctatccaacgcagctccgaagatccaattactaaacccaatgatatctcatgtggaaaacaggtttaggtaagacaggcttggtgatatgaggcagacctcaagctacatactatatactagataactaaacacatttctttacttatgtataaaatttatagaacaagtccttgtatgtttctgagaaaataattataaccctttatgttataccaatgtattattggtgtattaaataacatgatacatattgatgaaatatgagatattccttgtattttatcttagggacatgttatttatggaacttgatagacatagctcacgttgtcgtgacaaacacctactaaaatacacacagtagtgtgatgaatgataacccctttgaaacgattcaagaatatgctctgctagtttactgttgttaggatcacctccattcgttttgatcaaagggactgtttggtagagccttttagatccaaatccaataaagttgaagttctatcaaatgattgagatccatgcaaaaatggagcagagtgggttggataactcttacaagtcttacaagttgtacttgtggtttagaagttctttaaggaaattaacattgatatatattggttgtaaatttgaaacacatattcatgtcttataatcgtacatcaaaataaacgtaagtaataatcatatttatcctctcatctctttcatgatttctgaagatgatagtagcttgtaagtattggagttggatccccaaaaaaaaaaagtattggagttggatcatgaattaaggatttaggacaattacatatttacaaacacatgctaggatttaagaggttgcttggcaaatgggttaggaaaataatctcacctaccaaaaaaaatatatttttaaatcctagccatccattattccttcctcattgttttcctaaccctttatccattttgctatcccaacagtatcccgcttatctcattattatcccatcacaccctacgactgtcaacgcttccaaatgggccctagctgcacggcgaaaccaaacgcagccacgccggcacggcacgcgcgtgggcgtggtggccgtaggccgtagccgccgcgccgcgcgaataaattagcaggcgagatcggccgccatcgcagattcacgggtcgagacggggcacagaccagacggcgcggctcctccccattcgaaaaagccacgggcgcatcgcaccgcaccgcatccgcgcggcggaaacggaaagcactagccgagagggacgtccacccacccaccaggccaccacccccccaccccgatccgacacggcacacgcccacgcccacgcccacg

SEQ ID NO: 32265 - DNA, 10947 bp, Oryza sativa
ccgcagcaacagccgccatggatgaggattgatctactccatgttgttggtatggcctactatgtgtttagtaatgtttacttctcattgttaactgctggtgttgacttgtgataattctactagctgttgtttgtgtttgggagggtgattaaagtagtcaggtgtaggatatggagtgggggagtgaggaggaggattaggagtgagtgctcagttaagctgcctgtaatcagttcagtgatcttgtgcttgagttgctgctgctgaagctgccttgtccaaatacttctgtagtagcatattattgtcaggtttttactcaatcagtgtcctgtgtcatgttctatgttttgatgatcctaagccttggagtatgtgacagtaacttgaagaagccttgcactgtagtaacatgtttttctccatgaatcaaattaatggctggtttaagggtactatgatagcttatcagttgtcatggacatctggacagctgaaaacaacactctggatgcatcaaagagggtatagcgaaatgtgccggtttcttcgcgcttcttgctcttttgcactcagaacaagactgaagagtatcctgcacttaagcttctaatttattcttttgttagtcaagtcttcttgaaaacaaaaaggaacttcgactagccttctgtcaaagttaaatacaaaacgaagcagaagagagtgctgacatcggtcctattattttaattgttcaaatgaaataaagaatgacaacaatctagtaggactatgtttcattaagccaacgaaattctgaggtaaggcaatgtttcattaagctgttttatttatatgctttccaactaataaatggtgtccttttgtgcgaaatcaaataaatctgtttttcaagtttaatatgtatgttttgggaccgaagtaatgagcctgatcggcacacaaatgcccgcattcagcatggggtcatagtgcgtgtggtaatgacagatctgcaagtgaattcctcagttcgcactgcaaatgtactcagacactaatggtcagttcaccaaaccatatgagcagagcaatcgtagtaaaggccaaaaacggagtcctcactagtgaaactcaatgcttgctcgtacctatggaaaatgaaggcactcatgagatgtccagaattcagccgttgtaatgatggggcaccgtctggttttcatatattataaaggatgattgtcaatatatttttactggaaactggattatccctagatacaatttgccatgtcaccatgattatacaaagggtctgatgtagacaaaccatctgtgttgaatcaggaccagacaaaagagcgcgcacgtcctgtcagtagtttggaaaataaacattccagttcttaagaaaaaaccactaacaaagtgcaaattttttcgctgaaaactaattgcaaaaggtctagcacttgataatagacgcagacttgcaacgtatcaacgtataattgttcaaacttgcatattagatatacatgcggcactccaatgaggctccaaaatcagcttcaaatttaaggttgaaaattcaaattttggccgataagtataagcataaaaaaaaaaaaaagatgccagaggccttttattattcatacattgatcatgtggtcagtttggttgtctcagaagtaagaatacatggacctgtggagagatgtgttacgaatttatgatccatttttcttcaagaaaccttgatataagatcgtcccaggtgtggaacaaatagaaatgagcattacaaaaatgataaagcaatcacacagtgcacaaccttcatcgagttaactcattcccgctgtggcacaacgaacattctgcaaaacaatatctcgaaagacagcttgacacacaactcacaaatcacagcgcaaacagaacatgtagagtaaaccagaataacagaacagcatccagccttgtaaacaaataaacagaaagaaaaacaaggaatgaagtccagcgccagccaatcaacttgctacctctgagcacaagattggcatcagttctatcaggccccgaaggcttcttttgtgatgcaagaaatcacatcttccatgttcttttgtgatgcaagaaatcacatcttccatgttcttttgtgatgcaagaaatcgcatcctacataacatgattgactgccaatatgataatgtagtaatgcgatgggaaaaaatgatacgatgagaattacttcctccgtttcacaatgtaagtcattctagcatttcccacattcatattaatgttgtctagattcattatcatcaatatgaatgtgaaaaatgctagaatgacttacattgtgaaacagatggagtaaagtttatctgacagtctgaccacccaggggtgcgactactaatcgaggcagctttgttcgaaatcaacctatcataagctcctctatggcgtacagtaagtttcaagacattttcaaaatcaagcaagatgtgccaaggtagttgttgccaaatatcaagcattgctccagcttacacaacaagcagcaatgagtatttataaatttggcccctcaaaaactacacaccagccaaaagctacataaaccataagatattggaatatcacctaacttcaagtgtctcgccatcaaagtcaaaacggagctaaggtcaatgacatatcccataacatatctcaatcttcaaacttatttaaaccagaatattagtggtgcaaaaaaaatagtaagcagcattcccacactagctgagcaaaatttccagacctaccagtgaagtgtatgtaagcatgaggcactgaattaggacatcctaattatacttattttttgtgagtagaacaccatgtggtactatctcagatttctacaaggatcatagggtaggcaaccattggttggaacaactaaaagaatgaaaacattacttatgaatgtcctattgcattcctttattcaaatccaacaatgtatacacataatcagctatccgcctgaaccttaatactagaagcatcacataatccatccatccagacaggctcatcttgcacaccttggcaccaacaaagcaatgagccaatcactaataaaacactaatcagggaatttagcgcaagcaatcgacatcaaattcaaactataactaagacaagaaaatgaaccataaccagtgaaaaattgacacagaacgtctcccaatatgcttctttaatagatccatactactaaacatccacacccacacaagcaggcagtagtaccattacatcagggtgattgagattaatttagaaaatccaaaaccattcattggctgctactcagaaagcgaaaagctttagaaaaagagaaaaaggatgagatggccgtgcaccagtaccatcccatcgccgccgccgccgccgcaggagagagctcagaagcggagcttggtgaagaaccacctgttcttgccggtcttgaagcggtcctcgaggcgcgccttggcggacttgcaggcggcgaccttcttgtccctggtggcgagcgcgtcgggccccgcggcgacctccttgaggtcgacgtcgagggtgtagcgggtgggcatgaggtgggtgaagttgacgagcttgaggaagcacttgacgcgcgacttcttcgccgtcttcttcgccgagtccttgcggatcaccttcttggggtacttggcgaggccggcgacgaggcagtggccgtaggggcggtcgcgggtgccctcctcgaacacccgcacgatcaccgccttccgccccgcgaacctcccctgcagcaggatcaccgccttcccgggcttgagaaacttcaccatggctgatatcctctgctgcgccgccgccggggaagatggagttagggttcggggagaggagaggctttttttaagctcttttatagtcgggttgcggagaggatggtttagggtttggggtggggatagaatgacgtgtttacccctaggatgcggtccgttagatgcgaatcgggcgggtttaattgatgggtagtggtggtggggccaatgtgtcagtggtaagataggtgggcgagcgtaggggcaaaatgggaagagtgggagctgggctgagatgggctttgcgctcgtgagtgccatgtaggcccagttatcagacggccggcacagcatctggcccacgtcgagacttaatgtacagaggatcacaggaattttgcatgatgttcagagatgtttttttgttttctgaatgttcttaggttttttagacttcagaacaaggcttaagataatgcatgcggcacatacaccatttagctcctaattattcttttgatagtcaagtcgtcttattgaagaaaagaaacttcgacaaagttaactactagtgaagaaatgaagcagaagagagtactgacgtcgccacgccggctctattttttttattattcaaagggaaaaaaaaagaatgaactactccaagctagatactatctcttcttgtagggccaaaattccgagctagatatcttaagctaccgccctgtacaccaacctattccaagccctgtctcgtttcttccttagcctgtcagcaatggcgaaagccagttcaagcgactgcgatgcattcagcctggggtcgcagtgcgtgcggtagcgagagctgagatcatcaagggtcaccgtcttggatccaccaatgcactctgtaacgttctgccctgtcatctccaggtgaatccctccagggtagcttccctcttgctcatggacatcgaagaaagccctcagctcgcactgcacatgtacaagaataaacacaaatggtgtcaatatgtcaaatattcatgtgtaataagtcagttgttcatcaaaccatgaatggtgaagtctcagggcttgttcagattgatgtcattttaaaccatacaattttttttactaaagttgtcaaatatgtacatccatttagtttcttgccaaactctagtaaataaataagaaaccatgctaaaacttggcaatattgtcaaattgccaaaattttggcaatgccaaaagttggtaaggtttatttttactacaatctgaacatgccctcagttcttaccctgatcgcgtcgaatgatcttgtcttgagaccacatggtgcgctgatggtgttcccatgcatgggatcactgacccaagtgacaatcaacccagcttggcggactgctctgatcatatgtgggagcttaacgcgcgtgttctcagcacccattcttgtgatgattgtcagtcttccgggcttgttgtgaggattcaaaatctcacacaatttaacaagctctgaaggttcgagcttgtcactcacctttttaacacagaaaaaattaactatgtgcatagacaactcgttttgtataacaaataacaataaccataaagtcatggctactgtacttatatttgcgatggcatggtaaacatgatatacaatgttttttttctggcggtctttcaaaaaataaatattttccccgacaaattagcatttacatctaaggctaaacagcataagaccgatgactgatgatgaactatggtactactagtaaatattgttacttgtcatttgagatggagcttaagtacctctagtagtccaatgctgatacatagtttgagagtttcagtagatatattacatattgaagatattggctgaaagtcttatacaaataagccaactttgaagaggggattggttacctttacacctagagggttggaaataccacgaaggaattcaacatgagcaccatccagttgtcgagtcctctccccaacccaaagcatatgagcagagcaatcgtagtaaagcccagaaatggagtccaccctagtcaatgcttgctcatatggcaaatgaaggcactcatgagatgtccagaattcagccgtcgtcatgatgggatgctgaggagtcagaccagcagcaaccataaatccgatggcatcgtgaaccctctcggacagctccatatacctgctcacagaaaaaaacaaaagaggacatgatcttggtttccattgtataaaggattattatcaatgatacttactagaaatccctagctactatttgccacgtcaccatgattatattaagggtctgatgcgtacatgccatctgtactaaataatgcaattcctatgtctgttgtttggaaaataaacatttgcattcatatgaaacaaccactaatatgcgtaaagagttttgaataaaactaattgcaaaatgtctagcacttgagctaagctaacaactacctgtccccttgcgtgctgtccctcaagaagtcaagattccactgggtgactctctgcagatctgcataccctccatgagcaaatcctctcagaagattcagggtgctcgcggactggctgtaggctctaattaacctttcaggatctggtgcacgcgacttctcatcaaaaccatcgctgttaataatatcacctcgataggaaggaagtgtcactccatctatagtctcagttgggtttgatcttggctttgcaaattggccagccatccttccaacctgaaatatacattgtcaatcagtcaatctctccacctgtctatcagcacttgaatcattaaatgttaagccatcaatggtttgaagaacataaacctcaaaaagaaaactgcaaatacacttttgtttgtcaatctagattccagaatagactaagatactgaatctagcttgtcttttaaacaatatgaatgcttatggtttcatgtgtgcactggtggccacgtctgatccctgtctttcttgctgctgtaccttgtctgtcaaatattggggatggaaattggcgattgacttgttgatccgttaacttaagactcatagcatatataactgctaacaatcaaccatctatgcgactatgcctttcagggggaaaaaacagaaaactgaatggatgaatccgcgctgtgccataatttataaattataaagcctgatctttcagaacttgacagcgaagtcgacacgattatgtctacatcgaccgatcgccatctcaaagagagattgtgaagatgacagctgggaccctgcaacagcttaagcccgagtgatcagccacatcacatatattcgttctatctgaatgcgccaaaatcccaaacagtgcagcgtgtggcggacaggaaacagataattttcgatctcgaattccaatcgggtataaaatggaggaagtggattttgatctcttgaggagatatctcctcgttgcttgcttgcatgttactcaaatggttatgaaaaaatttgagaagatgtattaacgtgtgtaatatatcactccacaaattcaaattcagcttctatatctggcaacaaaattaattgtgaatatatgttaactagctgcggttctacatctcgcaacaaaattaattgtgaatatacgtaaactagctgcggtttaattaatttaatttttttacgagatcgttagggatggattggagaaggagaaatggtgagaagatgaagccatgggagtaggcgaggaggaccttgatggtgggcatctggccgccaaaggtgaggacgacggccatctggagcatgaggcgaaaggtgtcgcggatgttgttggcggcgaactctttgaagctctcggcgcagtcgccgccctgcaggaggaaggcccgccccatggcggcgtccccgagccgctcctccagcttccgcgcctccccggcgaacaccagcggcgggaacgacgccagctcgcgctccgcgccctccagcgccgccgcgtccgggtactccgggatttgcctcgccggccgcgccctccagctgcccggctcccacccgctcgtcgccgccgccgccgcgcgcaccgtgatcatcccccgccgccgccgccgacggccggtggaccgggcgtcctcgagacgcgtggtggcatggacgatcgccgcgtgcccaacggtgagagccgccatggcagagtgacacgtcatcgagtggatccgcagccggaggcaaatcactgggtatttatatgtagagccgccgtataatactccagtcactacgtataatagtcacaatttttttagactaaccaaaacgaagcaactacaaatcggccgcatgaaaaatgcagaagttgtttcatcactagacttaaaaaagtgttttaaacaattacaatatcgtctaaatttacttgaaacatttttcaatcatgcggtaaacaacaaagatacattgattgaaacattaaaaaaaatcgtgaaaatctacatgtttcaaacaaatgcaacaccattttaccccaagttgaaatatttttctagcacgtatgaaacatcaaaaatccaaaaatataccggtctagatctagcttccgcctcttaggtggtcgaatctttagcttcttctgagccgaccaaaattcgaacaaaaacatctccatggaaaagataatgggaactaaaaacccgattagtacaccaacatataatagtcacaatggtgtacacacactgaagttgtactgtacgtctatacaataaccattttatgaacatggtacaaatatgtatacgttcataagtaacaacgcacatactcatctccatatgcatacacacacattatctatagcatatccgaataactggataacgaaaccgacaaatctcgctgtttctaattgagctacactcacctcactacggtaacctcaaagctttagggcctttttaaatcacagtaatgaaaaaacggaggaatatgaaaaacataggattctgacaggaatgaaagtgtaaaacaaaggattgcaaaacgcaggaaaaagaatgaccgtttgattggaccacaggaaaaacacagaaatttgaggagagataaaagactcaaaggatttcttccatgagattctatctcttgttaaaattcctctaaaacttgtatggaaagaggcatttcataggaatttcatagggttcattcctttaattcaaaatgctttgtaggaaaaatttctataggaataaaatcctctaaaattcctatgaatttcctttcaatcaaagggggccttaaagttttatttgattagaatattgaacagattatcgttttgattatagagagaataaattatttaagaaataaatttaacaaatatcttaaaatagaaaaatattttgagaagcgcaaataatatgtttaaataatccaaagacaaggaagtgtagcacaaataatccaattacataattcaatgaataaactgggaaaatgaccatgcaaactgaatagtccttgccaaatgatcacacgaaactgcaaacaaataattattttttttctttattatttacgctgcaggaaaatccggtgcagagtatacacggcagaaaatgcatcagaatacgcatatcatttggtctggcgatcacgtatattccggatcatatttacagctgcagcacaacgaccatggatgcatatggatcatggatggtcagtaggtgtcatactcatcggcggcctcctcttcgtcgtcgctcttcagctcggcgagctccgcgagcagcgccgggtcggcggcggccatgtcgccggggaccttggcctcctggatgatccgcatgatctcctcgacggcctgcgtcggaggggcggcgtccgtgtccttgtagtcggccttctccctctccgatatctcctttggcagattcttcagaaaccacgtgtgcttctttatctcagggatcgtgatcctctgaacatcaaaagttcagggatgcaaaaactcgagttagttaaattcagagggaatccatctcgttaattaattagagacatagtttgagcattagaacatataattgagatcatataggccgcattacaatgagtaagattacaggtagaatctgagtatgatttaaggttaattttcccttcggagtaatctaaagtttggtctagtttggcaacttgggatctcacttaaactgggaggtaaagtgtgtgaaattaagtacctttgaaggatcggcaacaaatatttgagatagaaggcgcctgcagtcggaagacaccctcacgtagtccgggatggagtattgcacgccaagaattctctgtcaagtggaacaaggcatgcatattcagagtttcagactcaccattgaagcaaggtgtagaaaaggcttggatgatgaacagagggaaatggagcacttacgctgatcgttttgcggaaattcctcggatcacctggatcttcaaacgggtatgaaccgacaagcatcacgtacagtgtcacaccacaggaccaaacgtctgctacctgggtaaggagacgcattacctcagatcatgcagagatgcaattctatgatgcgatgttccaggaacttcagtagcgtcctaacattactgaaaacgtaaagcttatgctgttcggtttgttttgcactcaatgtaagtatttcagctgcaatggatcacttttagctaacgtctaaatgctcaattgctacggttccatgatgctagaaaagaaaaaacaatagtgatagatactgctatctatctttactttacagccaaattcagattgcaaaacatagaaatgagaaataacttgccttgccatcatattcttttcttgaaagaacttctggcgctatgtatgctggagtaccaactgtagacttcggcttcgaatgcagcaaagcagactgaaaatcaaagaagccaagttgttcagtactccagtttgattctaccaagaaggcaagaacaattcaatctatttctagtaaagtactctgagatgtagaaca

SEQ ID NO: 32266 - DNA, 8141 bp, Oryza sativa
  unsure (1)..(8141): unsure at all n locations
gttctcaagtttaagatcacggtggcaaatttcctgcattttgcagaagcagttaatgaccacttaacttaatgagcttacgatgtgcctgttacgtctgcagaatttcaacaagcaaaacataccagagaatgacagtagctgacacctgatattagctgctggaagaagtaccttgcctattgacatgaatcaattattgagcacagatggtttgcaaaacgggaagattagctcacaagaagacaagtagggcctgaaagcaacctcgtcttcgctgaatcgccctgcggtgcagatttgttcaaagagttctccaccagcagcatactccatgacaatggctaggtgtgtgggtgtcaaacaaacctgctcttgatcgacacacaaaacaagaaatcgttatagcagttgaatttacttcgatcttaagacgatacactacttactaattgtatggtaagtaatcagccagggtaagctttgtgcttgatagatgtataaacccaaaaccttatcattttactttctacagtagcagtggagatcagctccatctagtttgactgtttgactgactgataatcagtgaagctgccgaacgaactgatgagtgaaaagaaaatctgaattacctccttaaaccgaatgatattgggatgccggagcgacctatgattgatgatctccctctgcacattttcatcaatctgcacacagagcaaaccaaccatccatgcatcatcaatcaatcaaactaaaagctaagactcgtcatgcatctggaacaacgagttgctgaaaacatcaactcgcacacaccatcaaattatcaatcagtccgacgcaagaaactgcgaaataaatcacaaaaggagagaagagaagacagagacagaggcagcatcagaccttcttgcccctctcgatgtacttgacggcgacgagctccttgctcctcttgtccctgaccagcctggccaccccgaagttgccggccccgagctccttcaacgcctcgtacctctcctccattggccccctcgaaacccaaacccaaagaggagaagtcgccgcggttcgagaccgaagccgaccacccaaccaacccaatcagaggcgagctaacctccaaccaaaccagaccaaatccgaagaagggaggcggcgaggtggagggatatgaaattctcttcgtcgccgtcaccggaaagcgacgagggtctcttggtcggacttgaagccgaagcgaagcagcgacggcgacggcgaggtgcgcgacacgtggcccccacgagtgccgtcgcttgtcacgtgggccccacgcgtcagctcagctaatcggcgggcggggtaggagtggggcccgtggattaggtggcgtgtcctgtgaatacgacgtggccgtttcgtcgctccgggttgccacgtggctccatgtacgtattatatggaggcccacgctcagaagagggcggtgtccagaaacatggagctgggcttttcttttccaaagatgctgggccggttttctaaagtgcaaaccatgggctgcacgataaattaattgattaatcagttttagctagtaatcgttagcaaagacgttggttaacttggttttcttgctagtttcgtagggatttcaaatggttatgagcagtcgttcaaaaaaaaaagatgattatgagccaagcaaaccatgggactactatcaattcgaagcatccgctcgagaatcttccatcgaagatttggaacaatgttgaatttcttcgatgtgacataaacaatctgcctggtcgtggttcactactgtggtagtagtactattagattactctaattattgcgcgtggctgaggtaaaccatgacacattagtgctggaattgttgcatgtgaccgagaggtaagattagcgcaagttggcttgcaatttctttgcgaaatcgtatgatctgctaatattccgtgtggctctgccccttctcgtgattggagttgcgcttagccgtcgtaatagtcattttctttttcttggtttttttttgtcttttcttctttttcttggcataagccagtctgtctgattgcgttatgtaaacaaatatttttttttaatatattgacttaattgttttgcgcgttcggaaaaaaaaatctgcgaatattcccagctgaccaaaatgggaatggacgacgacgacgaggtcctcccttcttcgcttcttccaatccatgggccgcaagtccgcaagggccgcgcgcacgtgggcgcggtgcgggtcttctttcccaaaagaagtcgggggaaagcgaggcgcaacggactcggggcccacctatcgcgtaggtagtaggactaggaggaggcatagcccgtctcgtctcgacacccctccgaccccgacgcgtcgcgcaccaaacccccccgcccccaaccccgacctcctcccgtgctccgcgctccgatccgccgccgccgccgcgcgcgcgccgccgggggagtgcgccggcgtgtggtggtgggtgtgtaagggtaggtggaggggtgggtgatgcaagatcggccgcggcggcggtagagggggtgtgtgtgctcggctactccggtgggtcgggtctgggcggggtgcgcgtggggatggggtgcttccagtcgacggcgaggcgtccgcgcccggggtacgaggaccccgtcggcctcgcctccgagaccgcctgtgagttgttgttgctgtacttgccacttgaggagtactctacagtactgtatttcatttcatttcatcaagtagttcatctgatttatgcaatcgatgggcgtactggaaattctgagttagttgttttggatgtgtagttagcgtaagtgaggtggaggctttgttcgagctgttcaagagcattagtggttctgtgatcgacgatgggctcatcaataaggtgaacatctaactgtttcttgggggtatctcaccatattggcatcatggcatgtgtgattatgagcatcctgatacatttactaatctgcttttatagcttgttgtggaattacaaaattagaccttgccgcattcgaatatatctactgttccgtctttcatcaccatattggcatcatgtcatgtgtgattatgagcatcctgatacatttactatctgcttttgtagcttgttgtggaatgacaaaattaaaccttgccacatttgaatatatctccatgtactgttccgtctttcgctggatatgagaggaggtgctctcatatcggaatttattaagaggggagtgaggctcgaacctgggtcggctagcccacaacttgtggtgctagccagaagacccccacgcctttctcactgttccgtctttcaggtttcagctgcacaaattatgtggtggatgccattttctgtgaatcgttttgctatgctggcagttctattcattcatctttgaagtgagcatgaatctttgttgtacacaccccgatcctttattcctcttgtaccgctcattgtattatgtgtttgccttctaaattgttgaattttctgtgtatcaaaatgtgatttttttcctcaaagtttaataggaaaaaacttgttcctgatataaaccatctggctactatcacagtataacaacacaatgatagttcaaagtttgagtcactttcttcctgccttgtcaatattgatttgccgtgctataaagctagacataatgcgtttctcttgcatcttcacttttgttttttgcatcttcttgttgcgtcttgcgtggcgaagaagttcattaactgctatctgagaagccatacaggttcatgcacatctgctagttctcatgaactataatcttgacgtcatcagtagctaaattcacggtatgaaattagggactacctatctaacgttcgacataaaatccccccaaaaatatgccgtaactacaacacaataatagtgtaattgctgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctgctgcttgattgactgccagctaacgaggcactcgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgacgagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcaaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccgactcttcctcctccacccgtgcgacgtgggcctggccgcgtcgtggctgtcgacagtctttggcccaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32267 - DNA, 3369 bp, Oryza sativa
  unsure (1)..(3369): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccgcaccgatccagctcgcctgcagacaacgtcaagggcttcaacaactgttcctgagaaaccagctatggcttggaacattcctggcaggcctgtttggatgttgttcagtgtcattgatctagttacctccactgccttagcatgccttgtcatttcgtcctccaccttccgccgacattgggcaatctcggttttcttctctgcaagaggatcgcgggcatcgaacgaatggctttcaatgccatcgcgcccactgccaggaaggccaaggccaaccattgaataggattggtagtacttcttctcaatggctcgaagtgagttggtcttcttttccagctcctttgaatatgtctctgtccgcttttttattttcatctcctctgcctgcttagtgtagatgacatggacaacattcacgaagctcttgatagcctccgaagccgaagcatctggaagccggtccagtgcttgcttccactcatcacagaaggtggtgagttcacgagagatcagcgaggtgtaagcctcttgtgggatattactgtccacttggaagagtgtgagcttcagccagccatagagggcacgtatataatcacgttgatacttgatgagacggttgaagtttgagtgccatgctgagacagcagcctcaagatcacgggtggcaagccggtgaagatcagatgttgactcagccatggaattgtctaccagaccacggacttgctgaacaatttcattctggatctcatggaaatggttcattgatctccacatgctcaacagcctgcatatcaatattcagatacaatttaaatacttgcacacaatgtcgcaaaatctggtatcatagatgtcagaacagggaacaagtcttacgcgaagcaaagctcgacaagctgtggtgcaagctcattgtcacgcaccctgacaatggctgaggatgtggtagttgcggcctgtgaagtcacgatgatcaacgattgcagcttgtttatggaggccttggtcttatccagcttggtactatccctccctctgtactccaggctctgcagagtagaaagcttcttctcgtgctcaatcttaacgctctctctagcctgaagcagtaaaaagttaatacatatgggaatagtttcaataaagtttcataaactgcttagagaatagaagcatttagtagacaccggacagtaagaatccattatgttctagattgcagaaataaaaagaacattggttagtctcactcaattatcgaatagatatggtataagtctcatgcctaccaagggtaatgcccctaaaggcctaaacatctctggactctggtgctttagacatagatacgctaaatctacctttggcattatgaggtatatttatgtgcagtaaagacaatttcttgaggatctaaaccttcacccacaaagccacaaagaatctcaaaggacaggagtagtttagatataaaaagagcataaaggaagggtatatgaaggtgtggttgagagatcaatggccatgtattgtgcctgcttcctttactgaaagtagtgaaaaattatcaaccaaatgctacagctgtttcagaatccagggtaggcaagtgcaggacctctgtaaagacgctttatgcaatagaatcagattcttctaccacatttgctgaacaaaaggcgggctgctcaaaacaccaatttcaaatgaggtgaagcttcacctaatcgattagaagctacaccagaagtgttaaagttagcctcaattcatccttgattatttgactgctaggtaggcctatgctgcaatgccaagtgcaacagttcatgcattctattctagcatccaacaagggtggctactagaagattacacctcattaaacttgcattgctgctaaagttgtgcagtgacctaaattatcggttagtccactactatgctctagcaaatatatatagctggataattttcaagtggagccaagtgaatagtttgaagatgcttcaccgacaacgaatgattgaggcgtgcaacaaaaaatgtcacagcaaacaaacacctcaattttagtggtgtgctcatctattaagtataaccactaaccagcagtcaagaatggcattgtaatcaagcgtcgatgagcagaattaccttgacctcctgatagagctttttctcccaggccaaaagacgctccagtgtcgacccatggctcttcccttccattgactccatctctaacgcattggtgtccaacttgtagcgaacagccaatggtggctttgaagtccatgtcgacgacagcgacgatagcaagctgttcgagtggtacaccgtctctgcaaaagaagaagtcaaattaagtgaaattgttaagcaattgcttgcgttttttcactaaaaatgtacattgccacaccaattcaaaccacattatagtttttgttcaagcataatatgtctgctatgaatctctgattacttttgagctgccggaagttgcggtccagctgcgcgcggctagcctccaggagctccgagacgccattgccggcctcggccgccttgacaaagtactcctcgatggcggccacgatctccgccagcgtgcggtggcggatcaccatccgcatctcggcggccgccgtgaccgtggaggaggagtccccggcctccgacctctcgtccctcctcctcagcggcagtggcagcggcgcggcggcgtactccgacggcgccgtgccgccgtactccgatctggccgcgaagccgcactccgatctgttccccatttccccctcctccgatctggtctccgaggtggtcgtcgacgcgtagtggtcgtcgtcgtcctcccatccgccgcaatgcatctcctcctccctctcgtcgtcgtcgtcgtcgacctcgtcctcttccttgaggtggtgggggtggaggtagccccgggccttctcctcctcctcgagctcgcggaggcggttggcctcctcgaggtcggccttgcggcggtcgaagaactcggagtccggcggcgacggcgggtagaagttctcccagtcccacgccgacgacgacgaccgcgtccccaccaccggcttccggaacgacgaccgcgccgggctgg

SEQ ID NO: 32268 - DNA, 2335 bp, Oryza sativa
tggatcaatccaatgccatatacctttgtttcttcaacctctcctgacggtgctttccaaccaagaactcaccacggccatgaacgttcaaatcatgctttgatttctgtcgccgacgacgagcttccaccgccatgcgtgctattcttccccggcgacggtagacggctagacgcagtcgaaccaattaaactacgatcggatttaacgactgacaacttttgtatttgacctatctcgtttaatttattgatgctctattcatatattaagcaaacctcttcatattcttagataggagtagatagatagacttaacgactgcacaaaatacaggggcaaaaacaaaagaatcgactcgatcagggtaatcttgctatgaaattttcaacaccactgtaagctagaatctaagattgcttatctagctagtcggtacttttacttactagtcagtttgacttcaaagatgcaagaatttattaagcacataaattgcttaacacaataaacgtaacgcaacaggacaagctatatagattaattagttaattaattaattgagctagcgtcaggcaggtgagcaaatgagaccagcagctttggttgattgattctttgaccaccctggcgtagcaatttgattcttgccatttccagccagccactctcacagtgtcatctccgacttgtccatagactgcaaaagaacacatactcctactacatatgcatgatgctagcctgtatgactttggaccggctagcctgactaatttgtatattgctgttgagcgttaactcgatactgtacatgtcgttagctgaccggtaaagaatcaccaagttaattaattaaatatagctagctagtagtgttactgatacaaatttaagtgactctttttaaagtaattgtttgttaatatttgaagactagttgcgtataactctagctggctggtatatatgtacttagggtgtgttcgctactccagtttcctaaagtgcacagtaaacacgaaaaacgaagcggtccattagcacgtgattaattaagtatttgctatttttttaaaaaaatggattaatttgatttttgtaagcaactttcgtatagaaacttttttaaaaaaacgcaccgtttagtagtttgaaaagagtgcgtgcggaaaacgagggagatgggttgggaaaaagggtttgcaaacacacccttaattactagtgaagaatgtttgcaagaacaaaatttaaagcaactttgaattgtaatccaaataatatttgaatttttaaagtttgacttttaagaacaagtttaggtagattcttcttcttctcttgttaggaaaaacacacatgcatgtacactaaaggagagttggaagttatgaagaaaaacataattttatcctaaaatcaaactaaaaaaattaaactaagctttgattatgcgtggaagttagggagtcaagtctacactctatatagactcggattgaacggcaccgtggactcctattgtctatactcaccgccgtgcaccgttgtactccctccattttttaatagatgacaccgttgactttttctcacatgtttgatcattcgtcttattcaaaaaatttatacaaatgtataagctataaatcacacttaaaatactataagtgataaaacaactcgtaacaaaataaactataattacgtaaattttttgaataagacgaatagtcaaacatgtgagaaaaagtcaacggtattatctattaaaaaacaaaggttatatatatatatatatatatacactctatatgcaagatgaagattcctggaaacgttctaattaaccaaggtagtagctaatcacgggttaattagagacatcgtcagttatagctaggttacaaacccatggatgacgcatatatagtcgtctttttgttttgactgtccatgtatccaactgtaaatgcaatgggatgtttacgttggaccattggaagtttggaacaaagccctgcatgcctatgtgactattgctgagttcgttaggcccgtagaacacgtgcgggaagcgtgctgtctcatctgaacgggtgcaaattaaaatggattattattcactggattgtctatttaattatagggacgaataaatattttgatggataagcttaaaaagatacgtactcgtgatctaaataattcatcagaaaaaaaaaattctatttcaagacagtgtgaaataaatatactccctccgtttcaaaatgtttgacactgttgactttttagtatgtgtttgaccattcgtcttatttaaaaaatt

SEQ ID NO: 32269 - DNA, 8357 bp, Oryza sativa
cgtgctaaaaagtcaacggtgtcaaacattttgaaacggagggagtataatattagttcagccaaatcttgttcgattaatgcccaaaaggaagaagtcggagggattaatttcacatatccatagaagtggaataaattgaacctctttcaagggtccaacagggatttaccgaggaattgatccgcaaaaggtaggctatagttggccaagtttatatgaaaggattgtcgatagttatacttttaatgttttacagatatactaataaaaaacagtagtcaagtttttgattgcaacatttgaccactcgtcttattcaattttttttacaaatataaaaaacgaaaagttatgcttaaaatactgtagataataaagtaagtcacaaataaaataaataataatttcaaaaaaaaattgaataagacgagtggtgaaacgttgcaagcaaaaactcaaatcccttatattatgggacgggggagtacttaaatatgtgcatcaagattgtatcaataaagacctaaacaagaagtaaaaaagggtggggatgaaaaacgtagtactaaaaaacaagtcaatttaccggcaaattaagagaaattagaaatttggttgtaattggaacgatatgatggaaaagttgaaagtttatgtgtataggaaagttttgatgtgatggaaaaagttgaaagtttatgtgtgtaggaaagttttgatgtaatggaaaagttggaagtttgaagaaatattctggaactaaacacggcgaaaagtaggccatatcattttgctgttataaaattaaattgcattcttctactggttacacatacctgatacgcgtactgcctatagacgtgtagtagcacgtgcactgcatgctttctggacacggccaacttaactgtcgtgtcgtcaataggaacagacgaacgatgcggtttcattttcattagccgatcgatcgatatctcctgcctccgctacttgccaagttgcactaacatgcgttctcatttttattttgggtactgctaccttcgttccatattttttttaagtcgaatttatttagctttatcaatttttttaaaaaaacataacaaaattttcaacataaatcaaaataattataataatatattcaatgttatatttaataaaactaattcggtgctacgaatatatattactatatttttttcataaatttagtcgagcttttttaaaaatttaagtttagaaaagtcaatccagtgggagtaacttctaatacacggagggagtacaaatcattctaggaccatgatacagcccgcacatatgcatcttggtcggcaacgtgtgacaagaggtactatgccatgcatgtatcaacattgattcatatacaagtgattacccaattaaaatctaaattcatgtctaaatatttgtgtataagggttaggctcagcttgaaacgtattatagagctttttagaaattatttacttgattatgaggatatcaaatgctttaataaacaaatttaacaaatagttttaaacaaatgatataaggaatgaagcataagattttttttttagaaaatgcatttttccaagcgtgaaataaacaatccatttcaacattttgataaacaaaatctgaatagaaacacgcggatgttgagttgtacttactttataattttaattttaataaaaatggattacagcttggatcaagttttgttatcagagcttttttttgaattatctttttaccttggaccaattaactttatatttatttttcaatttaagatcattatctatcagaatttaaatcgtagtgacaaggtttcaatataatttgagtaaatttcataaaactacaggtattttgaccaaattttcacaaaactacagatttaaggagttgtatcacaaaactacatatttagcactaaatttatcacaaaactacagattttagattaagtatcataaaaatgcatatttaatattgagcttatcacaaaaataccacttttggagtttaaatccctagcaccattgttatggtggagctataaacatcattactttgtgattaaattgattctaaacatgtagttttgtgataatttagttactaatatgtagttttgtggcacttcatcttaaatgtgtagttttgtgataaatttggtgttaaatgtgtagttttgtgatacaccgagttaaatctgtagttttatgataatttggtcatagtatctgtagttttgtgaaatttactcatataattttaatgggacacgctgatcccgttcgtcaccataagcttgtctcatagacgtatccacgcgtatacgggtgttcgcggatcatctccatctcatatactccatctgtcaaaaaaaaaaaaaaagccaacctagtagattcaaacaccactatagactaggatgtgccatatcttagtgctaagttggctttttttttcaaccgagggagtgcatgtcttacaagacaaatttgtgcatatgtgagcgtggtgtgatgtgtcgtgggtttaagggacaaataagaaaagaagatgcttttcataatgttctaaaaaaagagatggttttcagaagcatcgcacgcaaggggcaatgtggctattagaacagtcactctccacccttagctacagctactacaagttgagacgacgttgatgttgatctcgtcgtcacaagtgagaccgggactagtactcggaccagagaagacaaacactacgacatgatagatgcggcctcctcctcccttcgtgcgcctcgaaccctccgcgaagccgccaacccccacccctctccccctttaaatcgctcgctcgcgcgccacactcctcgaaccaccaccaccaccaccacgtgttcgatcgcgtcctccaagccccagcacctacgcgtcgtcgcgccatggccggcttcggcttggaccagcacctcgacctcatccgcgcccacctcctcgaagacgcccaccaccacgtcctcgcgccatcgccgtcgccctcgccaccgggtactgggcgtgtcaggccggcgcccgtgtcgctgcccccgaggccgccgctcctgtgggcggcggcgtcggcggcgccgcggcagcaggaggagtgcttcgagctcggcggcggctacgcgggggagggggagggggaggaggaggacgacttccggcggtaccgcggggtgcggcagcggccgtggggcaagtacgcggcggagatccgggacccggcgaggaagggcgcgagggtgtggctcggcacctacgacaccgccgtcgaggccgcgcgcgcctacgaccgcgccgcgttccagctccgcgggtccaaggccatcctcaacttccccaacgaggtcgccgccgacgccgccgtcaagtgggcccctcccgtcgcccctatccccgccgccgccatgtccgccggaagaggcaagagggtgaggtcggaggagcagtactacttgagggaggtgaagaaggagaggctgatcatggcgccgccggagaactcctcctcgtcgtcgtcgtcggcggcggcggcagccggagacatctgggacgagctgaaggggatctgcagcctgccgccgctctcgccgctgtcgccgcacccgcacatggccttcccgcagctgttcgtaagctgatcgatcgctagctccggccatggacggcgccgtggcgagcttggagtgcagccatggcgcgcgcccggcgcggtacacgcatggctgccgcgtggtggtgtccgtgacgtcacgtgcgaaggatatggccttaatcctgaattagatagggtgttctttgattaattcgctaaacttcgtaatattaggtaatcgatttggctttcggccaaatattgaattctttcgttctattgctgctcaggtgatcgatgatcatagtagcttcattgcgatttgtcaatgaaatgatataaatatgtattaattacaagttgaagagtactaatgaagaacatcagaggctcagagcaattgagcgcacatctcgttaactccagtctccttttggaatgattggctagtagtacttgtaagacatcgaccgttgaagtcgtgatgtttgctttcttcttttcctttttagaacacgtgattttgcttttgactatgctatttgatgattaaacagagaagaaatattcgtcttacaagatcatatcaccgaaaagactagctaggcgcatggagtagtactggaaacaagctctgctaaggccctctttgtttaggcttaagcttattggactagacttttaagccagctgtggttaatctaggcccattttggaaaaaaaaacattagctgtaatttttctcgaagttatatatttcttgcactaaaaaattaaaaaattagagagataatttgagtttctaagatggattatttcattcatattttaaatagtaaaaacggaacactaaatctctatgattttattcccttcgttcaagtgtaaatgtcagttttaactttagattggcatattttgatcaacaatatttttcaaataatctagcatcaaaattgtatcattatatttgtactaagagctttactaatactctcttgcattcgaatatgtttggtttgacacgcttagaaataatggtcaaatttcatctacctctaataaaaaacggatgactagtaggagtagcattcagactattcaacgggaatcccatcccgggccaactgatggagtgtgccaccttccggcccagggatggtcaccctgggccggctaacaaggatacggcccagatggatgcgtggacctctggtagactagcagcagtgcggcccatgtacatcgcaggaatcccgtgtgagccgaaaagattgaccaaataagcattatgcttttttttagatgggagtagctatacaactattgatagtttttgggatgaaaaaatttcaaatataactactatataattacattgtaactactatataactactatataactaatatgtaactcgagtgtaactcaaaatagcctgatgggagaactggttaggggaacaaacctccaagttggaggtgttgggtttgatccctacagcacgcgtttgaattttttaagccgttttccctcactagcacaaatctcaaagcatattagacagcttaaaatttgaaagttttcaccccctgttaactgtcgccagttggttccctcactagcacaaatctcaaagcatattagacagcttaaaatttgaaagttttcacctcctgttaactgtcgccagttgtatagcaaatccgttttagaaacataggcattcacaacgccgcgcgcagacacaccatatctatatgatatctatatgagttcctcctaccactaaaagaataattagctgtaaatgcgagcactcgtgttaaatctaggatttgaactcggatgagctagttccaccacaagaaatctaaacagttaagctacgttcaactacggctgaattgttgtccacttgagagagttctggtcacaacaagtcagcaatcaggatattggcgagaagcctactcttcttcttcttgatgaatgttgccaatgtggtatgtgggcacaatttgcacaaaatgatgcttgtgggcaacaactttagctgcattagcgtcatctaattcagaacaaaacttgaaacttttcattttcctttttttgaaaggatctgaaggctgaatgaagcttgtaagcaaagtggaacacaaagcttagaagcgacttcactgatatgtgggccccttccctactgtaggtcccgcgccacgtcagctctcgacggcgctcctcctccaacttccaagtcgccggagcggcagttgggccagttggcctgggcccacttcaccccaaccgaaagccccccatcaaactgacatgtggggcccacccaaagcctactatctccgcgactaccggactggcagttgggccagttggcccgggcccacttcaccaccacccgaaagccacccatcacactgacatgtgggcccccacgaagtcacgccgcctccgtcttctacctccgcctcgtcgtcacaagtcacaagcacaagaggcgaaagcgcggcgccgtcgcggagaggagaggagggcgacgagggggaggcgattcccaaaccctagctaccctcaccgccgccgccgccagcagcgatgatggcctacgcgctgcgcggtgccgccctcgtcggcgtcctcctcctcgtcgtggcctccccggcgctcgtcccggtggcctccgccgtgcccttcatcgtcctgcacggttagggtttttttttttctctcgcttgtttgcccccctaggttttgtgctctgctggtgcttggatttcgtctgaggttttgctggtcgtgtgtacttgtctgtgtccgggcgcacgcagggatcggcgaccagtgcgagaacggtgggatggcgtccttcaccgaaatgcttggggaatggtccggctccaagggatactgcatgtaatggcgccttatctccccccatctctctctcccttgtgttctggaagtggagactgttcgagctgtgatatttgtgaattgtgatgttgccttttgttatgacgagaaattagttgctgtttcaagtgcaatactagtgctctggtttccattaatatatatgtacaggctattaattaattatttctttgtttttccatgtgaaattgttaatgcgaataaatatagatgcccaaattagatatggtagccttaattatatatccttggggttggggaggtttaaaaaggaatagattgaaatactccacacatatttagcaaatcacgaggataatgaagtatgatgagacgattactgtcaagttccatttgttaacttgtccctgcaattttgtgaggaggatctgggagtaacatatacagttttatacatttgcaaagtcaaccacagtttctgttatggtatgtacacccaatgtgtgatctcacaaccaaaccaattgatgtcccaacttcttttttgagagtttagcccatgctgcatttgtttcagtcaaccacaataactgtttctgttgttggatgcctggagattttatcgcgacattcacctctttcttacacgtttgggtattcacgtaatctgttgtttcagtatcttatttttcgtaccttaccatcctgctctctatttttagttaaatgtcaactgttgtatgaagccaagtttgggcaattcaatacatcttagaagtctcctgactttatgccatgttgaggaactaatatgttgtctgttccaattgcttttacattacttagtatggccttcctggctgttggaagtgaatttaacctgtcgcagtccatagtggggataatgaagattctgatatgcttcataattttgtatttgttcctgtggaatgggccttaacaaaatatgcagaaacaactattgttgaaaaattcatctagtattatggtatgtacaccctagtgggtgaccttacaaccaattgatgccacaactttgtttcttgagatgtgttacatcatatatcagtacaaattttaaaaagtttggcacatgctgcatttgtttgctagtttacttatggagattaaatgtattcctcctcagtgaaattggaagaggagcatgggactcttggctgatgccacttcaagagcaggttgatttcttgcccttgataatttcctttttttaaaaaaaaaatcaaatagactgttcttgtacaagtttctgagattatgtattcatctacaggcagacactgtttgcaagaaggtgattcagaacctccatcacttctatttatgtactgtatgctgaattctcaaggtactatatcattgctggaattgattttccaggtgaagaaaatgaaagaactccgtaaaggttacagcatagttggcctttctcaggtgtgttcatgctattatgctattttatgttcatgacaatagctttattgtaacatgcagatctgttctttgcttcttgtacctctatgcattgctgttcttttgttatgtcttcttttagtcctaagcctatttgatcagtcttggttaacccaaaaccaaaaaataataataaaataaaaataaaaataaatcaaacgaggcctgtgtggaaaaaaaaaaagtgattttcctctctttgtgctgctgccgaacgcaaccttaggcctgtgcggacatgtctcgcttttgttctatgtggacctct

SEQ ID NO: 32270 - DNA, 4954 bp, Oryza sativa
ccaatccagtgctcacgaggcactaggatgatggatgaacaacaatttatcagcaaagtggcaggttaggtttgagttaaacaatgggccaaacgccgtttattaatgcgttgcaaacctgcagaactacaactacacaatgtgattgtgcagaaggccggccaagttgctgtcatgctaggacaagcacatgattggggctcctcctagctcagaaagatatgtagtaataaaggcatcaatgttttgcacagatctacagcaggagggggctgcactgcactgcatgctcccatcttgtgcaaatgcaatattgcaatgtaatgctattgctatgcatgcatgcacacacaggtgacagccactacacaaacacacaaaaggtgatgaggagaagaaaacaaggagtctagttaagatagtagcacaacaggacaagattgaatcaattcttgccccccccccccccccccccgcctcatctttatttcacttcaaaaaaaaaaaaactctggcaatttgattgtttgcattatctttgcacaagaggcatttgatcttgtggggagtattctattttacctgatcccaagcttgagctttctctctctctctctctctctctctctctctctctcactctcttttctctcttctctctgaaagatgtgtagggaatcttcctcatcatttcagtacccaagaaccatggacttcgtggctggagagaaccacatgaaattgtgacagccaatttatctcaggatatttgtgaaatgagacagtgacacacacatccagccaaggtagagaggaaaagaagtgaaaaaaaagctgcctcaaactcaccaaactagcaacttgcagtgcattctactagggtaaaccaatcctcctgacatttgttttcatctggtgtacagactcagaatctttttgcccacttttactgagccctcctacatgccactactgaactagtatcactatcttctaagtacacatatgatctttgagcttataaactgataagctacatctgaattaggtagaataggagagtgccattggtgacaacagctgcattctggggtggtttgtgtcaaatgttagtgttgtggttgtgtggcactgtagggtggtcaaaatcctcccctgattcaaaccccatttgtggggtctcctcattgcaaaggcaaggcagtgtgtaccactgtactactgccctaatccaattattagttcattgtgttgctggggccaatgcatggatcccaacttgcattgctcaaggtgatggatggatggatggatccattttgcttctgtggtcttggaaaggctcaagtgttcaccaaaaaaaggcagcagcagcggcagcagaggaggaggaagagagtttagctagtgatgctgagatgctgcacagtgatgaacagagcatgaaaaagatggggccctgcttgcctcttccttcgtagattgtgtcattgttgtgatgaagaggcacgcttgatttcgcctcaaaagaatgggagagatggctctcatctcatctcttcttgctgcatatcacctgtgaatctggctgtgatggggtgcatggattggtgggtgtgcacatttgctatctgggcgtcctcccttccatcattgcgatgctctctctgtatgtgtgtgtgcgcgccatggtaaaaaagatgatagcaatggcagagcagaggtgtccttttctcctatctgcatttcagttttcatccttttttaccgcccggctggctttactctgaacagatttggaacattagcatggattaattaagttttggacatgtatcatgttaatatggtcaacatttgcacgaatacatacactgagagcaagtgcctgcatctgcaatatgttaactgttgcaggtgcagcagggatgttcatgtctctgccttgcattgctcataggagaggactgtgaatgagaaactgaagctcatggtaccacaagtccacaacacaagcacacgttttaaggatgagaaaaatgtgtgctcatgcaaccaggtctccagttgcatagcaaatcgctcactcacacaaacaagcaagggagggacaaagaatcaccacgctctgtagtttgttcatcatctgatatgcaaatatgcaatgcactcaatgaaatgaagcttgtcctacatggtaggacatgccctgtttgttccaaggtgacacaggaatcagacaagcagatacacatctatccaaaattccagcaaagtcttggggtgacatcctgacatgctgtgtatccatcaggagaccagaaaataaggcgagctagctattacataggcaaagataaggttctgtgattctgtcgtgttggttcaatgaatgccatccacttgacaatctcacgacgaagttatgcagaactcgactgattccaagctttagtgaagaatccatgcaaaggcagggatcaaacgatgcaatgaggttaagtagtaagattgacagaatcttaattattcagttgtcaagcagaagagtgatgaatgatcatggaactttcaatctgtcactgcctcaattaaaatggaattgaaaatatttcacggcatgcttaagagacatgttaactaatattctgaaagatgccatgcatcaaagctggttagtgcagaatgacaatacagaaagaacctaggagaatgtagcttctactcttcagcctcattaagaaattttatacagtagcttaggtacagactgcagagacttccacaaccttattactttctgattgcatatatgctttcatgtcctctcacaaggacagtggcaattgcatagcagttgaactactgccatctgccactaataaaggcagcatctctcgaagtcagcgtaggatttgcaaagtaaactatagctaatttgacagtaattaattaacaatcagtagaagctagctccaatggaagagaagcatagtggtgaaaaagtcatgtcgaccaacgagcatcaggatgggaattaggaagcttgcactacggaactaaactataattaagtctacttcatcatgcactaaaaagtgaacaaaactgctggctcgtagtagctggtttcatttgtgtgcacgcagcacctgccactgcaggtattggaagaaagcttagctgacttcctccttgacagaaaatctaggtgagaagtttctctcttctcttttcttcaattgttcttctcgaagcttctgaacatattcttcaattactagtaacatgcatgtttattaattacactacagatgataatatatagttcaggagctaaaacaggagagaaatggggagtgagtttgtgccaaatggatatataggaagcaatatgatcattcatatgcaggtatatagctcacaactgagatctgtttgctgagttgaaacaagcatggcatgcggaatatgttcagaggaatacaatttcctccatatataactaaaatatcggctgatagatcagcattcaggcatgaatatatatattgatcctctatacacacattccgcctgctgcaatacatagcagtacagcaacaacgttacaataatagcatgaagacgtatacagattattcacttgtgccgacgtctaatatctaatcgatcaagcagcatgcaacgtaatacggcattattaaggccacgaatcacattaaacgtaagcttaggctgtgtttagttccttccaaagttaaaagtttgggttgaaattggtacgatgtgactgaaaagttgtgtgtgtatgacaggttgatgtgatggaaaaagttggaagtttggatccaaagtttggatctaaacacagccttagtatataatgtattgcaaacttacttattattactagtctgctttcgttgacaaggctaggaaattcctgacatcattgatcagagccttgtcaaagaaagttaatttgtgttgtcttaaaaaataaaaaagccagatatgtacatagttcattatgtagacttatgttacataagctagtagggcccggacgagccaaagtgcagacctacggagcatgtcctggaaataatattgaacttctgccttttttaaagactaatggtgaactatgagcaggcaatggcgtgttcattgctatacatgatatgcacgcacgcaaaaatttggcttaatttgtttattaaatgttttcaattcattggttatgtattgagcacagtattaaatgacatgtcatttccttattagccttgtgcatccaatttgtcatggacttattatttgcccaaactgttctgattaatacatgtaaccatgttgttgaccatatatatagctcatacttactccgtcccaaattataagacctatatattttatatggttttcaacgatatatttgtaccgttaattcatttcacattatgttcccaacgaatatgaaactaacacatgtgatttaaaatataaatctaataatataatatacataatatttagtatagatataattaatatgattaatacttaaaagttgccgagtttatttttttaaaaaaagtcatttaatttgggatggagggattatttagttctatgacacagaaattcacgaggggaaaagagtagggaaacgtctacacatgaaataatgaaaatcctctttaattactttaattttgactaagctcgagacagcgcaagtgttcattatatttaagggaaaaaaaaactttgttctcacgcatatatatattcttgcgcgcgcacacactgaaataatcaaagagatgcacatacacacacatatactacgtactcatctctctgaaagtctgaactctcttactttgattaacccatgatcaagtgaagaactgaagatgttctcctgtacagtaattaaggggca

SEQ ID NO: 32271 - DNA, 6151 bp, Oryza sativa
  unsure (1)..(6151): unsure at all n locations
gccgccgccgtcgatctgctgctggcagctggatcgccgccggccgctgctctggcgccggtggcggcctcgccatcgagctcgaggcgaaganggagccgccgccgccgccgtcgcttccttgatccgccctcaggcaccagttgcacgtgccgtacgactctgccttggggtatcgctccgagcagtatctggcagtatcatacatgcgtatatacagatcagtttagctgtaaatacgtggaaaatgattgcgtgatctacgttattgcatgcatgtacgtttcagatagacactgacatgcaacacaagtatatatatgtacatccatgcacggagataaacgaaccaacacaacaaaactggcgaatcctgaattatacttatgtctcgatcaatattcatgcgtctttttcagaaaaagaaaagaactcttcatcaatttgtcaagataagatcgatgcatgcgttcattatatttatagttatccatatactatacagttagagctagcgatcaagcaagtacaataatgctttaaatcaacatttatgcccataatttttctttaatcacgcagatgtttcaacaatattcatatggcctagctgacatgcgcagccactgtcaagcgctaggggaaagagaaagaaagcagaattaattaacaaagatcgaactatttgcagacagtgaccgtgttatgtactatatatttcagccacgaacgccctactttgaatcaatttgtttgacaatttcgcgcggatcgcgcgaaaagtcagacaaaattagctggaaggcgcgctaaaagttactactcggagacacgcgcgcacgtcaaaagcgcacgaactgtggcttgtcatcgatcagctacatgccagtcaataatcttataatcacagctaattcgatcactagctacggtctggggccaatccatgtagatggattagtcattagttgagaggaatgtgttacatgtgtagcagtgttgagcagttgtggttcagagatcgatgcatgatcaattgaaactattgaagtggttgcatgctcgaactgtgtggtgcacatgcatatgtacgtcagtggattattccgatggcgaaaaaattaaacaatctgcatcgtgtgccagtttgctattgatctgaatagttagtttctcagataaacaatccacgatggctattaacctatgaactcatccaattaagagtatcagttcatgtaaatcttacagttaatttatatagaagaatatattgattccaaattaaactgattctatcctgatctgagtatgtgcccagaaatccaaatgaatcaatctagcatgtctctcatattgggttgggggaggtgtcaaaaattattttcgttaaggaaaaaaaacacccaaatctgcagttgcggacgaacacgaacaaattaacaaatgaattttgacgagagagcaaaacatacgtacgtgtgctgggagcggacggcgcaggcggcgcagcggaacagctccggcaggaggccacggtcgccgcacatgcagcacacggccgccgtggcggcggcaaccggccgcggcggcgacgacgacgatccggcggctgacttgtcaatccccatatatatctcggcagatcgatcgatgaatcgggcggctatctcaagcgcatcgattggtaaagctgccgcatgagatcgatcgatcgatgggatgggatgggattgggaatggatcggatcgaaacttcaaaagggagcagattggttgctgatggcgaagtcgaagtcgaatgtggtttgggaagaggaggaattggaggtggtaatgcggcgcctgccgacttcacgcatctcaagatcttgtagaaggaaggaaggaagctgccctcctttaattttgtcctcctcctgctgctgctgctgccatggctgtaaagatttgctgcagtttttttttatatttttagtttctgagatggcttttgcgttttggaccctgaagtttgtggctttatgttacaagttcttttgttggcctcccaagaaaaagatcttctcttgtactatgaagcaattgaggcatgtagtttatttgtacgatgaatatcgaatggctaagaataggtgatgaatctaagggactggctgttcagattgatgttattttcaaccataccattttatagtaaaattgtcaaaaaaatgtctacgtttagtttattgccaaatttgataaataaataagaaattctgccaaaaatttagcaatattgttaacttgccagattttagctacaatctaaacagaccctaagacttaataatcctagtactagtaggctcgccggtgagccacaacattatgaatatttgcggtgcctggcatgccacacacatgcttatgtctaggcattagaaaaattccttagttcatcaatgtcttaagtttaaatctaatttaagtatttttctttggtcctatgtgtacaaattgtatttaaataatataaggtgggtatatagctctaacttataaacttttcagtcttaatcattatgcacacgtgtttatttgaaaaggtgttatagttttagtcttttttattagatgcacaaattttaattgtcgaaacacaacaatgaaacaaaataaccacccacgctcatgtgcaatttcaatacgattttcatgatgcgcacgtatttaatatgtagcctttgagaccgatgagaagtgattgttgttgctacaattgccgctaccgcccaataccacaattgctaattgaaagtatgtatcgctgcaatagctacagctgcaaccacaacaatcagatccgattaagctctttatttgttgagtatatactcgaatatatattaaaatatatattcatgacatgtgtaagtggcagccgtgtacccaatgctttatctctgtcttagtgaatcttgattcgacgtcttctaggtaaaaaaaaaataaacaaagcgtgcaagacaatagacatgtcggctagaggctacataccaaaataccacatatgacagggttcagaacgcaaaaataactggagtgaaaaaataattcgagaggcaccaacaggtccctttcatggcaaaactgtagatagtgagacatcaaggggcaaaccctttcccccgaggaataatagcgcagctgggcggatggacttcgttggacggccgtgcggacgcaggggcccacttcgacgctccctccacctaccacccacccactgacacgtggggcccacataaaaccccaggcccacctatcagtcacgggcctcgcggggaagcgaccaccaaatccgccggtggcatcgggccgtaaattcacgggaagcgcgggggttgattgggccggaagcgggccttggtcggcggtttgaccctgcatgccgcgctggccaatgggagaccggcagcgatggcgtggggcccacgtgccgtggcgggtaggtactttggcgcatgtggacgggggaggccgatggatggatcgggccctgcgagcgagccgacaaggcaacggaaatctcgtgtggttttcgcggctaaattgaagtacactctcgtgtggttgattatgttttttgattagagcgattttttggattaggatgccgtcatgctgcgtggctgcgtgcgagcgtgtgcgtgcatggggtttagcgtttcgagaggttaggatttgatcggctctgtggaacgttgtagagatcgggtgcgtgacgtggtgatggtggtggtggtggccggtcttatcctaggtaggtagctggccgagaacgcggcttgtagtctctgaattagcgccttaagatatgctcgtatgctaccgatagctacataattttattagtgtgaagtacatatgtcccaacattagaaaaattgataataaagttatatctacaggtggacgggattctccggataaaagttcttacctaagacttgatgggcgacggcggcctgtgatatctatgaagacgtcgtataggagatcatgttgatttccttgctcgcctccattcagggtggtgtgtggcgacgttcttagatgttctcgtcgggttacatgagaagcgagtagatcttctctctcgcccttctctctacaacgtccaaaagtttgaaagcaatattatgctgtttgaaagcaatattatgctggagaagagcgaggcgataggtatgttcctcttcgaagggctgacgacgatcgggtacgcttagcgatgatcggttagcattagtcctatcctcaattccgttattggagtcgccaacgtgtaatggtgtgtttttctttctttctttcctgatcgtagcctcccagataataatcttcgtatttctccttgctatatcagcatgaaactttgcactatcttaggtgatggttgtttcaatatatatatatatatatatatatatatatatatatatatatatatatatatatatatatatatatatagtagtttcgttgagcctcttggcttctgggatgaacctgttgcattattaaggaccaagtggcggctcgatgaacaacgttgccattcatccgcgagtaccacatctccagctgcatcttttttattacggaatacatagacgcaagcatacacccacattattacaatcaaagaaaggcaatatgaagattcacgtagggccaagtccagtttttacaagtcaattgctgaaccatttgggagcggacgcatgcaagggcaactgaacacaaccggtcacggccacacaaaaagttgtgctagtgtagggaaatatatcctatacgcaataccggataatacgggaaccgaagcttcccgacctgaaatggcgttgccctccgggccaaagagaggaacattatggcttaagcctctgctatggctcttcgattgtttgcctccctacaatctgtacaagggaatggatatacattgcgtaccagagatcaatcattatacccaaccagcaggcaacagcatttagctgtttattctcatctcaagcaacaacacgcctgcttagacaccgcataaggaggtgtgccaacattaatcaataatgcaagcctaaaactgcagcaaggccttgcagtttcactcctatcaaaacatgaacagcttatctcttggatgaagtcaccttccatgcatttccttctttttcccgtaagctgggatggaaaagtaaaccaaatcccaaaatcaggtaactaccaatagaagcatatgtactatgcagcaagacaaaaggcaaaggtttgacataactgcctaactgtatccaaacatatatagaacttgtgtttgagcacctatgctgtaaagtatttaggatgccctaaaatatccagtgaacacaggtacctcagcaaaacttaagcaataggaaatcagctctgtgcacactccaaaggatgtaaacttccttcaccaaactcatgcattcgaaatcgttccaaaaattcgaaaggtctgcacagagaatataacagtttatgaatgataagggaaagaaaataataagggcaaatatcatgcatgttaaggcaaccggactggtttctctctaattggattacctcttagtataataaaaataaagtggaactgtttcaagattcactaagcttgagtaaactggaagcaactaataaagcaatttattaactgcatgtgacagattgacaacacactatggtaacacaaatagactcattcgaagaataatctgacagccatattttttttaatagcatgacgccaaacacctttagtgataacttgatcctaaacagcaaagtatggtttgatgccaagcaattggtcatgttagttatggcttacagcaaaatttcacggttccgggagagcttcctctgattgttttctatgacacttgatacatcaatttcgggtccagcaatcatagatgtagcgttcgcatccggtgtccataactaataaagaaacagataaaatcaaattgcattcaagtacttcaagtaaaatcattaaaatatttctaaaaatatcagattacttacctttattgtgttatctataccacttgttgcaacagcacagtca

SEQ ID NO: 32272 - DNA, 1586 bp, Oryza sativa
aataaagttatatctacaggtggacgggattctccggataaaagttcttacctaagacttgatgggcgacggcggcctgtgatatctatgaagacgtcgtataggagatcatgttgatttccttgctcgcctccattcagggggtgtgtggcgacgttcttagatgttctcgtcgggttacatgagaagcgagtagatcttctctctcgcccttctctctacaacgtccaaaagtttgaaagcaatattatgctgtttgaaagcaatattatgctggagaagagcgaggcgataggtatgttcctcttcgaagggctgacgacgatcgggtacgcttagcgatgatcggttagcattagtcctatcctcaattccgttattggagtcgccaacgtgtaatggtgtgtttttctttctttctttcctgatcgtagcctcccagataataatcttcgtatttctccttgctatatcagcatgaaactttgcactatcttaggtgatggttgtttcaatatatatatatatatatatatatatatatatatatatatatatatatatatatatatatatatatatatgcatatgacttcaaatcactggtggagaaaaccttattagtcccggttcgtaaccccctgtagtttccggtttttaaaccaagactaccaatccgggactaaagatagcgagatcgctatctttcgtcccgggtgaaatagccgggactaaagatcgatctactttttttatatttgcatggccctgttgctgcatggtttatatatataatatgcatatatatgtttcaatacactaattttggttttcacttacatatacacgggcattttttagtatgattttagtaagattcatacatttacttgtctatataaaacattaatttttcaggattgtgtgcgctagtcacgaaaaaggtgcatggatttttcaggatcagattgaagcttcgggcgtggggtctgctttgttgaatcataatatagttcacgtaatcacgcctcgacaaatttatgataggtacagtaaacacaggcactcgtgcgcgttcctgggatgatgatggaccggggttgcagcttggtcgctgttgtacaacaccagagaaagcttcttccctgcgtgccattgccattgcagctggagaaacgtagtagtacagtgttgatagactctccgtgcaaccagaaagtatggctggtgctaccaattcagcaggctggcacagccttaccatgtactaggccgacaggacatgccagctgccggcagcgacgtcgtcgtgcgcaagagctcatgttcatcaccgaattgcttgccgctaaccttccgggaagaaggcggcgtgtgcagatgacgtaaggcagcacatggtcgatggttccgtcgctctcccactcgtgtacagccctttggaaactggaacgagcacatgctttccacacacacaacgacagagacacttctttggcctgtctgctgaaggaagcggacaacttacctgtttcgtgttctcaatatatatatatatatatatatatatatatatatatatatat

SEQ ID NO: 32273 - DNA, 2040 bp, Oryza sativa
gcagcagtgaaaaaaggaagtacccttaccggttccatcccctgcaagcattttaatcaaccttccagttcgtttctcccatatgaaccatctaccatcatcacttccgctagcaataaactcccctgttgtaagagaaacgcagcatagatgtgtttacgttattaaaatgaaccattttattccatggattttagaactcaaattaacccaagtgattctgtgtaacagttttagtcagttttacgtaaaatctaaaatttagtaagcactaaaaaggttcataattccatgtaacaaactccacaaggaaatatagccttcaggacaggggagaggagatgaagtgtctgataatctaatgttaagtcaatatgcaaagtagtatgttttaattaaaggtcagtgtatttctgttactagaaaatttgtcattaaaaatgcaagtggctcatggaaggacaaatacttcaagtaccactaagcaggaacgcaagaaggaacagcctaaccttgttcaccgagaaagctagcttgctttatatctgtccccacattgcagtgtgcaacatatctttgcttcatgtcaacggcaacttctggctgcattatataatgggaagatgatgttaaatccatgtaatatcagtggaatacatatatgaacagaaaaatatcccatattaggaacttcagacaaagcggtggcagaaaagaacaaacctgataggcagaatcaccattctgagtggactcagctgatccattttcaccagaatgttcgtcagtttgactatctcttctgtgaaatcttaaacttaaactaccccggacaaaacctggatcactatcacggctttcatcacctgatgctgatgtttcaaagtccaactccatttcatcatcataatctgaatcttctcgaccctcctgtgatgacgagccactggcatctgatctaaacagtagatcacttaatgagcgtaaccgcccatgtcgtgcatcagtgtaggtattccctacttgatcctttttattcttctcaagttcagctgttcgaacaaaataaacccatcatatattttggaagttacaatcagtaaaccaacataataatgcatctggtgcatcaatgcaaccaccaagccttaaatctgcaatacaggtcaattttagtttatgtgtttttttgtgagttgcgacttcatgacaacaactatctaacatgggggattaatagagggtaacttagctcagtgcaggcatgggaaccaatttcttcgtaactatttcacattatgttgtgtgtgggaaaaaaattgcctgtgtccgatatactatgtgctaacctgcaaaaagctgctcctttatattttccacttgcttcactgactgagaataaggtggaacaatagtatttaatgcatccacatattcagatgcctctttcagccttcctaactacaaattcccaacacatgttcgtaagagaaaaatgaaaatcaactgatttcagcacttcatttcaaagggcattagtcaatccatgtttctatgaattactcagcttacctgtaatagtgcttctgccatatacagatgcgcctgaaatgatctggaatctatacaccttgcactgttgcaatcccttatagccatgtatacatcatttttccacctcctctgtagatcaatatttaatgatccgtacgttttacacagatcagattttcaacaacagataaacaaaagcaggcaaacctttagatacaatcctgcccgagtacacaagcaatcatgcttcatgttatcatcaatattatggtccactgccagaagtattgtagagcatgcttcaaccccaagcatcaagttagtgcccatctcaagagattttgttgcaacttgcataagtttcttgaacgtatctacctgaaacgggtgccattaaaggcaaagcggttcaacatgtccagcagatcaagcaaacagtgtggtctgaattgcagagagagagagagagagcacaactcaccctac

SEQ ID NO: 32274 - DNA, 14460 bp, Oryza sativa
  unsure (1)..(14460): unsure at all n locations
atatccttgatttgtcttaaattttactatgtttcataaaaccatataacagaaactagttgtcaaatgtgtgttttggaaactgcgttgatggtacaaaatgctactcattttatgacacgagggagtatacccagcaacaactgctaccatatttaccatacacagttgggacaataacaatacactcaagaacagggaactcacagtatcagcaaggtgcattggacagaacattttaatacatggaggtggttccttttttgtttggcatgtgctcaatggtggaagcattctcctatcatacagtcgtgcaaatgcatcactgcataaacatcaagttgtaaagtaatgttattcaggtttagaaagcttagaatggatcaatgtataagagtaagttaggtcaccttccaccaacaaggagctgatggggacgaacagtgctgatatcacaagacttcagtgccaatggctgtctgggaatatcagctaaagatttctttgctccccatcgtagatctagctgccacacagaaaacaaaaatagaaccaagcatgcaacttagcaactataccagtcaattttatagcccgtgtttaccttaatactctatttagttaattatccttacaattccaggattcacaaaaacaaaaggtacagtgcagttaccaagcctagaaggtaaaagtgggagccacaacatgatcatcataaggctgaaatgattgtacaatcatagtccaacaaaaggcagcattatgggttcatccacatggtaataggaaatggtgtacagatcaatccttaaaaagtaaatctcaattgcatgctggctcaagagttcacgaaacaataatgagacaccatttatattttttggtaaatattttcttctagtcattaaggacctccacgtaattatttatagtgctaaagattacaggtagactgcaatatggaatcatacaaggctactgagttgggctcttattagattattcctagtggtaaccaataaatctgtaacagaataacatttaaacgaaataacaaaaatactcccaaaggtaaaatttatcatgatatgaggttattaaggaccaaacaatttatcaacctagacaaagttgcaatgttagacgttattagttgaaccaaattttgtcaaagggtggatgactcacaagcacattacggcattcctgattagtagatcttgcacgaggacaggaactgcactcccgaaaatcatgctgtcttagagttccatcctcacttgcactccagactatattagggttaccaatttcaacctgcatatagcaaacaatacaaaaaattaaataattgaagaccaggcagaggcttataataattgggtagaaatctcaatccacaagaaactagagcacatctatatttgtgtaaagacttaagtgcagagcatcattttctccttctaaatcaagatgatacaatgcaaatataaacttctttcatgctcacttaagtgcagaacatcattcacaaattacaaaagacctatgtcaagatgatgcaatgcaaagataacacttctttcatgctctagagattcaaattccaaaggtcatctcaacatggaatcttacagctaatttcttgatcctccttgagtggcattggtaaactgctgatggttccatagaaatttctacaggcctttttccacttaaacgggacaaattaaaaacacgaacctgcaaaagaatcagcaactctctcagaaaaaggatcctaaaaataactggtaccagaatagcagacagatgagaacaacttctataaagatcatacctctgcatctcctgctcctgagactattacttcatcagatgtttcagggacaaattttgtgcaaaatatgtttgctgaatgacccgtatcaatgtcatgcaacaactctcgattagcataactccagatgccgatctgcaggtagatgttcatacagcacttaactcaatcaagcataaaagtgtctgattttactaatccaagcatatgccaaagaaaagagaaagccagccacagaggttactaactacaaactcgtgtcgcctgctgagcaacaccccttttgcaacaaaattgtctaatacagttcatataataattccctatagttacagcttaacaaatagtttaacttgatagaaataaaggaagacaaatcattgcaaacctcttatgtttgacaaacaactaaagagttcatgtgctaccatattctttgagccgaaaaggtctactagatgatgattaccatagcaatttagccatataaaggtggcacgacagggcattcagaagccagagagagagagagagagagagagagagagagagaaggggtgcaaatatctcaaaacaatgtttaacatagtgttggggagaattagagttcaagtgctaactactgaagataacatgacacaagaataaagaatctagcaaagtcagacccaaccatacttaattttagaaacttactctagtgtcatctgaacctgatagcagaagtgagccctttgaattccatgcaatagcattgacacaacctaggtgaccctgttatatagcatggagaaaacagagacggtcaatgtaaaaaaagcaagagaactctagcactttttcttttgaacagctatacaatttccaatacaggaacaacaagagggccaagtgccaaatgtccttgtgtgaaaatcagtagaacaagaagaaaaaagtagtcgtgtacctccatttccttctccaaagcaagcctttgtactagagaagaatggaattgcactctcttattaatgtcctggaaaagaagtcgttactagcttctaaacattttagctacaggcctacaacacatatagtgataccatgatcaacatatgcatcacgcatcacaaaatgcaagaccaaagaagaaacattattaatgcaagaggccaagtgccaaaagctgggttgaaggtcctcaacttctccaccgggtcgcctccatgtttttcacctctgttcacccctattatacatcgactcactggcaggtcattcaccttagaacttctcatctatcctaaattctcaaccaacggaagaagcaatcaagtgcactcatagcagatgcagattacaacaactcgagcaattgatagcccaaaccccttcccctgacgctacggatttaattcgcgcaacaagctaccaaaacaacagaaggctcaaacagccacggatattacccccaatccataaacccttgaaactctcaaacgggtcgaggaacatagctccaaaaaaacgcgaacctagagctccagcctccagccctcgcgaacataccacaaaacacctcgccacgcgttcctactcgaccgattcgtccgcccccgcgaacccctccaccgcacagagcaccccccaacgaatcgacccccaattcgccccgtaccaaaaagctatccacaaatgcaacgaaccctagcacgcgataggggagggggagaggcgtcccgggccatcccgagggtgaggagggggggggggtgcttacagcggtgccgtggagacttcgggcttgcaggaggtcggtgacgccgccgtccgagaagcgccaccgcgccttctccgccgccgcgtggtccatctccatctccgtcgaccggcgatctagcaggggaagaaggccagacctcgcagcctcttcgccgccgccggctgcgcgcgcgcccccgatcgccgtgggcggttttggggacgcttctggaagctttttgcgcctttcagcttccaaggtacggaatgggggtggaggtgtgcggggtcagtgttccagagagagagagatggagagaggggaaggagggagccagggaggtgttgcttttgcctcgctggcgtgggggtgtggggcccactgacgcgtggagcgagaggatggatagacgtggcctgtcaggtggggccagactatcgcacggtcgcaccagtgctaatccttctttttcattgtgaaattagccagccgaggaatggcttttcgccaaattcttttgaaattctttaggattttctcaagatatgggaatttaaaacaattttaacatgggatttaacctgttttgacgaatttcgttgtgcctctcttttctgatttctgaatttttatgtgattaatccagacgattgtttctagagtttcctggtatttttctaatcatagaatttattatagtaaaacgcacttgaatcctactttttttttctttatgcgtttctaatgaatccttagtatctcaactttaaaccatcggttattagcttattattattagtttttcatcttttaaaactgcttcatatttcatatttcatatttatattttattctgatcccaagccgggatggtgtttttgcattttagttagcaatttaaaattaatcatagggtgcgtgagagaagaggaaaaatgagacaaggtaggtatactaggctgtaataatttctttgtgcttttgtttattatttattaatcatatattgatgccatcaccatttttgtccatgtgtactccacgtagggacatcacatagtcgaaaatcaccttggtttgggttcagaaacgaaatgtaaaaggtgaccaatagtgaaccatgtcatagttaaggggcggaaatcggatcaaggtcataattataagagaccaaatatagtctttccttaattgattacagtagtaaggttctgatatcaattgtaattattaaaacctgtctggctctgctgcaaattataatccaaaactgatttgaattttagaagtaaacttaaaggttttctacatcccttctattgcttctgttttcatgataactaatccagacttcgtggtacttccagaggtagcgacagccgacagaactacaaaaaaggcagaaggcaacctggtaaaagaaacggtgacgacctctagaagggagaagaatggcttggctcaatcaaaagcattagaccaactcattgcaaacaaattaagcaaacagctgcatgaggaacactatcccttgatttatctcacttcaaaacttctctatttgattctggttctgcagatatgtacagggcaatgggctttttcagtagttcagttgcgacactgataagttaatacaaaggtaatgtacacaacgaaacatcgagatgaggggagagacacctcgccctttttacaacgggagaagcaaaagcatctacaaagggaaccacctggtcacattgccaatctacctgcaaaattgtgttgtaacgccgaatcgaatattacctctgttccatgagtttaagttttcgccagctcaggctgtcaggtggtgagggtatgttcttaatatcttgatcgtgttccaccatcatgattgaaattcagcacaggggtctaccgaactatcaatttcctcagctttctttccactagtaaatgcctttgaatgaatatctcaagctatgcacgtgcttctacaaaggcaagcttaatgccaaggtctcagtttcttcagagtcgatgctgtatgacagcctctggaaagcagttgcaaatgccctgtatgaccattagagtcagtaatgaagtctgcggttggttcttggtaatgcactctaggtaaaaagattaccacttagaagttagaactcaacttacatgttatgacggtataagtacaacagttactcatttgaatagctgtcggcgaagtctttaattcttctcttgatagtctgggggaggacaggaaatagaaacaaaatcagcatggatacgtcagaaacccaagtaaaaacaaatcaacacaaaggcaaatggcagagttaactaccgaaggacacacacctgcaactcttcgtgaagcagtgaaaagaccttcttcatcaatttatgcctctgtaggatatatggtccacaatcaaaccaggataaactttatattaatagtaaagtatcaaataaaatttcagtagatgatacattcttgatcaattgcctccccaatctaactaaaagtttaatatcaaactgcgatgcaaggagaaatttgaacatggatatgcgaagtggaaggggtaacccctttcaaattggtggagaagaataaattgaagttaggcatgtactaacaataattgagctgtaatgattatatagggaaaggcaggaagaagacatactgtgcccgattcatgatacatgtctctgattctttccataatgttataatacagatccttatctctttctttagcgacattaagatcctcctgaacctttaggaattcagatctgtacaaaaaatatgtcagttacagaaggagattacatgaacaattgaacagacaacaatggagtactgagggtacttaaaataagaaaatttacacctaagaaaataatattacgggactttaaaataagaaaattattgcataccgagttttctcaatctgaatgtttaagtaggagtaaactttgtatttctcagtgtactcctgaacataatctttgtatctgaaaaagaagataatatgttagttttttattcacaaacaacaaaagaaacaaaatttcaaaaatcacacattacttattggcatggagtatctacaacggtttacggtatgcgatttagacaaaattatccattacttattggcatggagtatctctagaatgcatattcgacaaaataacactgctcaaatgcgaaattaatcgtaccacctataaacctgtacaattccagacaacagatatgatgggtcactggtcgtaagcagtctgaaacagtcagtaaaatattcatatggacctcaaatatcaccagtaaagttcaaagaaggaaacttaatggacaatggatgtgggctatagaccaggtaatccatcatttgaatacgaaatttcatggtttggcattctaacatcctaggcatagaggaactgcttcaatccatttttggttgttaaacaaaattcaagtaataatactggcaaaataattataataaaaacaacagcgggaaggatattgtaacttactgtgagaaatcttttattggacctttcagttctggttcctctttatcatactttgagaagaataaattatcttcatctgaagaactgtcccttctctttctacttgcatcattctcaatcaaagagttgttcctacttctttcctcattttctgctggggaaattgatttctgtgttctagagcctatggcattcctactaccattctgaggaagcttgggggtagttttccctatcttctttggacctacttgatctagcattccaacctgaacccttgtttcccttttcccgggtttttctcctggctgatctggatgtaatatgaccacaggaactggattatcaggttttgacaattgctgactttgtggaacatttcctctttgttgaggcctattattatcaaaatcatatccagatgccttcttggggaatccttcctgatttatattacctccaataccaaattctcgaggtgatggtttcctctgatcttgagaagaggatagagaaccctttctgtttgccatactgggaatggagtatcacattagctaatttaccatcaagtgattttgaagaactatttctttcaaattgcttctttgccctcccagtctcattttccagagaagcctcacgaaattcacccaactcgagatctgaaagctctctctggagcactttttttccatgaggtgaactctcggcattatttctttgcaaatttgatggctgaccattactttcattggaatcaggaaacggcataacaccatcatatccaacatttcctttagcacttttagctgaaaccatggaattcacgtcaatgttagcatctttggaacgactgagcattttatcctcaacttgggttcccccatatctagctttttttcttgtggcagaatcatcagagtcatcaaaattggcatatgggtcttcagcgtgcgaaactcttccaaggttaccatccaaactattccaaggcttctgaaccttatctgcctttttcttagaaattgacttctcaaccttatcttgtgttctctcagagtgcattgcttggttaagtacatttgggctttgatttatcttttgcaaatttccagaagccaaatgtcttactttcacagcagggctgctatcatgtgcatgaagatcactatgtgcatcccagctaacattccctgtctccttactcagcttctcattcacatgtttgtcaagaggtaaagtttgtctctgttctgataatgaactagtagttcctaaataatcagccttggcccttttggcacttccagacattacactcgagttctcattggcagagcatcttttcaacttgggtttggcacctttctcgttgatcctatcctgaccatgatttgatccatcctttgatactgactttctcctactgccatgatgttttgtagattggctggtttcttccttgggtaggttttcactacttggtgctaaagggtcaccaaaaaggtcctcataagacatttcatttgcagcgtacttgctatcaattctactaggatctatgctggtatttaccatgttcttgcttccaggaatttctggtggcttctctaagtggctcgcatcgaagctatcagttggtacagctgtgtatgctgactcattattgttgtcattaaaattgttcaaatcaatgtgtggggatgcgctcttataatccagatttgttccaatatctattagctcatcatcgccatctagtgcagtcaaatctcttggcaatgaagataatttaagttcatctgctgcttttctgtgtgctcctcctttatcatcatcacttgtaatatccacaaatgcatctgatccttccttgctgcttgaagaagcatcactgtcactgtcactactgctcccactgccacttgcagcgcttctgctttggctcccactgtcacttccactgtcactgctttcactgtcactatcactaccgcttccactctcactagatgagccagctttaccatcactgtcattattgactttttcatctcgggcagcagaaactggggagcctccaatgtcaatcctctcaaatatatcaggatcatccatttttaagcttggaccagcttcctcagtgttgtcatcaatagatctgttacatacatcaacagatgactgttaaggtgcttgggagagataattacaaaaacacaggaaaaataattgaacaaaactaaggagaaatcttcattaaaacaatacccatttgtcacagtaaaacaaggaattgaatttgtaggagaaaaaaaatttacattccactgcaaggtgcataccttttagagctttctgcctctaatccaggtttgagcaaatacctccctggcgcttggaaaattgcaatctgcaaggataatagtgtattaggtatgcaacataacatagagctgatgtttcgttaatggagaagatgtagtggtgagtaatgtactaatgtttgccactcacattcttgatgatactatctattttctttgaagcattcggaaatacatctgcaacagctttctccaggccctgcatatatttcaacaaatgttgtaaatgataattgctcatggagcaaacctttcttaattaagtaaacatgtatacaaaaccaagacatctatctggctatgaatattcaagaatatgatgtacagaaatgagaccaagaactatgaaatttaaaaagatcgaccaataaattaaaatgccacttaaagcttcaaagaactgaagctatcactaatagggggaaggggggcgctttattttactagtgatacccatataagtttggaaaaatccgcttgactcaatttttcaaccacgtataaaaccatttaatcttcacgcttccaattctcaacaccatttgaaaaataccctcatagaccaaagggagtcaccatggcactgagtgatggggtcaccagcaatggtgtcatcttacccaaggatcaccaccaaaattacctctttgaacatcccatcgccatctgtgtgtgattggagacttggaataacgattaaaaatggcatgagtatgtaacaaatgaaccatatggaagcatgagctattcacagcatccctgctacccactacaaaactgcatctgtgtgctacaacagtagcagcggtggcatgtagcaagtcaccacagagccacaattgtgcataacactatgcacgcaccacacacacacacagggggagagagagagagtacctttaaattcattccttttggattttctgaaagtacagatatcaagagacttcgcagctcatttgtattatcatcagtacttgcagaaacaacacttgctcgacgacttgttccttgagacaccctatttggggttgatttctcgactttactattttcatctttattcaaatcgaatggtgttatgacttcattatttacatctgatccggtaggaactgaaggaatgctcggtccaggttgctcaggagaaagcgctggtgaagtggagaaatttgcttttggtacactattagacagcttcactttggaaactgatttggttggagcaataacagcagctggagtaggccaatggaaaacatatgccgttaaatatttgctaatgcaaggttttcttagcggaagaacatgcgtagatgtaaaaagaaataaaacaatacaaatgagagggtcaaacaagactcaaacctggattcttcttgtaaaattctttcttctgcttccagttcatcctccgcatattacctgaaagagataatacattagattatatagcccaagatctaacaaaaagtttaggcattacagactctaattaactttaggcaaagaacagaaaacaagttcagagccattgtaggctcatagctgttgcacctaaagatataaaggatatttacaccgtacagaatactgatccagtgcaagtaattgagctcagttatatactgatgtgtacaaaatagttatatatacatatttcaaatacaaatgcaaaattgaggtagaaaatgaaatcataatccatggtgaaaaggaaacaaataatagttcaaagcaagatctaacaaaaagtttaggcattacagactctaattaactttaggcaaagaacagaaaacaagttcagaaccattgttggctcatagctgttgcacctaaagatataaaggatatttacaccatacagaatactgatccagtgcaagtaattgagctcagttatatactgatgtgtacaaaatagttatatatacatatttcaaatacatatgcaaaataaaggtagaaaatgaaatcataatccatggtgaaaaggaaacaaataatagttcaaagcacaaaccttcaacagcagcagcagccattgacttggcctgactcttaacagatggatttgcagggtccagcacaatcgatctataacaggcaaaatcacaacatgttaaaaccatacataaaatcataaaacagaaactttgagggaaaaatctatttatcgggtgatcattaatcagtagaccaagagagttattgaacagggaaagcagacaaactttcgagattttgagagacgctcagcctcctctgagcgcattttcacaaggttctttgctgattcatccaaaatacgctgcacattcaccttgcgccacgcagagccacattcaagaagcaatccatttccatcctctccactctgacgttcttcataaatatcacataattcaccacgttcagaagcccatgtaaatttaaattctttgccaccaacatctataatctggtaggaaaagaacctgtcaatactcaactcaacaaatgaaatgggcaacactatttgccatattgaagctattttactcgatacattaatttagttgggctaatctagtactccctccaggctgataatacttgtcgttttagacaacggtgaggaaaaactttagaatctttgattatgaatcatttttaaaatatttgtctttcaaatatggtgactacatgtatatattagtcttaaaaagtactttaataagatcatatatttgttaacacttctatacatattataatgaaaaataatggtcaaagttgttttttttagaaaccgtgtccttgtccaaaacgacaagtattatcaacccggagggagtattgttaaaaaccatacaacggttgcaaaactcactagcgattaccttagtattccctttgtatgcaggaaataaacatgcatccatttcatgaaacatgaatcacattgtgctagtgccaaattagtgaaccagtatcttctcaaccaactttcaaagcctaaaagggtataactattttgaaatagaaatagctaacaaatgtaaaaccataagcttatcttgtcaaaacaagacaaagatagcaaaagaaattattgatgtatccaagcagcatgctggattttttttttagaaaacaaagcaaaacagttgaactaggatccataaatgtcagtgatgagacgtaaagctacagtttcactggagtaacatgtcatgtgaacaagaaagttaggaacacaaagggtcttgacaggaaaggagatttggagttttggagttcctatttgagattagtgaaccctactggagccaaatacatagttgggtgattctacgcttctttagtacaaaaccaagtaaatggttttgaagaaaagaaatatatataactgctcattagaaattaaacaaaaaataataatttgatatacccaaaaaacaatcaaagaccatagataaaagatgtacatgagctttatatgccattcctagcagctaacggttacaaaagtagggcccaacaatgcaattccacaaaattaatacttccgcatggatcatcattcccaaagaactttgagcaaccataaacagcataaaatatccaaattcatcctagccaaatagtggaagcctcaaataatgatttgctcacagtgatctgaccaaagaaatgcaaaatacacaaacaaaactccttgccattggtgcatataccaaaagaaatcatacggtttattcccatcaagccaaggagacatgtgcccaagtaaaaccaaactaaaacatgaactgccaatttataaaatcactcaataatgaacaggcaggggctggatttgaacaatcctatacaaaacttgaaggtaaaatgaatggcatatcgacaggaccagaataagcaatggacgagctcacactcaagagagtaccatataacatcacaagtgaaatttaagtatttaacgatcctaacaacatttgggataacacagcatcatgccaaaacgattcagagcatctcaagcaccaggcagtaaaattgagcaaatataaatgcaaattacacagtgaactaacctaaactcaggaacgatgttacaggaaaaccaaaaactggtattccagatgaaaataatctcgagttatgaacttaagacacatatgccataacaagcaaaatttagaaatcagttaggttttaacttcagaagaaactcgcggggacagaacttgacgacggagtgagatggagggagggaggggagggaagctcacgttctccgaggagttgtacatgttagggttgaacttgatgcgagcgccgctgcccgattcctcggcacgccggatctcgtcgacgaggtcaggggtcagccttatgattgccgcgaaggccggcgggccactggactccaggctgaacgactcctcccgcccggccgcctgcgccgccgcggccgccgccacggccgccgagcttgtacatcgtcccccgcggcaagcggcgccgccggcggggagggggggggtcctttggggctcgaaggcggagagtagcgaagacgccgaagaggagggcgcagaaatcgtataagttttccttttgtatttttcccgtttttagtttggattttggagtattttttattttctatttgtgttttgttgtttgggttggatccccttttccgtttataagttcaagcacaatagtaccaactagtattaccaattgtaaactttgacaggaccaaaagggaaatcactcgcagtaagttaaattaccatagagaaatcacggttgcacgacactcttcaccccttgaacacaaaccatacgacacatatactccctccttccctagatgtttgacgacgttgacttttttaaatatgtttgaccgntcgtnttattca

SEQ ID NO: 32275 - DNA, 4045 bp, Oryza sativa
cggtagagccacaaaaacacacgattgacagaacagcacccgccgtggcccccagagcagagcagcggcaccgcttcccagcgaatcggcgatagcgagccggcatcgtccgatggtgctttcggccggcggaacacgcgaccaacacagcgtgcaggtaggcaggcagatggtgaatttctttatccacgcaccacgcaccggcacacatgtccgggagacatcatcccgcacacgcatattctcgcctccgcgcgccccgtgcaacgtgctgcatcccagaaaagcagctccagcctcccggatgaaaagctcctcctccccttactactcacttaggctcgtttgaatagcatgattaagaaaaacaagagacatgaaaaacagaagtacaagtatacagaaaattacaaaacgtaggaaaaatatataaatgaccgtttgatcggaccgcaagaaaaatacaggaattagatgagaaaggtaaactcaaaaggaaatttttcaagagattgtagctcttggtaagtttcctctaaaatctatatacgatgaaccagtaagttttctctaaaatctatgtacaatgaaccattccataggagtttcataggatttggaaaacctcaatcttttgaatcaaatgattattaggaaaattcatataggatttaaatcctacgaaattccttcgtaggatttttgattcaaatgggccattgctgataccgtaaagtagtagtaaagctaccgtcaagaatccagcactgcaactagctaagctagtagtagtagctgacgagcaagcaagcaacaaccggacagcggtagtgctgctgctgctagactgctagtgcattggaccggatatgtattactcccagaggagaaagtgatgtttcctttgtttcagctctatcccacaggagaaagtggtcactggaccctcactacttcgccattgatgctcgcccaaccgggagatggctttattatagagtaatcatcgacaaaaaaggccgtcaaccaccggagatgatggcgggaatatgcttcctgccgtggagttcagttcagtcacaactcacataggactacagcctacaggagcgagctgagctgcacttacattgctactactagtatcaatgtatcatgtatacttcctggccgtattggagcgtgccagatcgcatgaactcacacaaccaattcgccgtggtcctcgtctgtgcccagcagcagtgcccaaaaacaacattggtgtgcacttatctcgcgatttgcaagttgaccaaatgaccatcacaactcactagtttgttcgagcacactgacatcgtttttacaccggtggtctgggcatgcggttcccgtggtttcagaccacaactgaattcccgatcttcccagaaaatactgtaactgaccggtgaccggtcagcggtcacagactatgttctggttttatcacaaaagccggatcaatatgatcatcacacagaaaatgagatgtcaaaaccaaacaaaacaaaatatgccatgtgaagacaagtagacaaatcgctcaaacagaatgcggtgaagatatgggaagacagatcggcgagatcttatcatagttgcactttcacagtacacaagtgagtggagcatcagtccctctaggagaaggcagacaaacaagcacatgttgccatgaatgcctcaatcttaaggattggtattaggcatgcaaaaaatttcggggttttattgagtcctttagttgcctctcctaccccgaccgcggaaaccacgcccgccacctcggccaccacctcgtcctcctcccctacctccaccgcccttgaagtggccaccacccttcttgccattggacttattgccaatcttcatgtcctccgggagaggaagtatgctgtcaacgcacttacggaagctgaaatcatcagaggatccatcaactcgtcgaacgaagaaacagcggctctgaaacaccgggtggttgcggatctcaaatgcttcaattcctgctccaattttcctatcggactcagcatggcctttcttcagcaggtcttccaacaccatatgctcatactgcaaaagttaagcgattcagcaaactcaagtgtgacagtagcaatgacaatgcaaaaagtaaagtgacatctggatagtttgaaccagacaaagtacagtacacaagcacataggcatctggaagtcaccacaattgattactgtgaaactatagtcacttccagcaatgagcttatttttctcaagggcaactagagatgagcttattgtggtaacataaacatcccactgacaaatagttttatcttccaattccaaacaacgatgaagtaaaagatgcaaggctcaagtatgcgattattttgatcacatgtagatgaagaatcatagtgtatttctttgtaactcatatatgtgtcagacagttcaatttatgtgcaacatatcataattgcagccttaatccaatacaattttcttataagagtgattagcaaaccacctagagaccttgttcatgtatgacagaaaacaaagtgatctcttttacctctactgttgcatacttgctaaaaacaggtaggaataaaccaacaattttctttgatagagaaaaaaattgctacttatggtctaactcaattttaacagaaaatgttgcgaaacaccaaaggaccatttggaggtcgcaagctaaccagatttaaattgcaagtcataacataacacttcaagttaaacaaacatgcctgaagccccaaatagagtctgttctccttgtggtacaaccatccttaagtaaagaacccagtcccagttcgtcaaacactacatggaagaactcatatggagtcccaacatatgaaggcagtgcagctgaaagagtattaaacgtcatatgctattccgtaaatgaaacttaccatgagaacctaaaagaaaagctaagtgaaagaattatactgtttaagcactaaatcactggtactactgaactcaacccaacatgtccattcacaaagatcattggtttagaagtaaaatcattggtctagaagtacctaatatacatacgaaatgcctaaagcaacctctccaagcttaataacatccttgaccatgacagatcaacccaatgaaactgggggctctacggagtattcaacgccatatgctattctgtaaatgaaacttgcccatgagaacctaaagaaatgctaggtgaaagaaggataatgtttaagtgccaatcactggtgctaacgaactcaacccaacaaagatcattggtttagaagtacctaccatacatacgaaatgcataaagcagcctctccaagcttaaaaacatccttgacagtgacagatcaactcaacgaatctgggggctctatggagtttcatgcaaacttggctaaatacaaggcgaacactcagattatcatgtcgaattatttagccgattggatcaccggtttcaaaggcaaagtactacctaatacgggcaccattatacaccactaaagctaattaaataacctaccagcttatcactacagctacaaggataaaacttttatcataccaaagtttagctacaacaacacacatcgtgacttcgcgagtcatcaataaagcaagaaactttttttcgcggccaaaaacagcgagaggccggccacgattgacaaccgaatcgcaaccctcaccttgttgatctcgagctgcggcgcccacgagtggagcagggcgaagaagtagtcgaacatctcgacgcccgtggcgaactccttgggtcccagcttcaccggcttcgcctcctcttccttcgcgccctcctcttcctcccccttcgcctcatcctccgctcccttcgcctccccctccccctccaccttctgcttcttggccgcagctccctccgccgcctcctcgccagcagcgccggcggcggagtcatccccctcctccctctccctcttctgactcggattcgccg

SEQ ID NO: 32276 - DNA, 24021 bp, Oryza sativa
ccactcctccccgcgccgttccgacctctcgctcccgccgccgccgcggcctccgccgcaccgcgccgcgccaccgccggagaggggggccgctcgtcgctcaccggggcgttctgttcctaagcatcggcgccgccagcgccgccgccgtcgcctgcaggacggggtgcgccttctcccgccgccgcttccccttcctcgggtaaccttctctttcctctttgctcttagattttgtgtggaacccgcgaaattgctaggcacgtccgaacatgcggctgctaaaaaattgaatcgctgaagtatggtacaagagtgtagtttatccatgttatgacattgatggatgtgtgaactttggaggttaacattgctacgcttttatctagtttgaattctatcttcttgtagtgatatctgaatgcaaaatttctcagggtaagaggtctcagctctgctcggatggagtccgcttccaccaccgtgccatccattgttgtgtatgtgactgttccaaacagggaagcaggtagtactttactgtgtttttgttcttgttatattgtgtgcgcatttcatttgtggaacttgctaggcaatatatttcatttcctccaagataaagcagttagagttgagattgatcttgcactatttgtcttgtgagcatcatgtttctcctttcaatattgttgtttagcgtttatttttttgttaattaattttagcatctatttctgccttttgtttaagcagtctttaaaagcatcatgtttcacatctactgcagggaagaagctgtcacagagcatcatcagtgagaaactagctgcttgtgtcaatatagtgcctggtttgtcactttgctcatcacttccgtttctctgacactatatgcctatgaacccagatcatatgtcagtgttattggccctctgtattccatagaaaacatctttattaccttcaaaaaatttaatggaaacactgaaaaggtttagtagaggtggcagtgtaaacgaattagatcaagaaaatccatcatatgtgggaacaaacccttttaaagctttgcttaccttactttggactgaaacaagaactctgttgaatcacgaaatataatggtgctttggttgtccaatgattgttgcgctgcccttccttatgctgttaggcaacaggtgctgtgccaagattcgcaattagcttgtttcatattatcgtttatactgaattatactgaagttctgtacatttttcaggcattgaatctgtttattggtgggagggaaaggtgcgttgtggaaatttacctatagactgaatagattattaatagttctcatctttgtaattcagtggtttatcattccttcggatgatgtatttcctgctccttagcagacctaggatttagtgatcaataatctgccttcttgcaggtgcaaactgatgctgaagagttactcataatcaagactagagaatctcttctagatgccttgactgaacatgtcaaagctaaccatgaatacgagtaagcttcattcagtttattgatcttgctgtacaatctgtctgtttactatagtttacttgtaacttttctccctgaaatcttaatgtaatttggttggcctattctttcggccggcccgggagaaaaatgttcctgtcagatttactggtaacttgttcatgcagtgttcctgaagttatcgctcttcccataactggtggtaacaccaagtacctggagtggatcaagaacagcaccaaggcaaactgatctggcattcaccctgttgtatacgcgcgctgcagacccgcagctcaaaaatatccaacaacatgaagtaactgatcggatgttctctgtttggcctatgtatcacagtgacatttgctgcaaggaatatatgtgtggttgccatcttgtgagttctgatgagtaacttgggtctataattctgctcacataaaaaatcgattcagtactcatacttgtgaattgctgcccttgatttggtattctcatatgaagtttttctagcgatgcaaatgatgaagatctttaagatcgatgtaaacataccaattcacactggtaaaaccctgagtacgtacgtaatcacctagatatagccctattggcacatacagatgagacaggcgcccgtgaccaagttttgatgtcacgtataccttattgcacagatcggaaagctacaagcccacaagaggacaccgtgatttcagaaagggaaaagaagagaatacatagactgcacaagccgttctcgtgcatttgctagcagcagcttggctctagatgagatagcggtagatcatcttaattaatcttaattcttaattagttgcaggactccttggcgaagccgacgcgggagttggcgacgtcgaagacgacccggatgttctgctgctgcaggttggcgatgacgttgacgacggagttgacgttctgcggcgcctcggccatggcgaggcaggccagcggcgtggcgctgctgtggatgagcgtgttctccatcggcagcgccaggtccacgccgccgtccatgtgcaccgtcaccgcgggggctccgccggcggccacctcgtcggtgttgaagcacgtgtcgaacgcgcccagcgacgtgtacccgctcggcgccgctacctgccgccggaactcctcccgcagcgccgcgtacaccggcgccgtccaccgcgtgatcaccgtgccggagtccaccaccgtgccggcgccggtggcggcgtcgaacgcgaacgatcccgcggggaccttcacccacgcgtgccccacgctgagccccgtcacgttcacgtagtagagagacgacctgtgcgggttcctcagcatcggcgtgtaccggacgctcctcggctgcccgccgccggcgcccagccggagcgagccggagaagtagtatgacctgtagctcgggaggcagtaggagaagacgccattgtacaagctcccggcctgggagagcagcgccatggggccacgcccgaggccgagcagcccttgccttggcatgttcgtcgtcggccccgtcaccgagctcacgcacccgaacgtgtagttcgggatggcgtccttgcccagcctcagcgtgtcgctggcgagcgccgcctggaacgacgcgtcggcgaacggcttggagaaggcgcacgtcggcagcgtcgccggcggcggcgccgcgtcgccgccgccctgcggcgccgggcacgcctggccctggaacagcgggcaccacgacgaggagcacgggagggaggcgtaggaggaggagttggccggggcgaagaggctgctgctcgggcacgtgccgcacggcgagcagtgcgcccacgtcgcgtcggcgctggtgtcgagcgccagcagcagctgctgcgacggcgagccgaggccggcccggacgacgtaggacgggggggcctggccggaggcgacgggggcggaggagacgccggcggtggctgccttggaggagaggaagaggaggcgggcgtcgtcgtcgcgggcgagcgcgatgatggactcgagcggggacggcgacgaggggtgcacgttgtggtacacggagagctcggcggcggcggcggcgacggtggcggccaggaggaggaggaggagagggatggtggtggtggccgccatggcaatggagctctcctggctaagctagcttgcttgctaagagagtgtcactgaggggagtgaggattgtgactgagcgagctgggtttatatagggtttctggctgttgatcctgtagtctttggcgccgatcgattgaatggtttgagcttaattacggcggcacggacaacatgacgggctaatagcgcacattcaaatcattaagtactactctagtactctgtccaaaagaaaaataaaatctctaacataagtagtatctaggttcgtagttagaattggacttgtttttgtttttagagacgaatgggtattttaaaaattttgaaatatatttattttttgacaatgaactttcgtaaatagtttctgtaaaaacagattatttattggcttgaaaaaacgtgctcacgaaaaagagagataccataagctaataagttcatcattattaaggtctcctttgattcaaaaaaaattcataaaaattttagaggatttcatccctgtagaaatttttcctatatagccatttgaatcaaatgagtgaaatcttttggaatcctataaaattcctatagaatgtctaatgccacgtaaattttggaggaaatctaacacgaggttctacctcatggaaatcgtcctttgagtttttatctctcctctaattcctgcgttttttctgcggtccaatcaaacggtcattactgtgtttttcttatgttttgcaatcatctattttactcttacattcatatcaaatttttgtgttttttctattattacattttctcaatcatgcgatttaaaggggccttaagcttttaggaccatttatatattaatttgagttaatagtatcgccgatgatttttacagaacacgttaatttgaaaaagaaataagtctttaggattaacttgcttatactcttatagacatatagttgtttcttaagtttaattgtttttcgaaggttatagtttaattaaccgtttgaccaagcacatacggacaccatcttggcatcttttgactaacctaacacatgctcaaagaatgtgaactttggtcgttggtattatgccctcacaactccaccgccgtacagttcgatgctttactatttacctcaatcatcatctcatggtggtagtaaataaattatgataaggtcttgatttttgaacaatgttctgcttctcccttggagtagaaagattatttgggataagaatctctcactagacaaaaattgtcacaagaacaatgattaattatggagaagcaaaatactggcttatcacatgcaaaattgtagtggagtgagatgcacagaaccaaattgacccttttaattacttagttaagctgagacagcgaggaagacagattaaggaagttaaacacgcctaggagtgcgaccaaaagtcacaaagatgggcaagaatattgtaccacatcctgtcaaagtttttgtccggccactgcaggtaaaacctgacgaaatccttgattcctgacacgtcctgagacagcttcttcacgggtcaacaaggacaaggatcatcacaccctgtcgacgaatcaccaggtgtgtcttagcttagttatcaaccaatcaacaaccgttgagtgtctgttaataattactgttaatttgcattattctctgggtcattggctgtgaccggcgatcaggttaacttgtttaattattaacttggatgtgtacaaataacatcaacgtagatgctcgcatcctggtattttctgcagtctgcagaaacatgtgatccgaatgatttgttcaaggaccacgatccattggtgagtaacgcatgcttgtacgtgttgataaccacacttcctatagaggggtatcttagaaagatatttaaggctttttttaggaggagcttttagcttttttatccatattttttatagctgtattagttacataattaaaaggataactttgtataattcagaaaatttataagaaattagaagttggttttccaatttcttcatattctcgtccgctgcttctcaagatataaaacgtaacctacatgcctattcctcctacaaagtaacatatgcatgtctgccatgtccgactctctgactctcatcctgtagtatatgtaattgagatgcacttgatagtgtaatagtagtcggcgtgtggtttcaactctgaggttttatgttcaatccctagccctctcacaatttcacatccctccaaatctcttttttttttctctctttcagtacatgtatttgcttcctcacaattaatctccttttattttctttcagtacatgtatttgcttcctcactattaactagctagggaaatattgatgtggactatggatattttctcggtgaatctattgtgctgtgacgcctacagatccaaatgtgtacaaatccccgttcctccacgcgtgattccgcggcctcctttctttgggggttggattctactgctcgtctgttccttcttcacgagcagccagcggcatcacgtcccatcccttccatccagctcggcatgcattgcgtgcgcacgtaaaaagtgtactacgcagccgcgagcggatggcccgtgcattgctgtactcagcgcgcagatggctaagtaaccttcttctcaatataaatgcatctgcgatagaacttgagatatcctacgattacgaatctgcatatagttatttgtccagatttgtatttgtagaactataaatctaaatctaaatagttgcttgatcagatttatagtcgtaagatataacacatctcgcactaggtatatttatattgtaacaaaggaagtattgacttgctaattgatgagaatctaaaaatacacttagcttttttttctttacttttttttttagattttacaactcaagtatcttagaggcttccatcgtttgtcctataacttattagccgctgccacctaaaaattaatcttagagttcattttgattttctttttcattgtagttgtagtttatttttcaaagttgactttaaatttattaagaatatatatatatatatatatatatatatatatatatatatatatatatatatatatatatatatatatatatatatatatatattaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgccctatatatatatatatatatatatatatatatatatatatatatatatataaaactacccataattttttttggcgaatcagtggtaactagcatttatgtgagaactgcttaggagaaattaaaattctagaacaagcagttgtccgaaaactctcctatcgtcctggcagaagagagcacagctgacaaacgcaaattgtaccttcaaaagtgccttgcaagcaggcaacatcaacaagccagccagccaaacgaacaaaccagcagtcaacggtgcaggacgctactgaaattcagcacgaagatcgtcgtccatccgtggcaagcatcgttcccggccatggctatgtacaaggtttagccacttatcagcaaattaattagcaggagaagcaaggataaggaacatagacagatcttcctacatctattaatgcatctatctcgtgatcgaattgtcggtgagagtaagcccaaaaccctcccctgtttcctcctaacacaaacagaacaaatctatactccatatattaatctaacacatatctgctaatcttcgggaggccaactgtacgtcagtttgctactccattttatattacaagttatttcaggtttgtcctatgttaaatatcaactatatttgtagaaaaaaaagtagaatatctatagtaccaaattatctcatcaattataaacctataattgaataacattttttaagtaagtttgtttcttgctgaaaatgcttatacaatttttaaaattttagttaatttgaaagacgtttgatttagaacaaatttaaatgacttgtaatacgaaacagagggagtacagttggttccctatgcttccaaagggagcaggttcacgggcaccttgttccttgcgggttgcggcgaattagcgatgcacgcagagttgcagacaaagctcgccttggatcgttctaatccacggctaataatgcagttttgttctacgtgcgagcctcgcttgcatgcgtccatgcggtcgcagggatcagatccaatcccgtgcaaaagctcatgggaggatgcagttttatccagatgtagtacagctcatctgaatttcctgccacttcatctgcagtgcaaatgggttctgaacccataggttatgatgctttgagcttgcggcaaatgggttggaaaagccaatcgttttcttcttttttttttcattcaggaactctcaaattcaatcaatcctagctttttttttttttgaaataagcaaaaaggaatgcctgatatgactatatggagcatggagcagttttgtacgtacaagatttgcacaaggcacaatcctggttcgtgctcagatttgaacacaagatttatatttgtttccgtgtctctgacaggtcaaaatgcttcactggcgttggcaccagccaaatgatcatacataaaattccatgatgcgaatacaatcgtatatctacaaatgcaatcaaaccctgacgttttcacaagccctacaatattaagcggcactgataaacagccaagtggacagacaccacgacagaatagaatgatggagaaatgggaaactcatacaacagggtgttcgtcctacagacggccgatggatttcagcgaagtgaggtcttgccggcgagatggagcaacgcctgcttgtggtaggcggcgcggagctttttgtacttctgaacaaaggttgggaggtcaatgtccttctccaggaacttctggtgcagctcctccgactcctcgtccaactttgccatcgattctgagcaagcaccgaagcaattcatgaaaatgtcagcggttgcggttgggtgtttgaaaaattaaattacatggttggacttcaaacaatgacagaagcataaatcaaggtttcacgaaatggaactaacatagacgccactatgacgctagtaccagtcctagcctgatcattggccggttacagaagggtagtgcattcatagcaaacaatagatacatacaaaacatgcccatgattcggtgcactaattcacataatgtattcaactacaaataataaagcacagactcttattaaaatacacagcaaaaatgatgcagatgcagctgttcagaacccttactttggagcttgtcgagcagtgcagcaggagaatatgacctcataatctcatccttttgcctttccaactcagccaacctatcttgagcagcagctagttctgtagttcttataatggtgcactgcacaataataaatgcgatttgaatctcaggaaaaaaaattgaaacgcagacaaaatccattattatagcattaactgtatttaaagttcgtttaacaatgaacatcatggctacagtagcttatagtttctgagatggaggtcacagtactaaacctgattcctgagctccaagatccgttgctctttttccaaattttctcctgtaagttcagaagatccaaccatatttgatttagaaacagtagtaactaacaagttgtttatatctttttcatagttaagacaatccaataaaaaagcattgcatgccgataacagaaacacgaataactcacttgcaagttgcactgtctcctttctaagctcatcgcgtaactgaacattaagaaagaacaagaagtgagcaaattgacaagaggtctagcattcagacaagtcaactatctaaggttaaaagcagcaccgaatataaattaaagaataatcacccacattaatgcccaaatcacaggagatgtgccacagcccaaagcctcaaatatgaggccagaaaaagaaaaagaaaaataattggagcatatagtttggagtttcctgtgtatctttaactactggaggaaatacagaaacatctaagtacagccaccaatacaaatttcaaacacctgtgtactcagcaacaaaacttacgttgttctgggttttaacttgatcgagtgaattgaagaaagcattatatgcctctttgtctttcaacagcctctgcaactcatcaacactgcagaaaaaaggacagtattatatacagcagttttgcattccaaacaagcatgctcacaaggaatagtgtgaaaaacacatgtagtaaaggtggcgattataaaaagcaacccaaccatacataatcacttcttttagcatttatatacatcccttctgaattgcacaaattgtcgtgccctctgaaaagctagggattcttcattcattaccaattgatagaatatagaatatcagccatgatatcattattgcaattaaaaattcattactctaatattattagttagattctagtgactctcttttagtactaatataaacactagaatatgtaaaataccatggtaaaaagtaacaaggctgttgcaattttaacccacagtatagataagataaggcataatacaatgaaacttcgtatacaggaagctacaagcaacttatcaaaaaaaggttagctgctgaccttttgtcctttaaccgagcaattatccctgcagcctcagctggagatggttgagcacgcgatgaagactgggaattatcagaagctctttgatgtggaccaacattggaagagcttggtgtggatggatgtgaagatgaaccaactacagactgagggtaccaaggttgcgtagggttgtcctggaaatttggatcaggttgctgctgctgcgagttgctgctggcaagcattcagcagaaacaaagacagtaagccagaggagctcgtttttcaggaaagcttaaggcaataagtgaatcatattaaatagccacgttaatttacttatgctaaaaattaaattcagcgtaactgaagacccaaccataagaaataacagagtagctgagtggtggacactgttcggatgataaaataaacttttggaacaaaagcaaagcaattttttgagcatcaatatctgaaggctttttagtatagaaagaaactaaggattacgaatcacatcaagcctgctggctggcactgatcaacaaatacaatactttctaccaaataaaagaggaagctcagtttatagaatacaaatgctatgcgaggaaaggttaggaacagacataagaagaacaaacgaaaaaagtattgctttcagtaaaaataacatacccaaaaagaggaaatctccagctcattgtactagagcaatctgcataaaaagaaatagcaggttacatatgttccaacagttggtggtaatcaataagctgtacatgcatatagattctaacggaaaataactagtagatggtaatcgctaacgccaatgccagactaattgttggttgcatcagaaaaataaaaggaagaagaatggatcaaatctagaacaaattgaaatcaaacccctcaacgcagagttcctattgactattgtcaaaaaacgatatacttgtgataagtctcatgttcggtaggacgcgttttctactccaaaattactgcctgcgtaatcaaatcaaaatgccaagcatttggatggcaaaatgttctgtaggctacggcttgcttctactctcaaattgcctagataccgtagagcggttaatccatcactgaagattaccatgagctgctgataactaactaacttgggtgtgactttcaagaagtcatcagaacaacagcataaaaacgtgtcccccactcccccccaaaaaattccttgtaaaacctgtcttgcaaaactaattcctctacctgaatcacaatcgccgaacggattcgacaactttaacgggatcgtgaaacaaaccacagcaccggttttggatcgagggcagacacaaacctgccgagatcagcctcgaaaccgagttgccggtgcgggcggcgctcagggacggccggcgagggtcgcggaggcctggtctcaccgccgcgaggtggcggggaggggagcgcgtcgcgttcgcgttgcttcgggtgggagcaagcgaagcagcgatggacggtggccggcttgtcgaaggagaataagcaattgggatttgggggagaagaagaagagagagaggaggcgagaggcgacgcggagtcggacgcggactgggccgtggggagaggataggtgggctttctgttgggccgtgtaacctctgcgacttgggttttgtttgtgtttgcatcactgggccccggataggagaatgtgtagggagaagtggtccaaaacgtcgagaacggtagcatttgttcgaaacgattttcggtcagtcgaacaattgatcatattagcaatttattacttcctctgttacaaaatatttgacgccattgactttttatcatatgtttgaccgttcgtcttattcaaaaaatttaagtaattattaattcttttcctatcatttgattcattgttaaatatatttttatgtaggcatataattttacatatctcacagaagtttttgaataagacgaacggttaaacatgtgctaaaaagtcaacggtgtcaaacatttcgaaacggagggagtattacgatagaaatatggtgtttaaaagtgaatagaaaaaacaaaatttctatttgactaaaaaaatcaagaacatatatattatttatacgaaaaatgatgcttgatcggtagagaatttcagcgaatgttttcattattaagaaagtgtcgtccaatcatcactagatgtgtgtttatgacatgtttatcagggatttagctcaatctgatctcacgagcatagtctagatcgagtggagttgtgaagcagctcggagatcgttcaatcatggtgatctcgaagaagttgagttgtgggaaatcgttcgatcaaggtgatgttggagttgacggcacaatcaaatatcgagatcaaggctgagggggaagtgggaagtgagtcgtagtgcccggtgagggagacagcgtaggtacgtaattagagctagctagtaagctaagtacggcgccgtcgattaaacaccataaaaccacggcggcacacgtacgaccgatcaatattcgatcgatttaccttcatcttgtaaggacacgataggagcatcaattcctccggagacaatctcagatcgaaggggcgatcgttaacgaaagcgcgagattaattttatcagctctctagtgtgattctctctggtatatgctgagtatcattcgtaagtcgcaacccaccgtaagctatgcaatcttataactatactaattttagtgttgatccatgttaatcatacaggaaccacctatatatttatcgacaaattttcttttaaaaatttgatagatataattatagtacaatcgcaatgtaattacactgtaacttgcatgtaactacagtataacttgtatataactttcacgtaattttgaatcattagatctattacaagatttgttctagtgacgaacaaaaagatcacagtacacacgtatatgaaaggatttgttcccacgacctcgattttaccgaaataacatgttacggagagatttttgaaagttacatacaagttatattatagttacagtgtaattacatacaagttacagtataattacactgcgattgtactgtaattacatctgttaaatttttggaagaaaatttgtcgacaaatatatagcaaaattgaatcatatatatccttccttccttatatagtgtggttgcatctccacatttttcttttatttttcaccggtccattgactgtaacagtaaccgcgtcgccctagcacgatacggcaccaccttagactgtggtcttgacatgtgggccgacatggcacggtccgatataggtgatgtggcgtgttaggttaagccacccatttggcctgctatataacaggtgggtgcttggttaccaggtcacaatttaccacccctaaaattaggtgagtttaattttattagcagttgtttggttgtggtcgcagttagtagcgagagtatctttcaataaattggatctcacgcgttattagtaacataaaacgtgtatcaagatcatgttagccttgctaacatgtgattaagaatttaatcatttcaacttaaataaacgtgacgataatatttattgataaacggtgacctgaacgaaccacctactcctaaatttgtttgcaacactccaccaacccgtcttccaggctccaacacggcaacacctcatcacaccgcctagctactgcatcgtccacgcatcaatccatcggtcagtacgttgtccctcctgacctccctgttcctcgattccttcctccatcctcccgagaaaaaccacccaaaacagtttcttcggcgagagctcaaaataggatactcctacccctagctactctacaaaagctcatcaatttctgaacgatagcaggaggctttgccgtcatagaaagaaatggacggacgatggaccgactgatgccaacgtacccctcttccacccccccttcccctcctctctcctctctcatggctatgtttagggcatttgaccggatgtcagaagtcctctctcctctctcatggctatgtttagggcatttgaccggatgtcagaagtcctctctcctctctcatggctatgtttagggcatttgaccggatgtcagaaggagttttcggacacgaataaaaaaactaattttataactcgcctggaaaccgcgagacgaatcttttaagcctaattaatctgtcattaccacttgtgggttactgtagcacttatggctaattatggactaattaaactcaaaagattcatctcacgaattcctccctaactgtgcaattagttttttcatttatctatatttaatactttatgcatgtgtccaaagattcgatgtgatgtttttagaaaaaaaatttgggaaactaaacgggcctaatagttccaaagttttctttttccaaacttctaactttccatcacatcaaacctttcatacacacacaactactgttctatcacatcgtaccaatttcaaccaaacttccaaacttcagtgtgaactaaacacagcctaagagttgattcttttaatccctccatcctaaaataaatttaattttctacatatatcaatactccctccgtcctagaatataaggggctattgagttcctaaaaacatcacatcaaatctttagacacatgtatgtagcattaaatatagataaaaagaaaaactaattgcacagtttgcatgtaaatctcgagacgaatcttttaagactaattagtccatgattaggcataaaagtgctacagtaacccacgtgtactaatgacggcttaattaggctcaaaagattcgtctcgcggtctccagacgagttacgaaattagtatttttattcgtgtccgaaaaccacttccaacatccggtcaaacatccaatgtgacacctaaaaatttttatttcaccaaccaaacaggtcctaagaaattttagggctggacacggttattaagaaagtaggtagaagtaagtggttgagggttgtgattggttggaaagagaatgttggtgcagaagttgttatattttgagacaaatcctgatggctaaaaattgttatattttgggacggagggagtataaagcttaaaacagaataccatatttattaaatcctaatacagtcattttccagtactttatctgcttccgatatattttttaattttcatgaattttgatgtaatgattattaaaaataaacttattttaagataaatgaatgaaacttactcctaaattttattataggacgaagggagttacttttattcttcagtagctcattttgtagattacggagttttcggtagcttatattttttaggaccgaacatttcagaagaaactcactactacaggattgattatcctggacaccaccccattttatttccatgcggtccgtaagtcagactgcacggaaaaatggtgggagcgtcgcccgcacacgaaaatcaatttttgtgtgcaggtgacttaacaggcccacacgtgaaaataaccctattttcgcgtgcgggcctcctaatccacccgcacagaaaaatagtcgtccctcccatcctattcaaaattttcctctctctccccgcggccccttctctcctctctctcccttatcttctcaccttccttctcctccactcattttcctccctctttctctcaccttcttcttcagttgcctccttctccacaacccacaggcgggacggcggtgagctcggcggcggcgggcggacgtggggaggcggcggctggcgtagacgggatgggcaggccccagctcctcccctcccctccccagcagcaactccggcgcgcgggcgggcgatgacgggcgaggagccgcggctcctcccctccccggcggagacgggagcgcgcgggcggtggatccggcggacgggagggcgatgaccggcggccgcggctcctcccctccccagtggcgacgggagcggcgggcggtggatccggtgggcgggagggcgggcgaacgcacgggcgaggcccgcggctgtccctgcccggatccgacggcagcgttcctctcctgcccttccccgctcgagggcgacgacgacgaggcgggagcggcggcggcgaccacaatgacgacgatgacgacgacgaggagggagggctctcctctccctactttcgcgaggcgacgaccgggcgggtgcggcgaggcggcggcggcgagggccgacggcaaccggcccccacacgcccggatccggcggcggcggccgtccctcacggcggtgagggtcggcggcgggcgcgacgatgtcgacgacgagttgcggcggccggttcgcttgcaggccggcgggcgggcgacgatttttctttttttttggttttttttattccgtgtgggtggtatagtatgaccgcacgggataatcgattatcccaagcggtccttccgtccgcacgcgaaaatactgattttcacagacagcggtgtgcaggcgggtcaaatgaccgcacggaaaaatggatatccccgtatggcaaaatgagttacgtagtagtgactgtagctgtcaaaggatctgtttaatttgaggagcctctgacagctacgatttcttctaggttctcactcgttactttttagaatttggagaattctgtaatatatctctaggccctttaacaactgtcaactaaaatgttgtagtcgaggaatatacaaaagtacaactaaaatccagaagccagaagctatttattttcagctcatctcatcttttgtttttcagaatctacaaacatgccataggctgtgtttagttcatccccaactaccccaaactttcaagtttccatcacatcacatcacattcaaaacttttctacacacataaattttcaacttttcccaaacttccaactttttttagaaactaaacacatcctatggagtgggacaactgcagtttcttctaaaatactccccttttctaaaatataagtatttttagtacagtgataacccaaacattttaaactttaaccattaatagaaaaaagatcaatcatgaaaaaaaatgatgttactggatttatcatcaaacagactatcatagtatgtaactctttttatttaaatcatcttacttttatagatattgttggcaaagtagcatctcgaaaaccgtgtcagggtccaaaaatgcttatattttgaggtggatggagtaacaagtttcccaaacaattaagcttttcgtccagattctaagaagttgaagtcagagtctaaaaaacaaactagaagtataaggtgtgaaacctagttttttagattatcagaagatgactatcaaatgctccctccgtcaaaaaaaaaaagcaacctagagccacatctccttctagtagtacaacgaatctgaacaaccctcctagatccacatctcctcctaaattgtctttttttttggacgaatcagggagtactccatatgtcaaaaaagaattcaactctacggatgaatctgaacatatagattttcttttaatagaaagagtataattactccatctgtaaaaaaaaaaaccactaacttagttaaacctatttgatgtgattgattttttttaacgaagtgaggagggtgtttgggaaacagagacttattccaagtctctgtcacatcgaatgtttggatactaatttagagtattaaacatactgtaattataaaacccattccataaccttggactaattcgcgagacgaatcttttgagtctaattacgccatgatttgacaatgtgatgctacagtaaacttttcataattatggattaattaggcttaaaaaattcgtctcgcatattagctcttatttatgaaattagttttttttattagtctatatttaatactctaaattagcgtcaaacatccgatatgacatggactaaaaagttttagcctcacctaaacaccccttaattcttaaaattttaagctcttcgaaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgcctccgtccctgtggctccaccacttgaaagcctttgccataaaaagtaggagtcgtcctactcctacccctacccctacccctgctgcagtgctataggctagccctacctccctgctcctgtttcctctctttctctctcgcctccttcgcttcgcttccattggtggtggtctccattgctcccttcctccctgcctttttcttccataagtagtagtagtagcgggagtggccgccgccgcagccatagatctgcggcgccgcgtatctcgcggctggtttggctggtgcggttagcggctagggttttggttgtttcgtctgatcgatcctccccgattttgcggcggcggtggtgaattggtgtgtgatctgatatggctggcggcggcggtggcgggggaaggggggagggggaggggagggcggcgacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccaggtatgcatgtatatacagttatacacacaccaacacatatatgcttctctcttcctcgccggcgtctccttcgctcgctcgcagttatttctgtttaatttgcttgcaattaaatctcgatctgggtgatgatctctctgtcggttcttggaatatcgtactattgttagggctctttgtcgatcgatcagggtttcttttttcttctgaaatttccctaattgatttgccggtaagttacgttcttcatttggcgtgtttaattagtataaaatttatcataataaacataaaattctagtttatcgtgcttctaattgagttgttcagttgaggagttgagattgaggtcatggctttccaatttcggattttcggtcagctcttttttcttggatatactccatatacacaacagtgatagatgtgtatattttttctcatcatcggctctttcaatcttaaaacagttttgtctttggtttatatagaattcgctagtgtgtgtactgtgtaaaattctttcaatcctacaacagttttgtctttgtcttttgctttctctgattctacaaaatgcttttgattgttcggcgctttgattcattttcttctagatgagtaatgtaatatgttcttctagggaatgttctttaattcccaggaaaaaaatgtcccagcttcttaaatagagctctctgtatatgatgttattaattatagctccatagtgcgcttaatttgaaatattgtttagcacttatgtcgtgttctcttctatctttcactcgacccattttttataatgaaaatggttaatttacaccgataggcacacggctatatatatataagcatatatagttttttttttcactcttgaagtcagcaatcttattcagttaatttaagaccgtatggaagagactcggcagagaggggtgttttctctcttttggactggatgaccagagataaatagcagattttcttgggaaaaaaaaactaaagtaggacaggttttgcatgcatgtgtgaaagcactcgtggaaaacttaccctgttctcgcatgatttgatgtgtagttgttatacatatagataaccatatctacattattgcttctggttggatcttctcataaaactgcatctttctccatctttttctacaagctcagtggacttccaagtatcttctctgctaatttcttgacactgccgttctttccacgtttgttacattattgcttttgacatcactattttaattaattagatcttgtagacaacaccctggacgcttatcaggaaacagactatatatcgttcaaagttttttgttgaaattttaacttgtaaaaaccatctggttttagttaatctcatcgatattattttcttcattaaagcaggaataagaaggcatgtagtttgtacatgcatatatatactgaaattcattattacagctttcagagatcagcagcagatttgtcatgacaattacatattcttcatgcgtgagtgatatatatatatatatatatatatatatatatatatatatatatatatatatatatatatatatatatattcaattctgttgcttttgtcacgaatagttgttagttttaaccgagcgtgcttaaactgaccattatttttaagcaacttcaaaataaaaaggtttaagtccaactcattcataaattatttttttattacaaatctaatggtataactttgatgctaaatactaactagatttcttaaaaatattgttggtcaaacatagctaggcaactcaatgaaaactaacaactatttaattcaaattatttttaatggatatggtatatatcggtatacagtctaattaatttgtcaactgaacttgggttactgatggttctaaccattgtgtatacatatatgcaaacaaatttagtcctaattatatgtcgtaacatgagggtacgtactgtgttgatcgttttgtgttatgaactaatcacatggaaagaagtgcatatatatatctaatgtcaagagtgttgttaactgataccccacatatatataccagaatgtttacagtgttaattaacacatggcaaaatcaagcaaaaatacaaccaatctaaacttgttaattgttcaatctttgtattcggggtaactaattaagctagagctgtcaaacgaaacgacctctgatagtagcacacatatatgggattctccaaagtgataggtttgcgactgttaattgtttgttttttttttctccacaagcgacgacagaaaactagctagtcgatctattcttttcatgtacatcacttacactatttgccagtgcatgacatgatctatcagcatgcatggatatagagtgtgcataccaattggcctggtagctagaaaaagattgaccaatccaatcaaatggatccctgagcttacgtaccgctatcagagtttgtccaaatatattttcaattataatatataaaaatataagtagatatttaattttattaaagtactttttaaaactaatctatgttccagtgtttttttaagctaaatatttaaaattgttaaagttctagtcaaacatgataattatggaattagaaggagtacgtacataagagcaagtataataaaactcaagatcgtgcttataagactcaagtgttgtcttttaacagtgttatgttgcatttggtgatgagtgtggggtaagtgaggagagagagaacgaacaatctctcagtataaaaagcagcctctacataatttaaaaagtgcaaatactagtgtgatagtaaacaaataaataacattagagtttgtgtattatggatgagatatattgtactacctttgtctctaaatacaaaagattttgcttatgtagatatatatatgggcaaaatctcttaagatgaaggtagtacacatgttttatatatatatatacacctcctgatcgaatcgatgaggagatatgagggataaaattaaaggcggtagacatctctattattaaacttggctagcactactactagtctacatgtataaacatgaaaccattaatcacacacacagagagataaaagaaaaaaaacaagaaaacaacagaaatgactgcttaaatggagcatatatagaaaaaacataatataattattggaagatagatagatgcaaagaatattttctaaaagattggacctcaagttaaaagttctctaatatccctatgattcgagccaaccataaggaatttcataggaatttggaatgactattccttcgttccgattagacatatatatagggttttctcaactttataaaatttatttaaatttcctttgtttgaaaagagccataagatatagtactagttcatcatgtcataatacataacaagaaccataagatatagtcatgtgtcttcgtcttctagacttctactattcctgctgcctgtgccatgtcatgcatgcatggtccatgcatgaaatattgatggccacagaacaagctacgcgtggcttacctcttcacagaagcaattgtattttcttcttctcgttctctgaaacaatcaatatggtagttcagaacattcatatccttccaatatggtagttcagaagcaattgtattttgaagggcctagaagaactacctaacaatatttggtactactagcatcttgatgaaaacgtttggattcaacattacaaaccttagctagctctacaaacatccaactctgtctaactttgttttctatatatacattgatgaagcatggaacagattattgaccggtacaactcgcattccaagacacttcagagagcagaaccttctcaactcgacttacaagtaagctgaaaatactttcacttgtattacaaaagagaaatgcaacagctatatgtgatgttgatgatcgatataccctctcatatcactcaactttctagaaagaattagtgtggaccttaattaattagtcagttcttaagaaactgttgctagtggtacttctctgaacatttc

SEQ ID NO: 32277 - DNA, 2154 bp, Oryza sativa
  unsure (1)..(2154): unsure at all n locations
agagttgtaggtactgtctaattctgtggattcacaggatggttcagttagtatatgtggccattatttcccttgtgtgttcctgcaggcagatgagaggagaggagttgcacaggctgaatgtggaacagctgcaggagctagagaagagcctcgagtccggtctaggctctgttctcaagaccaaggtacgcgcagcaacatgagactgtccattggacgtacgtagttgcaatgttgcacaccgtgatctttgatcatgttcttcttcagagcaagaaaattctggatgagatcgatggactggaacgaaaggtaagagcatgatattttggccaatctccagcttcagtacacagctacagagcgaaactgaaatgcagctgaaattaattatcttctgttagatcttgatttctctttctcatcacaaaactgctccatttgtgtgatcaaacagaggatgcaattgatagaggagaatttaaggctgaaggagcaagtaagtacccttaattttatctgccctgtcgaaactcgacagaggctcggagatgtgaaccattttccattatctaaaaagaaaactttctctctatgcttgctctgctcgttcatttgattaaacgacgatctgaagctgcaggtgtccaggatgtcaagaatggaggagatgcagcctgggcctgattcagaaatcgtgtacgaggaagggcagtcgtctgaatctgtcaccaatgcttcttacccgcgacctccacccgacaacgactacagctctgatacatctctcaggctcgggtgagttctcccatactttcagttccaactcctacctgaatttatgtgtcaagaaacaacagaggttagttcgatgatgaacattcaggttcagatgatgagttgtttactgattgattttgcatgtggcaggttgtcactcttcagctccaagtgatggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaataagctattttttcttaaagttctagctagcttggtacagttcataagccgtagaaaaacaaaggcaaataggacaatatatcaaaagtcatttttaggtaaagcttttatatctccattcttaccggtttgaaagcaaagtctgcaaaataagactacgatgaatgtcaccaagggaggaaaatccacaagcgaagcatatcgcatctaactttcaggctaatctgcatgcattatacaaagagcgatttttttgggaactaatgaattgacatgcatcgtccattaaaatagaggcctgcatgctttgggcgggcaagatatgttccattgcgtcatatggattggactaaaagtgagatgtcagctttagaatcttgagctggaaacgcattatctgacagttgaatgtgcaaaggttggagcaaactcatctcgtccaccgggaagacgataaaatgcgtccagatctcgctcatgtacataaaaatttcagattgcgaaattatccccagggttaaaagttagcactagtaaagtacttttagtttagggcaatgatgcacaagcctttagcgtgcactggatcggaaaatcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32278 - DNA, 40396 bp, Oryza sativa
  unsure (1)..(40396): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnncaaacagatttgcagccatgacgcactccacaagtagtctacacaaacgaaaaagatctcgcagcaaacacaccttgttttttggattttcggctgctgctggtgggcctcttcattatttacaaaactgaaggaggattggaaatggagatgatcctacgagtggagggttgcaaggagtgttgaaacttgaaagaagcggcagctagcaaccagaggacagaaattgcatgcagatgtgtgtaccccttcaacttttgttggtcggtggcaatggcctcccctgcttcgagaatcgagcagtgatcgtggagatgaactgggcagagtgccgattcgtcctttggaggacggaggtgagaggcggagagcagagagagaggtcagtggacggggcaaacagctgatgcaagaagccatggatcgcgtattaataaaaggacgcaggaggaggagctgaggtgggccgggaactctggttttggacggtttccaagatgtcctgtggcagaaatctttgtatgattcatgtgtcttcaaggcatgtttgatttgttgaagatgaacatatcaattttttgtaatgcaaaaaaaatgatattaacaaaattttataagttaaacacatgagaaatctcatgcatttggttgtgtacatcctttgaatatatagatgttgagttttaattcattattaaaacaaacactggactaataaaatgaccgctaatatctccaatcaagttcgactgcataaatctttttttaagggacaccggggcagagtctcctcacctgaattaattgaaatttaaaataactgcacaaaagtttaaaactagatcagccgaaccaggaagaagaggaagaaaacatcgaggagaaatacatgaagattagaacaaatgtagagggaaggcgaatagcgcctttcaggtggaggcaacgtgccagtagatctgtttgaagcgatgtgactataatctagccatttccaggcagagtcttctcacctgaattaattaaaatttaaaagaactccacaaaagtttaaaactaaatcagccgaaccataaataagaggaagaaaacatcgaggagaaacacatgaagattagaaaaaatgtataggggaggcgaatagcgcctttcaagtggaggcaacgtgccagtgggtctgtttgaagcgatgtgaccataatccagccgtttccgagcagctgcgcagtaagcgggaaactgagggtggcaggtttagaagatgacttcgtttcatccttcaggtttacttgagtgtgtaaacggagcttgaaatttgtgagccaaaggttcatccatcagccatttgccatgctagaaggaggtgcgagatccatccccgatctttttgacaattgcctggttatgacttgaatttcatcagaatctatcaacgttcatcgaataaagttctacggattcagaccatatcaattgaaataatgataattgtcgggtagttatagtcgaatttacaaaccccgaatagattttgatggacctttaagagtagaaacttccaaagttgccaaatcaaggtatggttgtgattgcttcatatattttattttgctgtctagccaaaatttagtaagtttattttagtaacaaaccaaacatacccttaattagttatatttgcatgcatggtgttgtttaactttttcttaaggttcttgaatgttagtgcatggtgcatatcttcaagtgctactcagattgctaccgaattattttccattgttattagtctacgacgctctttcactttagcatctcaaaacaatatgggtaaccttgttcgaacatttttctcctatgttcaaggcacccagtgattataagtttaatccatccaattttttgggcaatgtagtcatttgacaatgtataatcttcgaaactaaacatcaacaactatttaacaaacaatatatttttagcatgatataatatcataatctgaatattaatcgtaatcaaacttacgtatacactccttaattttgctatcagccaactgagatgcattataaatagatgtgttccattaaatgagaaaagacgaacggtttaaatcgactctacaactacaatcaatagaaaacaccataaaaactatcaatggaatatgtaaatttcgattgccttcctctagaaattatgacgtgtttgtgtgccaacgaaatatttcatttcgtaagtcttaagtttaagcacacagctgcatgcactgcaatcaaccacaaagtatcagggatgcatggtaaatcaatccagcttagtgcttctttagttccaactttttctttaaatttctaactttttcatcgcattaaaatttttctacacacataaacttataacttttttcttcaaactttcaattttagtcaaacttctaattttaacatagaactaaacacagaatcggatggcggtgacggcctagttttaaaccaagtaaataccagaagaaaaaaacaaacaataatgggagaactgcacatacgccactacgatttgctataattgtaaatctgccaccaccttttcaattatcaatttctaaaatgctagtggtttcatccgaaagttgcgaatataccaccctgccgttaaatttgactaacgctaccaagtcaacatgtttggactgtacattagatttcttttaaagaaaaacttaaataaaatgttgtgctcatcgtcaaattcatctgctggtagcatttgagccattttcttgcaaagtattttctcatcttccattttcttaagaaataaaaactactacggagttaaaaaaacctaacgatagtggcaaaatttttacaaggtaatctcccttttgatggcattctagcaattttcagaattttcgatggcatagacaattggagcatatagtaatgacaaatgtgcaattgttttagtattctgtgattctgtcgttgccgctaacaatttaaattcgagatcgatcgaactcagagttgtgaaaagaagaccttgctgtcttgtacgtacacaatagtaatattcgtatcgtttaatagcgtttgtggcgttaccatttcaagcaagcagtgtgggctgtgtggcacaaatgcatgtcaatcatatcaacagggacataatgtaagaaatatgtagagttagatatctaaaaaagataaaaaaaaatgtaaactcaagatataatagattaccattcacaataatgagagtgtgaattctaactcccatagtccacatgaattctatgttactcgatatagttaaaaattgattataagtcattttgattttatagttatacttctctgatatcatttatagaaaaaatttagtaacatctacgatacgaattagtttcactaaaactaatactcctatttgatatagtttaataatgtgtttgttttgtgttaaaaatattgttatatatttctataaactcaaccttaaaaagaatttgactaagaaaaatgttaaaacgatttataatattaaacaaatgtattcaagtttttgaacaagcattatagtggaacacccaaacctctctgaaattgttgtaatcgtacggtgttatgttaggaatacttgtggggtgttgagtagtaggagtacgtacttataattttatatggttcatgatgcggtactgttagggcaatcacagtgcatgcactataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgtagtgcacagtgttttttttttaaaaaaaagcaaaggaaatgtataaggaaaaaaaaaattaaaaatggaaataaaatgtttaaaaaaaagtaatgatttactaatgttaaaaaatgaaaaaatggtatttaaaaaatggaaataaaagtttttttaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctctttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcagccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcatcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccatcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgcctcgggccgcccgtttggcccggcccatttggccacctctagcatgcaccggtagaggggtgttacttgttagcctaaaaagttggcacaaacactcaatcccacagtgcaaggaacctaatttgggtgatctaaatagataaatggatggagatactgttgaaggcccacaacgcacgggggagcggaggaaaatcaattcctcacctacccttcgatttttctcctcccacccactccgccgcacctcgccacaagcgaacgggtgaaaaaccgaggaggtcgtcgtcgtccttattgtctactcccttgctcctccatcccgccgccatcccgctccaccaccgcagcccacccctatccttgtcgtctccacgggagcacgcgcacacaccgagcagcgccgccgccttcgccgagaagatcgccgccttgaccttctccgacctccctcctccccaatcggagcagaagcaggcgcaagcgctgctcggccatagccgcctctccgacctccctcctttttccctgaatctcgccgagaagattgctgctcggccacagctgtggcatcccggcccagggcttaatagaattaatagaatactcatatcaacaagttgcaacttcttttccggaagccagtctcgaaagaactctgaggttaagcgtccttggtgaatttcccgggtgcgcacgagtgaggacaaagtgtgcagaaaagacatgtgttggtctgtgagggcagtctatgacctatgaaagctatcagatgtaagcgggcccggcctaggagaggcgggacgttacaaagtggtatcagagctgactctcgcggtttcacgggcacgtgtgtcgcagttgcgcaggcatggtgcgcatggctggtgtggacctggagtggtcacacagcatggcacatgcgctggcactagacacacggacgtggccaagaggggacgttcctggcctgaggttgatcgacgaggacgttgatctttcttaagggggtgaggatgtggcatcccggcccagggcttaataggattaatagaatactcatatcaacaagttggaacttttttctggaagccgatctcgaaagaactctgaggttaagcgtgcttggcctggagcaatttcgagatgggtgaccgatcgggaaattctttccgggtgcgtacgagtgaggacaaagtgtgcagaaaagacatgtgttggtttgcggcggtgttggcggcggagctcgacgtcgaccctgccaaggtggtggtcgggagggcgcgaacgacggagccgcaggagggcaattttggatgacgaatccggaattcctcgtcccgttcgccggcgagggcacgacgcgtctaggtcacgcgctccacggcgcacagaaccttgccgcgcgtggactcactgcgagtaagaatcgcgcggctctgctaaggggcgaggagctcaattggagcgcgcgaccttgctccatgcaagcgcaaagccgagccggcgatgcgaagtaacgctccacgtcaccggactgtgagaggccttattcacctctctgtaagtacatctacgcaacctctttaattagcactaaactatagaacgtgaggttttgctgcatttgtttaccatttccttgggtggccaaacgtggcagcaaatgtgttgaggaaacagcagcgaagctgatacagtatctaaacacatgacaaaaagtcaggaaaaaaaaaaccatacgcgaggtcgcaaagtgtggctagcggacgccgtagctcgccaaatggctagcagcacccagtttgaaaggccagattcgtgcaacagcagcatgtgtcacccggtccaaaaacgatatattatcccctttctctcgacgtgctgtgatgtttgctggaacagagccatgccaaagatatatcatgaaagaggtgaacggtgacaggtcatcttttgatctgattccatttcgcctaaaatcttctctggtcatggccattatttgcttgtgcatgcagcacagaactacaaaaacgatctctgttccaccaccagtgagatcaacatcacgacgcatgtgcggcgtgctgaaactactagcagcagctattatagataaatcagcttcatacgcaacgccgctggcgttgacgcgttgatgtacgtaggctgtttttagttccacgttaaaattaaaagtttaaagcaattagaacgatgtaaggaaaagtaaaaaatttacgtgtgtaggaaaattcgatgggatagaaaagttaaaagtttaaaaaaaaaagttaaaatctaaacaggacgtatgtgacttctatatgaacttgcgaaggatcgaccatgtcatcttacggatttagggatatgtccattgtccgtgtaaattaaatcgggctcgggcgagacgaccgtgtctgcacgcgtgaatcacgacaaggaccctgctttacgggcaccaacggagctctgctttgcatcttttgtagccttcgtcctcacgcgcaaatggtattacctccatcccaaaataagtatagccgtggatatccgtgtctaacgtttgaccgtccgtcttatttaaaaaatttgtaaaaaatttaaaaatatttagtcacacataaaatactatttatgttttatcatctaatagcaataaaaatactaatcataaaaaatttcaaataaaatgaatggtcaaacgttgaacgtgaatagcgcaaaactgcacttattttatggaggagggagtatatgccaagctattatataatgccgacgtgtcgtgttaagggtctaggatattgttcacttggacaatcacaaacgtgccgtatgctgctattagcctataccacgtaggcaatgtatcctatataaaaaaaagagtactattagaagataacgacaatgcagaattgcagagccccatcgcttgatgagagtgttaatacgttctagattaatgagggtcgataatgggtgtcgtacatctgctagtttccttttttttttttcaacacttgtgctagtttgctcaagttccgcagaacctatcgatttaccgaaatatccaatcatgctatcagctatggatgtataaacgccaaaacacggcgagcactagggggtgaaaacggtacggaaactttctgaattccggacctatttttgaaaacggaatatgtcggtcggaatttttcggaaacggaatcaaattcgaaaatattttctcggaaacggaatcataaatgataaggacagtttccgtcggagctcgaaatcggtcggaaactttccgaaaattttctcggaattaccagaaattttgtgacggaaataccctgcattctctttttaagcactgaatagtaaataccatggtgtttgtctgttattttaaaaaaataatatttgttatgtaaatctaaaattacataagaatattttttttgtcatgcattgggatttatcaacaacataaatcttttaaatatagataatttattcaattggatttatcagtttgagggattttttattccgataaattttcgttaccgtattcgcgccggttcgttttcgctccattttcggtttcgataatattcgattccgttttcgtatctgaggtttccaattccgaacccgaaaagaatatgaaaacaaaaacgataaagatagtttccgcctgtttccgtaccgttttcacccctagcgagcacaggtcgtgcgcccaagcactatactaatagtactggtactatgcagccatggtaggatgtagtactgtatagtataaattgagccaaaccttacgggaaactgttttaaatactcaagtggacgtccacctgtttcttgtatgtcatctaaatggttataaaaaaattgacatgatagattaatatataatatatcacttcaaaaacatgcaagttcaaattcgatttctacaagttgtaacaaaaataacaaatttaactgtgaatattagagtttaatttgttatttttgttataatttatagaagctgaatttgaacttgcatatttgtgaggtggtatattacacattaatctatcttcttgttttttttttgaaaattttttataattatttacttgacatgcaagaaaacgattagacgtccatccaaaatattaaaattcatcttccaaaccttacacgtatacaagaccacaagtcgcgcaagcaaaaaaagtcaggcgcgacctaaccacatttttttttccagccgggaatctgttctccggtggcctgaaaagcagcccccggataagcaaccttcctttgcccagaaagtcgcgggccgcatagcccgattgattgattgatggccgcatcaacaatccaacccaaccaataaagcggtagcctgccacacgcacgcactagcgcatggaccatactactgtagtacgggtcgccggaagacgacgccgacgtccggtccggctcggcctcgcgtttcttccacgtcttacgagttagtactccctccgtcatttttacttgcaatgtttgaccactcttcttatttaaaaatttttaaaattattatttattttatttatgacttactttattatctacataattttaagcacaacttttcgttttttatatttacaaaaaaaaattaaataagacaagtggtcaaacgttgcaagcaaaaactcaaaatcccttatattgtgagacggagggagtacttcattggtcccatacaaaattaaccgataatcagatatgatatattctaatattatatatctaaacatataggagcacacatttaaattatagtgttatgatatgttctaatatttgaagtcatctacctataaatataagatatgtaatatacttatattttgatatgtgaagtcatctacctttttcgttttaaaatattgctatctaggataggagagtaacattttgggacggagaaagtagctaacaggatctgtttccatccggacccatcagtccatcacaccattgatcatccgattccgtccacccaggacgggagtaggagaaatagcggaaagcgaggcagcgcgccaggaaaaatacggccaaattgatcccagcttctgttcccacagagaaaacaggcagggggtgacgggtgaccagtgacttaacgaacagttttgttctttgttgtatcaacatgagtatagtagtactccttatcaacagtctgctgggctaaaaactcgcaagaattgtcctctacaacgtgttttgtttttgtcgagtgtattggaagtgcagtgaaatcaaggcggtctgaagtgcaggagtggtactctgtggtactgacaggagcctactaggacatggtccgtcctatattaaattaatctaatacgagataaaacaaactccatataatagtgttataaatctaaacaaacatctattcatatttatagtactaacatatacattatgttccacattaagttaatctactaagtgatgtaacgtattgtattactataaatctaaaagacatatgtgtactagtaaggtatattatatcctacaatagattaatttaactcgcaacgaagaaagtacttccttcgtgaaaaaaaaaactaagattagatgtagacatattctagtagactagtacaataaatctagacaaaatctcaacgaattcggataaaatcctagtacaatgaatatgaataaaatgggagctaggatatttcacatctaattctagatttgttttagtatatcacatttagtcttaagtttgttttatgagtaaatttcataaaactacatatactttgcacaatctatcgcaaaactatagattttagaactagtttcacaaaactacagatttaatgtctttgtttatcacaaaactacatgtactttaaacaatatatcacaaaactacatatttaataacttatttcacaaaactacatgtttaatatcttcatttatcacaaaactacagatttagtgtctccattctcacaaaactacacattttaacaatgctaaaacatgtagttttgtgagaatggagaaactaaatctgtacttttgtgataaatgaaaatactaaatgtgtagcactgtgataaacgaatacactaaatctatatttttgtgaaacaagttcttaaatctgtagttttgtgatagattgtacaaagtacatgtagttttgtgataaacgaagatactaaatctgtagttttgtaaaacagaatattaaatctatagttttatgataaattgtacaaaatacatgtagtttatgaaatttactcttgttttattaatggagggagtaggagcgaactcaagtcttctcacatctattgtatccggtcgacgattataaatgttggagtctagcggtaggtgcactatgcactgtgcactgtgctgcgatggttgggccgcggtgcactgttctgcacaatgttaagcgtcaaatctggtcccggctccacctttatcgagcaaacagagcaaggacagctcaagtcacaacaactcaacaaagcgtcgactgtgcgagtccaccagcgatactcctagtcgatagatacagcggtacaacctcagctttgtttggccgagctctagtgccacagtagtactggcggtgtgctggctcgtcagtgtgaccaaacatcgatatgctcttcaaaccgctacttcttccgttctaaaatattataatttttagataaatagaacatatcataatactataaatttaaatagaagatctcatgttctattcagattctaatactataaatttaaatagaagatctcccattctattcagattcgaatttagatagaagatctctcgtttcgttctattcagattcgtagtgctatgatattttatatttaactaaaagttattatattttgagatggtgtattcaccagcgtcgtcgtaccatcagcccacgtgacgctattctttgatagtgtgacgcattcagagatgcgagatgggcagtgcagcagcatggcatacacatgaaaatccacactggtcaggacgagccgacgaccagatgcactggcatgcaacgcatgcactcgtgcgatcgtgccagtgtgtagtaagatgaatctaaggcgtaatttttcacgtgccgaaaacggctgaacagctcgtgctgccggcattggcgaaccatagagttactatacttgtagtagtacagctcacactttccgatcgatcgaccagagcgaatgaacctcgtcgatcacgggctcacggcacccacggccacgtcttttccttgctgataagcgaggtctcgttgcaatgtctcgtgatctcgtcgctatcgccgcaaccccaacgtcggattgggtttcggttgcaccgctgaacaactgctactcccatgtttttttcttctcttctctgcttttaattgagggtacgacgagttcaaaatccctgtagctggcaataacgtcgtaggctaacaaccctattagacgagtttaaagaagggttcagacttttcaaatcgatggaaactttggaggctagtgtaggccgtaggtgctacgggtgtgtcatgttcgtcaagtgtggtcctcatgatacagtaccccgatagtgcaatcaaaatgtttctttttttaagatgacaatcaatgagttcctttatctacagattgcagatgccctttagggtctgtttatttggtgaaataaaaatttttgagtattacattggacgtttgactggatattgcaaggggttttcggacacgaatgaaaaaactaatttcataactcgtctggaaaccgcgagacgaatattcttagtctaattaagccatcattagcacatgttagttactgtaacacttatagttaatcatggactaattaggctcaaaagatccatctcgtgatttatatgtaatctgggcaattgattttttttatttatatttaatattacatacgtgtgttgaaagatttgatgtaatgtttttgtgaaaagttgttaggaactaaacaggtacagggctacttgagttcagaaaacaaactgttttattgtaggagtacagggtgatgaactagatcaatgccgacttcggtgtagccgtagattttctgcgcttggccaggagtattcacttttttctggcattgtgaactcgcaacagtagttttggttgcctcttgccgatctcagatgacctcatggtaaaattcggtgctatttaggcacgcacacacagaaaggaaaaaaaaaagaggccatcgccacagtgggcctatattatgagatggactgaaaaggagtctgtaattgggccttatttaccacattggctcggcctcagtagcgagtttaccaatgggccttttgtcatgagtaggccttaacatggactcactggaccttaatagtgagtttcctgtgctcgatttcggaatttgcgctgggctgtgcgccgaatagtagagagcttaccgttttcagcttttggcacctgcttagcttgtgcgtttgcatctgcctgtacttcgttgatctatctgttcatttcatttgtattgtcgtgccgtgccagccagctagtttttgcatttccgggaagctgataatggcatccatcgacgcgcatactcctcctgggcatccagacggattagagtaaacaaacagacgcgcaaaatagcgcgttaccaggagacagctgctttcttttctctttaattgagatgcgcgccagtccgttcttctttgtgtactgtcaaccagccggatccaagtgtccacactccatcctcgcgcaggcacagctcatgccaacctcacagcgtcacatgtcctgctttccaggcaagctggtagccaaccaagccagaccgttttccccggttcattttttaataataagttcatctattaaatgtgatttaggctctgtttagttgctctaaaatagcgaaagttttgttgttgtttagcactttttgtcaaaatggaactaaacactagtagcaaaaattggtaatttgacatttgtcattttgaagtctagagtagcaaattttgcaaaaaatatattgggagccatgctctctctataggcctgtttactttgatgaaaaaaaacctcaccaaattttggctttttggcaacttgccaaaattttggtaggatttcttatatagttaccaaaatttagcagcaaactaaatgtagccacttttttagcaactttaccaaaatttattaagattgaaaatgacatcaaagtgaacaggccctatctttactagtaaaacgcaaaactttaatatacatctaaataccaactagaaaaactttaatgccaaatcttttgccaccaaattttttgcaaaaaaaattgccacggtaaattgatctaaacataaccatattttaaagataaggaagtagaaaaatctccgaccacaccgaccatactttttcttcgccatccgtaattccggtttcttctgcgcaacaccaatgcgagaagagtacggcgatagaagcaaaatggcactgttccaatacctgcaccgagtaattcttccaacaaaacgcatttatgtttctccattgaaagagagcctgcagatttttctactcgtacgcgggtttgaaggatcgatcacatggcggatggcgggagtacggcacaacacttgttcgccggcccggccgtcacggctcgcaacgcgggccatctgtcagcacagcacgggactgttcaatttgatgaaaaaaaaattattaatttttggcattgacaaaattttggtaacttcctaaaatttttggtaggatttttttatagttagtaaaatttgacagtaaactaaatgtagctttttttttataactttactattttggtaagattaaaaatagcatattagcaccacgtctcgcccgttgtaaacaactccaaaaccgacctccgcaacggctagtagccggacggcccagcacgtcgcccgagggccgcattttatcgtgatccatcacacacgtccatggacaatccgacggcgaggcactcgtccacctgtccatcttggaactagtcgttggatgattacctggtaaaacaaccgcttctccctcccggcgacgcggtgccgctgcacgaagggtcaacatagccggcgccgctctcgcgacgaaggtggtcggtgccagccggacccaacccactgacgtgttggtcccactcgacgtggcccccacgtgtcggcgaccgttgccgttgcgacttcgtcacgacttcaataggctacagctgttgcttaaccgacatggtggtatactagcctttcggctataaaaacctggaccctcccattgttttcgccacacagttcatcggcatcttctcacactctagctcacagcttcgcggtttccacgcacttgaaaactcacgtttccaagccggaaaaccatggctcgcttcgccgtagtcgccgccatcgtcgccctcctcgcggtcacggccgccgcgcaggccccgggagcggcccccgtcccggcgcccaagatggccccgctgcccgctcccccggcgaggtccccggccaccgcccccgcgccggtcgccaccccgcccaccgccgcgtcgccgtcccccatggcgtctccaccggccccgcccactgacgcccccgccgccaatgccccctccgccgtcaccccgtccgcggtcaccccctcctccgtctccgccccgaccggcgcccccgctgcctcctccacgtacaccgccaccgccagcttcgttgccgtcgccggcgcggtcgccgccgccatcgtgttctagatggatggatggatgatttgatcgacgcgttgtttatacggcgagattcttttttgtgattctgttctatttacagacagcgagacactgatattcagatgtttacacttgtcatgtttgatgagatgattatcgatggaatatattctttcatttattattaccatacatggagtattgtgcaatttttttccattttcttatattatctgtatcgctcacgcgtaaactattactgccgatctgatcgggccaacctacaagagtggctgtcacatgcatgatagtctagatagctttttttccctttgctttaccgatgtccgatgccgtgacatgtgagtgagacaacagctttcgcttgttcagaatgcacgtgaagcggctttgttgcatatgcctagtaagggtgtgtttacttcacgctaaaattataagtttagttgaaattaaaatgatatgcgtagtaagggtgtgtttacttcacgctaaaattgtaagtttaatgtgatgaaaatgttggaagtttaaagaaaaattttggaactaaactcagtctaaatcttgaacgcgctttttctttcatgtaaagttggataaaatccgtaggcaccgttagaaaataggcaaaatttgctacagaacatcgaaagattgcggtttttgctgtgagacactcgaaaatcgtgtatttgtttatgaacacttaaaagggtgttaattagctgctggacactactcctattaaactttgtttaaagacaaatttgcccgtgggcccacttgtcaatctctctttctctgttgttcttcttcgtctctttctctctgttcatctcttcctcagttcctctctttctctgtcgcggcacaccgggcagagctccacggcgaaggtgtgccagcgaggacgacgaggcggcgacgacgcgggcgggccacggcgaggtgacgaggtcgacgaggcgagcggcgtgggagcgcgatgcgaagaagtcaagcccgccgccgccgccgcccagccgtcctagcgatgcgccgccaccaccgccccgccgtggcccagccgtcccggtgatgcgccgccgccgcccccggcgatgcaccgccgccgccgcccggccgtggcccagccgtcccggctcaggccagccgtcgtcgccccaaagaagaagaagaagaagggaaaagaaaagaagtgagaggaagtgtaagtgggtattttggtacttacacaactctctctcttcattttaaccggaaataataaaataatgtgaggagtgttcagcagctaattatcacttttttacagtgtccacgagcaaatacatgatcttcgggtgtctcacagtaaaaaccgcaatctttcagtgtccaatagcaaattttgcctagaaaatacggtacactaattaccttaaccaaatttggatggctcgctatacggaaacgctgcaagttgaacaccagacgagatggtgccgtgtgagacactgagagagtctgagaacgtcactgcgtcaagaagagagagttgggggaaacgggtggttgagtgtggacagtctaaagttcgtttgagtttaaagaggcccaactaagtagtactgggccgggaaaagatgagggtagaacacgaggagtttgtatgggccaggacggaagatccaattcaagttcaatccaggcctagaagtaaaccgcttgtttcactttttatttatttttttcttttggtttggtttgaggtttgacatacgagtaacttgcaacatgtcaatatcagcaaattagcgctgatgcatggaatattacctgaacaatacacccttcgttctcaaatatggtaactatcatcgtagaataaatgtagtcaaaacgtaaacttccaactcttagtatacgcaaaagatttgctccccttaacaagcgaaatcattcattcttttttttttcttttttaagaacactgacgcacacaatcaatcaatcaacttgtctactccagatggttcacatgccgtcattatagcacagtgtaaaatttggaattttgccagccacttcttccactccatcccagcaatttgcttgacggggggagcacatataatgttcgcaaggaacctcctccccttcagactgatcgatagaaacaaagcagggttagctttcaaggcatcgatgcatcagctcagcacgaaagttctcacaagttgtgggtgccaattaagctagccggtacactgtattactgtgatgtgaaaatagctggaaagtttaatttccaggtgaatcaaattgtttcctggcctcgcttctccgcggtgaaagtgagctgcttactaatctgatgtggaaacaaccacaacttggccgtgtgatgcagtgcacctgtgcttgaacagcttgatgccgttttgctgctacttggctagatcaagacatagttgtacaggtgcgcaagagctgatctacacaaactacaaagccaatcatcggtaagctgccgggccacttgtctgagtactcccatcagctgttaggccccaggttccggcaacgacctgctggctaaaacggggcatcgcacggcttaatcctcatctttctcaacagcttacacacgacactgacgtggccacgtacagctagcacctcgcagtcaagtttgtatacgactacttaatcctcatccttctcgagtgccttattgaagctactctgaatatactgcatccgagttttccaacgtacttgagcagaaccagtcattgcattgttaatagacagtatatttcggtagatctatatcgtcaatagaaggttgatatgaattaccagtcgaagaattttgctcagaattttgtccgattggtgtaccggagaaataagatgtactccctctatctaaaaacaaatttggatagatatttatccaggttcatagtattagttaattagtattaggatgtgtcttatttcattttacatttacattacgtgggacggagagagtacgtagcagtacttatattgtgaggagaaacgtggggtgcataataggaggctcactgacagtctgaaacttactcaagtattacgagaggaagaaaaaatggttcattctttttctgaaatccacgtacatgggaacagccagttagtaacaagtccgatcaaacgcccattggacatcaagaattcatggagtcctagattatacggtagtaacagaacttatgtccttcgggtcaatggaatctctagtctctgccgcagatcactcatgttgtctctgtaggctagtgcaccctgagagcaagattgtctgaagagcattatgtactcctgcgaccaaaccgcagaaccaaacacacatgaggattatttactgtttatcacgagaaaagaagcagctcatcacatcatcgggcaatcattcggcctctgcactgcatggatgccacgctgttcgaccagtcatatatagctcctgacagatgcactctaaagcagagaaagcagagttcatgtgaaccgaaacagagatggatgcatgcaaatgggccacaggtctttttaggacacaaagccgtatacctcaaatgctaatcaaatgagtgattgcacggttctttttttatcaagagttatcacaattttcgatgttattttatagtacctctacgctagaaaatatagtatctcttggtacatcataaaggacagttcaagatttgtaaccaattagtttcaagaaacttagaaaaaaatgtacgtgatatatctcaaagaaattaaatccaaaatcaatctatacgttgaataaagcaatcggctattggtagcgtatgtgattttttccccttttgtgaatgagtagattcagatttacacttgaaaattcatgactttaggtattgcactaatgctgtcaattttgccttctggatttctcataactattttcatgatattttcgtttctaattaagatctagattctaccttagtttttgttagcatgattttcaaaaccgttaaacgagacgttttgtgttaaaactttctatataatagttactttaaaatatcaaataaacctatttttttatttataataattaaaactcaattaattatgtgttaatggttttaccctcatcagttaagaacaccatcgcccaagggctccttcagaacacaaaaatttcgatatatcattagtgtatagcctatgaaaaacccttgaagtccctccatttcaaagaaggcgtaaggttttagagtcaccctccttttatgcaaatggcaagtagtactcccttttttaatatataacgtcattgattttttaaaatacgtttaaccattcgtcttatttaaaaatatatatataattatcatttattttattgtgacttgatttataatcatcaaatattctttaaccataacttagattttttatatttgtaaaaaaagacaagtaatcaaatatttgttaaaaaatcaatgacgtaatatattttaaaaaagaaggtagcagttaagcaagaggtactagtgcacaacacctccatcaagacaaaagtggtcatcgtacgtacgtttacaagagctcaaaatgttggtatagatttctcattaaggtcgccggagatactgcatgcatgcagcactctgttggctagggtacaatcacattcacacattacaagctaacaagctatcgatcgaggcgccatggttccatttccaggacggacgaggcagaggcttcacatggcggccgtctcggttgtcgtctccatcgatcgcggcgtcagctgatggagaggacggcctcctgctgctgaatgctgcccaggatctgatgcacagcggtggcaatgtcttccacagagcccagcttggaatcatcctccacctaacatccaaacgaaagcgatgacattatcatcggcgttgtagaaaaatgggagcgaatcttcgctcacccgcgacgttccaatcgcttaatttgtctgtgctgctagcctaaactaactaagcatgcagtcgtggtagtaaaataggtgcaaattgtcgattggtttttaccttgaggctgaaggagtagaggaccatggcgtcgacggtggtcacgttgagatgcagcggcgggatgcgcagctgctgcagcccgacgaccagcttcagcagctgcttcggtcgccgccgcgcgagcaccttgaggctcgcgtgcccttccaccatggtcacctcgatgtcggcgatggccgccgactgccggccgctctccgcggagcccgccgtgtcgtccatgacgacgctgctcgcactgccggagctcccggcgctggcggcggcgctgcagccagtgcgaggcgacgtggagtactgtgggaagctgaagaagccggcgaaaggggaatcgccggcggcgtccatggcgccgctgcggttcttgaggctcttttggacttccagcgactgcagtagctgctccagctccttcacgtagttgattgctcctccgacgatcgatgcttgatcaccctgagcagaaaatggattcgatttaatgatgattaacgaatcataacagtatgcgtaaaagcgattaattgaagcatgcgtagttagtgttgtaccctctgcgagtaggacgccggcatgagggagcggagcacggcgaggtactcgttcatctggcggcggcggttgcgctcgacggcaatgtgggtcatccgctggcactcgatctcctccttgttcttgacgaccttcgtccgcctccgtttcctcctcccggcggccaccggctccgcccgctccgccgccgccgccttgccctccgtggaagcatccgagttatccttggatgccacctcccactcatccacggaggcgacctgcagctggtcatcccactcgtccactccgtaaaactcaccgaagccgccgccgccgccggcagcagccaggacgtcgcaccacggcatcccgtacgccggcgagtcccttccgcacccgtagccgaaatggccctgcggaaacaccacggcctctaacgccatcctgcacgcacccggcaaaacgaacgggcgttttttttcgcgaactgacgacgccacgatacgatacgcacacgattcagggggaggcgaattaaagagtgagttgcccagcgacgcgaggggcgccgccgtttttataaggggacgcgcgaggtgtgtggccgagagaggcgcgcgcgcgcgcggtgcggggcaagttgcagtggtgcacgcatgcattgcgcgcggggggaggggggccacgtacgctacgcgcgaggggcgaggcggccttttgcgcgagggggacgggaagggaaaacgcaatgatttacacggagagcggaagcaaagcaagatgacgcgcgcgcgcgggggcacgggcacgcacgcgggcggggcgcgatctgcttgcttgctgcggagccgtggggacggggctcggcacgcgggcgcgcgggcgatcgatcgggtggcgcggcttgtttgatgcggtaacgcggcctgcaagaggggtggcaacttggcgaagaacgcgcggcgcggcgcgcgcacccggtcgggagaggcgtacgtcgcacaggcgcgaattggaacggcgggccggttgctcagatcgagagattctggcattctgcgctgcacggtgatcggagggggcgtggcaaacaagcgacacgtacaggtcatcttgtgcagccatgagtcgatctgaattttctgattactcactgcgtccgttgatttttactgttcacatatatttcgtacatttctgcttgattgttggactcgtaattggagaattctgcttgtgatcgtctttcactacagtgtttgcatgcatgtggctttcatccgcctacaaaggtgatctggcttgatctactgtcttgtatgtttcaatcggcatcaaatttacgattaccctcttgtacaagtatgtctacttgtctgtatcacccgtcgctttccttggaaagaagcttcactgagtttgcaaagaatcggctatgatatgtcacttctctaaaggaatatgtttaggtgtactacaagtagtacaaatttgtgtagtgtgattattttacagctgattggcgcataaaatctgtgagatgggatcatcctgagtccgacgtaggaaattacacaacgtaacaaagattaaggcactaatgctaaatcttggcacattaaatttaatactccctccattttagattataaatcgttttgatttaagtcaaagtcaaattacttcaaattaaaccaaatttttagataaatatattaatgtttacaacactaaattagttttgttaaatctataattgaatatattttcataatatatttgtgttgggtagaaaatgttgttactttttttaaaaaacttagtcaaacttaaagcaatttgactttaacaaaacgacttataatttgaaacagagggagtatgatagatcatatgcgacatgtcacaccttaaacatataggtttaaattcaacctatataaggggaacaaaaataacaaatatatgactcaggatcgtactattcacatttacccctatcacatattctaacttcaagtactccaactgtaactaaatataattagtatattcaacacgtattacgtattctaaccgatagtatagacattttcctaataatcatatattattatcagggttgtactgaaagatgagacattatgactagatagttagccgtgaggatgaggattcggcacgataagtttcaacttctatgtacgcttgtgatgtacagatatactctcgttgaagtgttggggtccatgccacgtacgctagggagctcacattcatcgatctaggcacagttcgtgatggtgttcgccaaagcatggctcaacttgcgccccatcatgtctaaccccaacaaaaatagccgcatcagcaacagtaaaaacgaaagcgaaagatgcattcatgcacaaagtttttcttattcggtatcattttcgatctgttcgtttctaacttttgtctaacggcagctaggcagggagaacttgaggaccataacctctgtggtatgccacagtttcatgcacaaagctgaacaaccgttggcatctttttgggacgggtgttttgcatataaaaattcagtaacacgtacttctctgtaagtagtatttttgtttttccaggaagaacgtgttaacctgtttccaaaagacagtagaaagacgtacggcacacaggttccattggaatccccaacaagattgaaaaagaacagttggcagtgcatatactaatcacatagttgatcagtctatggacgacgacaagtactttagactgtttatcacagatgctggagaataagaacaaatgttcccttgcaatttgtaaattattgacctcatggacacgttagatcaagcccatgaaagaactgaaaccgctctccaaatatattgccggaagctagttcaaaccaggggcagaacaccggattggcctgaagaaagcattttgttctgttcttcaggtatactgcactgaagcattattatttctgctgtgtcacgcttggaatgtaatgagacctttcttaattataagtacctaaaacaatttgttcaattcacatcagtttctggatgcagttgtggcgatgctaaaagaactccattatctctcgggtacgtggtgtgccctggagatgctgaaagcttagcctggatgctttccccgggagaatctgctcagatcgagactgaaatgcttacaatgacgcaaccgtacggcaaccaggcattttcttttgcttcagttttccttgatgaaactatatgacgccaatgctttgttctttttgcatgaatttgattgctgccaatgctgataaagctggctggctagcaataactggcaagcactctcctatgtctatcagagtttcagagtaggataaagacccaaaatgttattcagtgacagcttaacatttctcggataaaatctcatactacagctggtgataagaacattcctacgcgtaatttacctggtcgtctttggttctgaacgtaacatcaatggtctccttttacgtagtataaaactagaaattatgattggtgaaaagatacgaatccgtgtcaataaatcagagcgtccaagtggctgtagtacaaaattatatttcacatagtcatctagaatgaagccatttctgaccgatcgagtgttactactatacgataacatatcaaataaatggtgctaaaattaaacaaaccaccatcgtactactcgacttgacatactatatcttctcaaaattttctgatgtgtatagtagtccatagacaaaatctggaagagtgattatccggtattatacaccagttttatgagtggtaaaataataatttattaatataatgattagtaaattatcaagtgcatctcaaggatgtaatatgtgaaaatagaattaattaatacagttgtcacaaaatactttcatatggttatattaatacacgagagaactaggactgggcatttacaattagattaaatctgaaccgcaaattacaaaaattatcgtataaaattttctatcaaattttcaacattgcctttattaatttatactgctagtatataccggtactagtatattataccgtaaaagttatgatcggctagatctagattagagttttctatatacacattgtacttcatataatctggatatagtttaggtatatgcatacaaacaaaatatatggatattatcttgcgggaggcacgaacctgtacgtaaaacctctatgcacacacatggttttacgaattcttatctttacacaaacgatctcagatatacttaactattgccaattatctaatgaaacgaagatatacccaaatcttttttgtgtatctaattgttcatgcaatgttccagaaatcgtgcgacacctagtttgttgtttagcatgtacaaaatgtcaattcggtcgtgcagctcctacgttataggtaggcgctaattaatactatatccttaacgtaatcctcggcaatcttgttccattctgcccatgccctattatgcaccaaaccataccgttctctcgaaacaaaggcaaaacagctgtgttagctgagctctcttgacatatagcatcatttctccagttcaaaggtgaggaagaaaaccatatacctgctgcagtatgcgccgcattaccagacgcagcacgacgacatgctcgaacaatattgttaatcagtgcaaatcttggagagatccggtgtgggggattaatttggacggacaagtaggtaaccgaggatttggtttggtgatggtcttttttgcaagtgtgaattgcgaagtttggaagcattgctaaccgctgccgtctcgggtcagcgtcctacgtactcccggggtcctctctgcccttaaaataaatggattttgcaacgcttcctttgggaagtccctagcaagtttgttaattgcaacctttttcgttcagagacttaagtttatttgcaacttggtcacttggtcaggtaaatgctttcgatgtacttgcacatttcaaagattcttcctatagctttcgcccggaggaccccgggcatagtgttgtgccaaattccaagatcgacaccggattcttgaaaaggtatgcccagttacaaagtacaaatatacatacaacaaactgaccaagatagtgtcacaaagtggttggtagaacaagtgaacaatcctcaaccattcatgtagtatgttacacatcctctcaccttatttaaaaaatataactggacataaattaatctactggtgggtctgcatgcattctgttgtttacggtgacaatgaagaggctgtaagatgttaatacgactcttctcgcttggatcaggcagtgctataggctgggaatgctgccatcacaggccagctgcagctaagcaaccaaatctgaatcatctaattagaagtcatgcaacagacaagctaactaagctagttcactaaatgataatccagtagatatagcagaagtagcagattattaaggccatctaactacagaagattggtttgttaactgcaaccgatgtcggcacgggaatcataccataatctatagctcggcctgcaggcatgcataaaaccaaatgctactagagaatttgtcttggccatggaggattgagttggtacatcagggaatctatcttattcttacccctagtcaagctcctaacacttcgaaccttgtaaagtatggtactaaaatagaaccaatagtgttcgatcatgcatgtgtgtgcgcatgtttgtctcctgctacctccaatgtgtggctggcaatgcatggtacagtctccgttatgtcagcatggcgccaattgaccgggcagtggtatttttctactggcgagcccgtgtttttttttatgccttgtgcaaatctcgacggctgtgatttaaagctcggttcgtgtacggagtacgtacgtggtcgtcagatactcgcgtcgtcacaacagagtcacagatatactactctttctgatgtgtaatttcgtgcagcgttcggacacacaccggtcacaaaatggcagagcaaaaggaccctgcctctctgccggaatctagccaacgtgacgaacagtgacgcccacagagttccgctgaccccgccgtacaaggagcagtggagcactggcgaccagggtttaccttatcgtttgggccgagattaccaccaccccgcggtagtgcgataaccacgataatcgcgtgataatcgtctaaaatcgcacaaaaatcacatccaaaaattcgaactcaaaactcggtggtttcgcggtttcaccacgataatcgcacggtttaccgcgataactgcggtattcgcacggttatcgcgggctatgtaactgaaatcatataaatgcaaaataaataggggaaaaaaataaaaaatacggttgaatatatgtagaaaactagaaattgagaataattggaagaatatgtaggatacttaaggcccaatattctctttccttttccaatttgtaaactattctcggtttgccctcaaatttgaatatagcttactctgttcaaaaaaattcttcaccattgataattacaaatcaagaactacttacatgattttttttttaatttttttcaattttttttattttttccgggattttaaatttagtcaaaattcatccaaaccatatcgtcgatttctcctaccgtaccccacaataagcacgataaccgcgataatcgcgtgattatcgtgcgataagtgaaacctgctcgcgactcgcgactcgcgcgagaaacgaatcgctctccggcatcgaccgtaatttggttaccgcacaacacgtcctcgcgctgccacgcgcacgcgggggcccctacgtacgcggccttggggcctggcctctctgcggccgcgcgggcgtgtgcgtgggcgtgtgcgtggtcggtcgctatgcctaggcgcgcgcctcatcacacgacacgcgggatcgcgcggttttatacggcggcttggctcatcgcatcgtcctgctgctgcgggcggcttccgcacatgccatgggctatattacgccgcgaataccactttcccgacctcctgtttcgtgtccgcggtttgcagctgcgcctcagctcctgcgcgcgcggcccagcgtgccgggcgcagagcatcgatcggaaacttggttttggatcggtctacagactactacaggagagtggatgcgtggccggtgtcaattaaggaccctctggtctggacggagaagtgtccgctacaacttccacaccgatatggagccagatgcagatcgagttgcaggttatgcagcgtggcactggcagcgtcaggttattcgagccagccgaatcatgagggttactgaattgaataatgaacgcgatcgagccggtgtgtgtgtgtgtgaggcgccgaccggtacgtcgcgtcatgcaagcgatcgatcgatcgtatgtcgtggtcgccgtcgtcaatcatgcgatgggtgcaatggagtagtaaaaaagacacaaggaacgcaccaacgtttcgggtcagtttccaccttggaatgattcgtgtcataatctgtacgacgtaggagtacgcaggtcgtcgtgcccgtcgcttcaaacatcaggcattggccttatatcacaccacttgtgctacctaggacacgacagagccgcgtcgttcgatgattgttcgtcccggcatggctagctgagctctgtgtgaactgtgatcgatcccatcatggtccatggctatgcacgcaatgcaactagtaggtcgcacatacatacatgattcgtgcagggatattgctctcatacacagcgcgaccgtggtgatcctttcttgtgttctgcgaaagtgcttatgtgcagtggactcgtgaaacgcatttacactgcatattcgtggtttctcgcagtaaggttattctgttatggcacgaaaccaatcggcatttcgtggcgtgttccactatgtttcatatatacatgcatcaagatctctatcactataaagtcagaaacgaacttgatcattggacacaatttggaacgcagcggcttgttctccggttagaaatgctaggcattcaaggaggtacacggcgtgatggcgttacaagtttaggcccatttgcccggtgaactctgcatagtaagcatcagcttgatcagatttattagcagcgattggtttccacctagcagttaaatatggctgtcacaactcacacgcggcaatatccctactgttatttggaatttttttagataatggaataattgttatttggaataaatctattttgcttctatctcttgcacccattttaatcatctatcttaactacaaaatcgggtataacgcatttgtcatcttcaaaaaccggtgtaaactaactccttcagtagtttaggaactggcttttcactgaaccagcaagtaggacctacatgttagcgactcttctatctatccttcctttctcttttttcttttccatctatcccctaaggctggtggcacaaatcctctatcccgcatcgtccctacgcccgagggcccaggccgaggtcaccgacaatctggctatgagctactgtgatggcagcagatcggtgacggagcaacccaagctgctatgaaggagaagcaaggcagcggatgggatagaatactttccctaccgccctcagggagagatgaaaaaaaaggagagatgagacttgagagtcctagacgtgcgggtctacatgcttacttagcgggtcaacgatggtcaacgtgtcacatcgttaaaaaccacttcctaaacatcaaaaaagtcgatttgcaacggtttgctaagatgaggaagacgattcaatcaagagcaaaatatgagggaggccaaatagtttttttagaaaaaaaaacttggcaaaaaataggttattccctgttcttttgttaacagtttttatgctcaggccgaaggagttgtcataatgtgcacagaatgcgtgggcctttacttcatctaaatatttgcgccagtcaatacagaggcccattactgctaaacttctcctacttctgtaacctgatggtataaagcaggccggacactcgatatttccaggaataagttcactataactccctgaaatgaacacggaaaactaaattgtatccctcatccgcagtaccagacccacaaactgtcaaaaccggtataatttgactcccttagtggttttgtaggacggtttcactaacgtgacgcacacgtggcagtgttgtcttggtcttcgtcccacgtggcattgatgtggcgcttttgtggcattaaaattaaaaaatacatgcggggcccatttgtcattcacacaaaaaaaattatgggtcccacatgttatcttctctctcactacccttttttcttcctcctctctcccatctctctttctctctctcgcctttccctcctgagctcctcatgcatggctgcacgatgccgtcgacggcaccaccaccatcgtggtccaccgcgacaagccaccgccgccagcgccgccgctctcgcacccgcttgccgcacatggtcgaagaggtcatcggtgacgatcggcggcgcagtggcgccggccatggcgcagtctattgggaggaggaagcaagcgaggggcggatctggcctctgggtccgcaactccagcggccgcccgctcgccgatgccgctccgtccatcgcctgccaccgttgccgacgccgatccagacgccgctccacacgcacgaagagaaagagggagagatagagaagggaggagagggaggaagaagaaaggataaatagaggatgacatgtgggacgcacatgtcagtgggtcccataatttttttttgtgtgaatggctcccgcatatttttaaaaatttaatgctacataagcgccacgtcaatgccgcgtggtacgaagaccaggtcaacattgtcacgtgtgcgccacgtcagtgaaaccgccctccaaaatcatcaagggagtcaaattgtatcggtttagacagttcggaggtcaagatttctagtattgcggataaggtatacgatttagattccgtgttcatttcagggagtcaaactgtacttattccatatttccaagcctaactgaaacagaatcagcccattatgaagcccataaaacaggtaacaaattcagtgcgctattgttccaactgatgtctgcttttctttcttttcagattcatgccagccatattcacattaactcaaggattcaatgtcaatgactagcattctttttacaagcatgcctatttgttacttttgctaattgtgcagcagcagtgacgaaacaacgcgaagaggttattctaattgatctagcgtacgtaacttacgtgacatatagacaaagaattgatccaaggcaaccaccacatgtccacgtgattgatgattcataatagtaaacaactgcgcattattgttcggttaaaagttgactgctacaaatttcatatgaccacgtcaagctttataaaattataaaaagaaaactttcggcgacgacctcagtggtggttgcaaatatcggaattagattcagtttgtacaagttgtaaaaaaaagaagatttgagttcgtacacatacaaagtcgttagtccacatgagtcatcaaaactcacaaaatacacagtttcaaagcttgttcctagaaccgacaagtagaatgaactggtcataataatgcatccctaatctatttttttaactaaatgcatccctaatccaagcatggcgtcagtaatcccgaagctgacatgtagggattgtaacgcgagtgcatgctacatgcttgacatgggcggcaggataggtcggaaagtgaagaatacccagccacaccaggcgccgtccaatcgctgcatattggcgacttttgggcactttcccgtcgtctttgtgatgggtcgggggcacaaaacgttgcgtgcaaaagacagcggcattgctactcgatgtactgaacccacagtaagttcttgttggctaggaattttcggagccatcagatcattcatgatcaccgtacatgtaagttgtgcatatggattagtacattaacgacgtgttgattctgtaaccaagaggtttgttgtttgtttgttcagatggaactctgaccaaaatccaggcacgcgtgaaacggtgacacgaaaaatgcttccagctgatttccaccggcaacagccagtgagggagtcagcggcaccgcccgctcgtccccgcagtcactgactggtggggcccactcgccacgcagccatccctgacgtccgcgcgttacaccatccgcgtcgtagttaacacctccgttactccattccttccaaaagaaaactcgaaacctccccctctccggccgccggcgagcggctcatccatccaccccaccttggccggagacggcggcaatggctcaccgccggatcgcgctcgccgtcctcgtgacgctgctcttgtcggcgttccgcccttgcctggcgcaacagagcaacgacgacacgagcaaacaccaccggagcgccacggccggcgggttcacgccgaccaccgtcgtcgtgctcgtggctctcatcaccgccttcgtcctcctcaccgtgttctccgtcctcatcaaccgctgcgcccaggcgcgcgctcccccgcgccgggcgttccgcagcacggcgtcccatcagcccgtcggcggcgccgccgccgcgtcccgcgcctcgcgtggcctcgacaaggaggtcgtggaggcgttccccacggcggtctacggcgacgtgaaggcgcgcatggcggcgaagtcggggccgctcgagtgcgccgtgtgcctcgccgagttcgcggacagcgacgagctacgggtgctcccggcgtgctgtcacgtgttccacccggactgcatcgacccctggctcgccgccgccgtcacgtgcccgctctgccgcgccaacctcacggcgccaccggtgtcgctcgccgccgccgagagctccgacctgacggcgccggaggaggcggtgcaggaggaagagtcggaggagctcgacgaggcgtccctgatggccaccttcacgccggaatccgtcatcgacttcggcgcgacgcacgaccatgaattcgacagagcagggtaccctcactaccggaggacgcagtcggccatggacgccgcgccggaccggcacacgctgaggctaccggagcacgtcatgaaggagctcgccgccgaccgcaggcaccggcgcgccgcgagcctcgccgggtacccggacagcgtggagaggacgccgaggtggctgacgtcgctctggcgatcggtgtcgtggcagaggcagagccgggcggactgggacgccggagaggagcacggcggcagcaaaagggttcacccggtcgccggagctcaggacgagacacccagcgggtccggctccgatgggagcaaggagaactccgattctgacgcgttaaaccgagtttgaattttgttttctcctcttctttttttttcttgtgcttcgttctaattgtgcagcggtgtagtaatacaaattaacgataaactaccttgcacaattttctattagcaaacaagtactctactactctagatcgtcgattcttgtttgagtttatcgggtacaaaggtttaatattccggtagatcatgaacattttaggatatccttaacagtacctctcagattaatggggataattagtactgattagtgattaattatgctggtcacttgccagaaatgctgctccactgtgtgctaggcttgccagttgcaaaaatggaataaacgaagaagtgatatgatacaccggccgatgcactccgtgaatgtcagtgacagagaatgtatccagtcaaagaatacgtacgcacgcgattgttcgtatgcacctttctatcccgttcttcaatgtcaactctcatgctgacattatccttagagataccagtaggatgatggcgtcctacatggcaattcgtcttgaataccaacggtagttgaaaattttctttttcagggcagctacgtccaccaatacggcgagcatgcagggtaaaaatccaagatgaagattgtagaaggaatacggttggtgaaatcactttagataagatcgattcaatcttcacatgtcaccatttgccatacatacgttacttcactcggccagccgaaatggtaaattctcttcggtagccagaagaccaataccataaatttggacgcaacgaagccaatactagagaccaacaagagcaggtgatgaagaatcgtcttgtccactgttcacctatgcagttaatcagctcactcgtcgcgaccatcttgtcctctcgtatggcagaatctggtgacgagcatattagctcaggaacgtgtgcgtcctctcccatcaccggacttgcgaccacttgtccatgcgtgtgcttgcgatcatggcctgcaaaataacacagccaaaaaatgtcaaaatttcaagtcgctacggcatttgatcgttttcttgggctgtgtggagggattgatcgttttgttcacctccttgtcccagtcacagcggatggttatgatggccagaattagcgtctgcactgcggttccgccgatcatacccgcccaaattccctgcaaattaaaggtttcacgaaagaaatggtcaggccggagatggctaacattttcacggtttaacttgaactggtcagaaatcaagtagcatagtggcataggtaccaggacgccaagtttgaagagccatccgaggagaatgcccatggggatgccgatgaggtagtaggtgccaatgttgacgtaggccaccatggattgccacccagacccaacagccacacctgcacgtatatgaccggcccatttatgaccagttcagctgggaactgaaggcccatgtagaaaaggaaggcccaacggcccaggtgtgtgtgtactttacctgagagaacgggctggatgctgttgaggaggatggtgaaggcgaggaggacggagaggttgtcgacggcgtcgagcacgacgtcgctggaggtgaagatgagcgcgaacttgtcgtggaggcccacgatgagcacccagaagaagagcccgatcaccagcgacgtcaccgacgacacgatcgtcgcgaacctcgcgcccttcccgttgccggcgcccagctcgttcgccacccgcaccctgcaaaccacaacaaaaacacgtacgccgccacacgtgctctgctttagttcggtatattcgagtttcgtaagcaaatcgagtgagaactgagaagaaggcagtgcgtgcgtacgtacccggttccagcgaagaatgccaggggaatcatcagctcccatgcattgatcgtcatgctgtccacgagaagacataaaggttagctacaatcagacgcatgtcagattgattcaggaacttggtactgacttaccagatggagagcgcgtcgaccgcaatagccgcgttcttgaggttaccggtcagcaagatgaggattctgtagtaccagttctccaagctgcaaattaagcacacaaattctgtcagcaactgcaaaaaacgtacgaaacgtgaaatcaaacagaaaccaaatcacacgagaattgaacgttctcggtttcacgtcgcgtacgtaccatagcatgacaccccgcgaacgcctcgaggaagaggccgttccacgtctccgggcatccgccgcaggcgacgtaggcgaagagcatggcggcggtggcccaccacgagaagttgagggtgagcgcgatgccgacgaggccgaaccggaagcgggagacgaggagccagctgatggcgacgtggacgcacagcgcgacgccggacgccgcggcgctggcgaagttcttcatctggcactgcaggaatcgctgcagcgggaaaacggaaggcccaacggagcaggtgcagcgggatgaccccgacggagacgcggccggccatcgccgacagctccggcggctgacccgtcaggagcagcacgtcctcggcgtagatgtacatgggcagcagcagccccgcgcacgccagcagcacgatccacgaacgctgcatgtacacccccatcatgtggtacttcttcgcgccgaacgcctgcccgcacagcgtctccagcgcgctcgccatgccaagctgcgttccacacggccaattaattcagtgaatcagtaattgtgattcagtatttccgtacagttagggtgtgtttagttccacgctaaattggaattttgattggaattagaacgatttaacggaaaagctaaaaatttatatgtgtagaaaagttcgatgtgacgttttttggttcagtgtttggaattaaactcggccttaattcagaagcagcaatcgtacaaactagtatacaacagtagtataaagaagtcatcactgctcaggtagccaggtacaattatacagtaagagaatcagtagtaccaattgattcagtacagcataattttttttgaacaggattcagtacagcataataattcagtggtttttcaaactgatgccatttcaaatcttgtcaattttttaaagttgccaacgatgcatacatttagttttattaccaaactttcataaatacataagaaatcctatcaaaacttgacaatattacaaacttactaaaattttagcaaatatcaaattttgataaggtttattttacggatttgctatcgatcgaacctgagacttgcagcttgaatgctcgttcaactaaccaattgctccatcaattttttcagagttatttctttagttacagatgacttatattgtagttacacagtagttacaatgtaattacattataattacatagtagttacaattgaaagttttctatttaaaaaactgtcgaatgttgtatagctactcccttattttatctataatcttaacagcccctatcgtacaaaccatactacagcaagaagtcactgctcaggtagtcgggactatcatacagtgagaaaaatcactaaaggcaaatcggttttatgctatgatccctctgcgcccatttacttgtttaaagtatagtgaaagatttcattaaacaacaaaaactgtccaatctctacactaataaaaaatgcacacgaccaaactgccacatcttttcgcttatacttatgtttatcagccaaaatttaaatttttagccttaaatttagaattgattttggggcatttttatcgtagtttatttttcagtctttacttttagatcgttaagaacatatataaaaaattt

SEQ ID NO: 32279 - DNA, 1482 bp, Oryza sativa
aaaattaaaaaaaacaaatataataaatagtgataagtactcgtatttggaaagggatcggtgacatttttttgaccggcaaagagaagccgaccggaatctattatattattaaagggatagaaaaaggagccaccacgttcactctcatgatctagaaattctcatattaatcagagaaaaagaaaaatcagattccatatagaaatacaatttagaaatagctgaaattcggattaaaaaataaggaatattagaataggagactagagtccatatagaaatacaatttagaaatagttgaaattcggaattaaaaaataaggaatattagaagaggggactagagtccatatagaaatacaattagaaaataactaaaattcggaattaaaaaataaggaatattagaagaggatactagagtccatatagaaatacaattaggaaataactaaaattcggaattaaaaataaggaatattagaagtagagtatagagtccatatagaaatacaattaggaaataacataaatttggaattaaaaataagaaatattagaggtagagtatagagtccaaatagaaatacaattaagaaaaaaatagttgaaattcggaattaaaaaataaggaatattagaataggagactagagtccatatagaaatacaattaggaaataactgaaatttggaattaaaaaataaggaatattagaagaggagactagagtccatatagaaatacaattagaaaataactaaaattcggaattaaaaaataaggaatattagaagagaagattagagtccatatagaattacaattaggaaataacataaattcggaattaaaaataagaaatattagaagtagagtatagagtctaaatagaaatacaattaagaaaaaaaatagttgaaattctgaaagtgcatctagacccctaatgattttgatgattgattacaatgcgattagagaggactaacatttttattcaagcaaatgtgaaggttgttaagtcctcaacgtgttgtaatacaatgcatatcccgtgaatgcgacatcgtgatgcaatgcggcaatgatcaaatggtatattgtatctttttcctcgcattgtgtcgtaggaaagccatactattaagggggatgatgcatagacatataaggagtgatgcgtgtgctcaaaatcaattttacttcgaagcatttctcttttggagcttctggaaattttcggaagttccgaaaatacaccgaaccgtgtttgggcgttctggaaattttcggaagttccgaaaataattttcggaagttccgaaaatacacagaagcgttctggaaattttcgaaagttccgaaaatatttttcggaagttccgaaaattgcgttgacttcgattttcctcagatctggaattttcggaagttccgaaaatcccttttattgcactccaacgggcagatttgtg

SEQ ID NO: 32280 - DNA, 9462 bp, Oryza sativa
tattaaaaataattaataaatagcacgtatataaaatataatatgaatattacacattagtagttttgtaaagttattgcaaaattttaaattatgttgtcattttaatatatttgaatataatgagaaaacatatatgctattatatgagaaaatataatgatgctagccgaaaattgtgcgggccaccatgctagtttatttgataacaggagaagtttttttttttcgggggataacaggagaaggttaacgttgcaggtgacaagtgacatcaattttgctgaaaagaaattgcaagcacggcaaataagtcggaatatatgctggagatgaatagatgccacatgtatgtgtgctttggttgataaaatcgacaggtggaacagcggaagcgaggaatttattcgaagcttcaggaacaaaagagatgaagcttctcagaagtactagaagaaatgaagaattcactcaagaggcccagctccttccggtgccttctctgtatacttttttttttgacaccgccttctctgtatactgatgataagaaaacgtggacaccagataaaacccaagtgtttgcgggcacagaagcgccagccgttgcattctggattattgcatttatgattttccatttttcacaaacgaaattaaaaaaaatattccggacacgtgcatctttttatataaaaacaaacagaaattatactggcctcaagaagtaccgaaatgttttttaaaataaaattttggtacctctgacatcgaaagtattgaaagtcaataaattatacaataaaaatatatggttgcttctcatgtaccgtaaaatgatccctcgaatagtaaataaaataatttaccaataaaatgtttatatatatgtgtttttattaatttaaaaatatataaaataaaatataatgaaaaacataaaatcaaacttcaaaattagagaagttttattgtcattgagaaagaattttaagttacctaaattttacactgaaaattttaatgactcgagaaatctagtacttaagttatcaagttttacactagaaagtacgacgattctagtattttttaagaatagtaaaattagctttgaagttaaatttaaataattttagcttataaacatagacgaagtaatgcggccttaaatttcacgatcagcctttcaacttcgcatgaattcacgaaaaggcaagagagattccgctctcatgtcgtaagtcgtaactctgacgcgaggaaaaacagtcatatcgcagtcaaagaaatacacatccacttgactactcacgattcggtttgtcttcacaaattcctagttgaactcttcaggtgggctgtctgcgatatgtacagggttgcacgaggattttggccgctgaattgaacaaatccatccacatttacgtttcaatttttttcaaaaaaggaaaaaaaacattgggcacgcatgcatggataggagcaagtgtaacaaaaggataccccacaaatgctgcgatatgcatgccaattaacacgtcacacctgtccacactagcaccatgcataaatggactttacgatcatgggtcatggcagctttgcagtgatcgaactccagaagcgtagcgttcttgcatgcttggcgctagctagctgctcttgcagtctactccatccgttaaaggttataaaatcaaactactttaaattttatcaagtttatagaaaaaatagtgatattttcaatccaagataagtttattataaaaatatatttaattatgaatttaataaaactaatttggtaatataaatattattatatttatctataaatctagttaaatttgaagcggtttgattttgactaaagtcagaacatcttataatctgaaatgcagtaattcacagcacattttgttcgaaatatttactgcttaatgtttatgttttttttccttgctgggataattaaaaccaatcctaagttgccaaccatattgaggagatagcacccaaagatagcacgtacgagctagcacgacgaattaattaaccagcaaaaaaggacgtgttcaatcggcctaccatgaggccgaagttgaagccgacgacgacggtgttggcgatggagatggcggcgagctcgaggtcgccgaggtggccggcgaacgcctgcgtgatgacgttcatgctgtaggtgacgacgcggctgaagatggccggcgccacgatgacccacagcttcctcgactcctcccacaccctcctcctcagcttgccgtcgccgccggacaccacctgccagccctccttcgccgcgccgccgccattcagcagcgccaccctgcactcctcctcatcccctcgcccgtcacccatcgccgccgaccgtgtcgtccgaacgaacgaacaatccaacctcctctgcttcgattaattcttcgattcctcctcttgtgttttcccccgatgtcaatgaggtgtcaaacccaaatggaacgagcgaccgagcgagcagaggcaggtggaacgccttttaataggagaggagttccgtggtggtgttggcgagtccaagctacagctaggcacgcacgagagggcgacgaaagcgcggacgtctgccttgcgtttcgtggcgcacgtatagggcggcgcacgggacgacgtcgctgttgggcaaatctgccgcgcgcgcgcgcgcgctgtggtgtttggtgccaactaacctcgcgttagctcccgtgtccgtggagacggatcggatcatgctgcggcgcacggctttcccgtgttctctcctgcctttccggaaacgatcggctcgatcaaatctggcgcgtacgtgacgcgtgcacagatcgcgcgcgaacaaccctcgagttcgcgatcgagtcctcctagtccgaacacgcgcgaatccactgtgtgttggaactggtgtgcacgtacgactgatgggaatattaaatgagattgttaagtgagatgttggtgtatatattttaggcgcctgtaccgcgtgtgagatctgcggccgtgtcaacacaagattcttatacgttgatcgtgattgtgaatattggggaggactacgtacggagaagctagctgtgctgttgaccaaaccaattaccaactcactctttgagtccatcatggctcatgcaatgcatgtcgcagatcgatcgatcgttacctgcccgggctcccaaaaccggtcgtctctgcacttgtgcagtggtttgatataccgcaggcagctgttgcggcacacggagagattactagtccgtatccgtacacgtcggcagatttgtggctatacatgcatatgcatcaacgtatgcgttggctctctaaacttgcactttaaaatcgcgtttgttgcttgctatcttctcatgaatctcgtcaaaaaactggggttggggggatcacttgctttggaagttcgggtgatgatgacgtcggatggggcccatgaataagactactaactaaaaaaaaatgcgcacgagccctttgttttctgccaagtctgtatacaataaaacctgacccgaaccgaaacaaaatggacatacggagtatataataccaggaggcatcgatcagttatagtgaatattgacgcgcgctagctacgctgtgggtcatgcgtactgccgtagaggacacagatactcccaagccatcgacaataatgtgtatctagaaatcgattggtgtacattgccaactaaccacaaaataaaaaataaaaatgaccaccattaatacaatggtaacaaggtagagtctctctaccttttgcgtcaaaaaaaaataaaaaaataagaaaataaaaatcagacgagttactggtatcatgatggcacacaaccgctggtgacatatgggtgcctacttttgctcacatcttcaagagattcacacgcatatataagcacccaatttgttgggggcggccacctccgtataagctcaaaactgggcttgccaatgagggaggcaaaccgaaaaaagaacacaagtaaacgcccttgaatgggtaggtaatcagggttaagaaagcgagagcaaactgtcaaactgattgcaactccggattgtttactacggagtactccagtagatagaatgtccaaattaatttccaacgggtcactatcgttctgaggtatggacgcgatggacagccacaaacaaagttcagttttccattttgcacagcaaacgggtcgttggcattgctgcttctccatcgcccacccataacattgtagcatcacaccactcgttgcgttcgtcattgcccacgtcttccggaccccgtctttggaacaagcaaagctatagctcttcgcctgttcgacatggatagatgcatgccattttatttttattttcattttctttctgatgagatgatgcatgcatatgattgtatagtactccctccgtccataatataagggattttgagattttacttgcaatgtttgaccactcgtcttattcaaaaatttttgaaattattatttattttatttgtgacttactttattatctacactttaagcacaatttttcgttttttatatttgcaaaaaaaaaaattaaataagacgtgtggtcaaacgttgtaaacaaaaacttaaaatcccttatattgtgggatagagggagtactattaagttcgatcttatccatgggcccgtggctgcgttcgtctgccgatcatgttcatggccgacgaagtagcaaaggatgcagctgatcgatcaaactgttgttaatcaatactggcatagtaaaggatacagctcttggctacgattaatagcgacgtagctcttggcaccatgatgcatgtggttgtgagttgcgacgcgatggtcacggcaaaacttaacgagtcgtggttcacgcctcgatgtgtagcgacatgtgttccctctcgtagtgtcgcaggatacatacattatatgtggatgtaaatcatataatcatgttaataatgcatggatctgtttatgttacgcacatgaagcccaggcaggacgtgatgccctcgtcgtggtgcggcgatcgagaggggaattttggatcggtgcctgttgtctccatggatggcagacaaaccggtagctgtatgcaatggttttggaattttcgtacaggtttgagtgattaactgattattatcactgtatggcctgtgaatatgtgattctctcgccgacacaaaaccgaactgaagtgatctgctcctcgcacgaaaacgccagcccagagtagacgtgcaaacacaagaggccggccctgttttttgtactgggccagatggaaataggactcgtccaagttgagcgagatgggccttggtgggttcaatctctcagttaccaggccacacggccgaaggaggagtgggctgccggcctgagcgaggccgatcacaaggccgaacaggatggccaattagcgcagctgcgtctcacacttttggtccacaaatttcacgtcaaagtttcatatgagaagttttcgaatgaaaattttcaggtaatttttttcagatgattttttttttgcagatgaaagttttacaaataaaagctttcagataattgtttcaagaaaaatatgcgttgatgaaaacgtagctacgctaaatagcagtcccctaaccccaagacttttaagacagagaattcagctgcattctctgcaccgtcgtgtgtcaacttgaccctttccacggtgtcaactaggaagctgggagtaggtgcgcccgttcgattcgcctgatggattaatgttgggttagttagttaatcggaacacgcatgcagattgttagacatgcaggttccaagcgacctgcaaagcgcggctgcgatcagaagaataatggtcacggtctcacggattagttgggtttcagtttgacctttatttgattgatcgaccaaggtggcacgtacgtctccgtactcacatctgattatttatttatttattttatttaaattcacagtacaacgcagacactcacaacatacgcataatcacccctatgaacacacgcacgtaaacccaacccatttgagcatcttcgaagactgggctagcaaatctatcttggagtcaaacccaggatctaagatgctactgaggctattgtaaccactaggttatataaactttcactgattatctatatgttttgagggaaatacatctgattatattagtatgacaatatccagcttgctgtcctaataagttatacctactacggagtagatgctaactagattgaacatatatagtaagcatgttgtctactcgactgcgtgcagtacgcacccaaggaacctgtggattttttttcttgatacaaagaaaaagaaaaaacagttatccgagctctcaacatgcacaatcccttggtcttttcccgtggtaggtgaatgcacttcaactctgacaaacaagatccatgaaactgacagagagcttatatgtctccgcgcgcagatctcatgcatgattcatacggtgactattgactatcgactttcttatgagctaataacattcatacgagatagtcgctgttaattactacacacttaccacctactaataatccccttcaagacttagcacgcgtgcctgtgccttcccctgcaaatctcaaatcctaattacctgaaccatcggcgacctcgagagataacgttcacacaaaagcggaacactttgatggaataactgaatgatggatcagctagctgctagtcgatgtctcgcagttggtggaaatggaatacgttttcagcacctgctgggatatcattgagaaaccaactaacgcattatgcatggtgccgtaaagttaaaacgaatggaaacatagctgaacctcttttctcagacaagagaatgagatagtgtgatagcttcaagttttaacacatcatctcattaattaaaagtcaatatatacaacacatttatacattacttctaggcttctagcacttttatatcctaatacaccatcatatataatttttattttattttatttgtttgctcttaatttattgatctatttttttaaaataaaattagaatttgtgcactcactctgaaaaaaaatctaatcatttgtctagatttaaatttagaattgggtttttttggtacggaatgagtagagatgatctcttaccgataggtgactcatgctctcttctcttctccatcttatctaccgaggagttttcatgtatttttagtctctattatacttttccacaccatatcggagtcgttcctgtctgtgactgtcacttttctgaacttactgccaccaactttttactgtgtcatgcagccatatcatcaccatccatgatcagtaaggacactagctaggtaaagtactggggaattccatgtactggatattgcatatgccaaattgccaatccacaagagtattaattaattgcatatgctgttggctgtatatgcggcagataaaatttaaattaatactggaacaacggactggcggtatgtacaccacaaattaccacaatgtatacagtttaaacacatgcagagtccaaccagtctttaattaactccaggcaccaacaaattaagctacaccaaacagcggaggggaactaatcaaacgactagtagtttcttcggtttgaacagggaaaaagatcgaagcaaaattctattaggtaaaataatccaaatcatcgatatatttaggatcgctatatatagttggagagcaagatagcacatgtgttaattacccggtcttaacagccgcttgaaccaaacggaacaagcaggcactttccacggaggcgcttctgcttgttttgtctcactaaacaatgatcaattagctagtctccgtgtagacgcatcacggatgtgtgtggattattgggaagaaaaaaggacgttaatttgtttcagctcagtactatatttcactatagtactatctacttggactagacccatgacacgtcaggtcatcagcttagctaatcctacggagatgcatggtggttggttatggatgcgaatgattagtacatgcacacacggtgggtcgtcaaacgcagcaagtccaagcacatggaacgttgaacatgtttgctcacaacaggttgctattacgagtacttgtggtcaacgtacgataggctttactcggtcataaacttatatatacattaagcgtatgatttgctgaaatgataacggataagttttagatttgtgacattttgatgcaccttatggtcacgcgcgtattcatacgaaagtgattttgagatatatatatatcaagttccaaaagaaaaataaattcatttcaagttgaattagtctgaactaatttcatgagtacatcatgtcatcatgtatggaattatcacaccatttcctttttctttagaaaatatcacactatcagaactagctagcctttctctacgctagctactccatcagttcaaaaatataacaacatatgattgaacatgacatatcctaatacgattagcttcaaataaaaaaaccaacgttggttttgtattaatttctactactatatacgaaggggtacccttttattttgtagaaaaatcagtattaattcattgtacgcatgcaacaagtggagtccctagctactccctagccgtagcgtgtaacaagtggaataatagtccatttacactgtagaggtagctaagggacgatttctcaagtatcttcagaacaaacatgtctgttgattattttactgtaatccctgtgtacttcttgtctccttcctttttgttgactcacctactctgttaatctctacgttactccaaatctccaacatcttctcctagaccttcacatccttcacacatctatataaaccctagaacacaccatgtcatccaacacccaagcagattaagctaattaactaccatcaacacaccctaatccaaaggtgccaagcttgcaggaaacagtaagctagctagcagtctagcactgcttcatttgatcatggccaccattactgctgctagtcccagacccagtgctgctcctgcagccatggaagagaccagcaaggcgatgcctactagcgagtggcctgccgccagcggcggcaatgcgtcgccgccggcgaggtcccggccgtcgctgctggtcatattcagcgcgtgcctcgtcctcctcggcgccggcgggccgctcctcctccgcgtctacttcgtgcacggcgggacccggctgtggctgtccgccacgctccagatctccagctggccgctgctgctgccgccgctgtgcgtgtcgctctaccgctgccgcaggcacgg

SEQ ID NO: 32281 - DNA, 15797 bp, Oryza sativa
  unsure (1)..(15797): unsure at all n locations
gggaagcggcggcgttcgggctcggcgcggccaactactacctcgtcctcgcctgggacgccgtgtcgtggcagctgctcaacctgggcatcatggggctcatcacctgcgcgtcgtcgctgctcgccggcatcatgatcgccgtgctcctgccgctctcgcaggtcctcgccgtcatcttcctccacgagaagttcgacgggacgaagggcatcgcgctcgtgctctcgctctggggattcgcctcctacctctacggcgagaaggcgcagaagaagaaggaggcgcagaagatgcgcgagcgcgagcaggaggtggcgctggcacagaagaccgcagacgtggagtcagcggcgccttagtttacaatgggattgtacgtgtctacttgggtgggtcgtatacatatttacgggtgtagtgaacatgtttctcagtgtagttttacagtacagtggcatgcataaattttgtacgagattgtttcaaattctgtatgacattgtttcattatatggtactagcacgcagaaaaagcaagtgctatagttgtatcaacaaagagaatactagcatatacattcacaagttcttcacttcatgacttcttcccagtgctggtaaaacctttatactactagctagtctacaagataacaagacagaagggaagattgtaagccgccatgaaggggttgcatattaaaatgccatttcacttcatatagagcacacagttgcttggcaacatgcatgcctgtgcagaaggagcatgtgctgatatgcacacctggagcagaaaagagggatgggactacggaagcacaagcatgcatgcaagaaacgacagggataaaatagtttcatagtataaaactagtaaaaaacaaaacaaactaatccctccaactccatgtctccatgcatgctgggcagtgcatcttggcatgtggcgacggtcgccggcgtcgtggtggccgacaggccgccatccggtccaacggcccagcaatgacttacaagaccaaagagggcatgggcccacaagaccgtcacgcacgcatgctacggcactggatgatggaccaacaaggtgatcgctgtcgtcgcctgcaccaacaccaagttgaatccgaatccactgcaatttttggaggctgtgcgctcatccagtcaccctgagcatagatgacaaaaacgaacacaccaaaagaaaaacaaatatgggcccaaacatcatggaatatattcacattgtcatggaatatggaattcttgtacaagatacaggggaatgacactttttttcaccaactatcaacttattctgccgtagtactgtaacatgaacctcaaaacacagtgtctgccaactgccattgacggaggtaccaactaacattttactcgatctctcccttttgtcaggtcttggtgcttcatcatctcctagagaacttggacacgaggtacactagaaagaagcagacgagagcgaagaggattacatgaaaaagatggttcgaaccattctgtatgattttcttgtttattctcctcatgttattcttgacgcctgcctgggcctttgtcagagtcatttgctgcaaacaagtgcaatatgcacattagagaccgagcacaaagcgtatttcaagttttcaacacaaactagtgtacatcttattgcagattctagtctacacatgttctcgacaaacagagaaaggaatatgccagacaagtaattttggatgatctagggcattttatagagtaaagcctcatttcgatggaccttaatctgggtccatcaaattcctggcctataggtgtgctaacatggaaacttctcatgtatatgtggcctagtccccttttctttttccaaaaactatcgaccaacaagatgacaatggagagaagatcagaatgtgattccatttaggcacgaacatcctgctaagcctgaatgatggttatagtgtacttttagagttctcgtacaaaggtttcagattttaaaacgagcagacatcaaattccaaataatcaattatgattaaatgtacgattctacaagcacttcacttccagaaactactattttatgaaattttaacatgatgccgctacagatagactagacaaagctcacaatgtaagtaatacccaggataccaacatacaaggccgaattcatggtaacttttagacatgcgttagtgcataatgaatcaactacagtgcatgggatgggatgactgaacatgactggttaagtgacaagagattgaggatcagcagattgtgtttgaagaaacattacactaggaaccttgcgatcagtgataatctatctgctaaaaaatgtccatgtgaggtacaataggcgtgccatatcaacattccgataactcaatctaaatgctattcaggatttggcccaaactgtctcgcagacaagttacttaccagctgagagatgaaatcattttggtacttggcctctgtttggatctcttgggcaacctgcagcaccaaattaatggcttgtttagaatcgattgaaagaatatgaaaaaagcttatgaacataagtagatcatggttcaattactcccacatagcatcacgcaatttcacaacaactctagctcgccacaccggtttcatttagacaccaaattttgactaccttccacaacagagtttgctcatacagattcataacaatacttacccctcttagcttacggacttgcccacgaagtccgacaatatggtcatccaaatcagcggtaattgggtcgatctggagcgaaatctcgctggagcttgatgatgcagccggcctggccgtcagcccttccctgcagaaccgaacattaggatcaggataaccgagacaaaattggaaagtccaagagggaaaacgataatttgcacacacgaatcgacggttaatcagaaattcagaatcaagccacgaaattagggacttgtcgatggctcaatcaacaacgaaatttcatagggtaccaacaggggaagcagcgcaagaacacaaatcgggggaaacgaccccaggtgttcgtcaaccacgagaaatcgaaatcaaaagaacgacgcgtcctggcgaatctaatcccgcaataaaaaaaatcgaaggaatcgacgattaggacggaaaactagggggggggggggggaagaagaggcgaaccttgaaccgtaggcgccgctcgccattgcgagatcagaagagggagaccacgaaagattgagcccgaggagatggagaccgatgctgctttcctcctccggatccgcgtcttcccgggcggagatcgaggctgcaaatttcccagcgacgcggcttggattggaacggagaggagaggacgaaggagagaggaagggaagcggagtagaggggggaaagtccgaggacgtggcagatcggacggcccacggttcacggatgacgcgttgtcgaagcagcggtgccagcgtgcagcgaacagcggttgcttctctgtcaggaaatcaggttaatcctgctttagtgactgttttgggagtttaaaattctgaaaaacagcgggtgagaagttagccgataagaattcgaagaaactatgtttttttagcttcagacttctaatttattttctagattcttaaaatctaggtgaaaatctaagtgttttgaaagtttctgacagctacagcttataggatgtcataagctccccaaacatgcccacatggttttacctgctgcttcgtgcatatgatgatgcttttttataaacttgtatagcacaaagaggataggttttccattccatcaggattttcctattaacgcttttttttataaattgttaaatagtgtgtttcgtataaaaacttttataagttactttaaaatattaaataaatttatttttaagtttataataattagaacttaattaattatgtgtcaatagctttctcactctacgtaccttatttaatcttaagagtatgttcaatggtagagacgattatagtctcttaaataataaaagattatttagagaccgcgtctttacaatagttgagacgacaaaggctctaatcattaactcaaaaaaatattcattttgttaacattcgttccatttttctaccctcatacaaccatatttccatattatagtgattaagagtcgttgttatccataacaaggatgttttgtctctcctctttctctttcttccatatcaacaaatattcctaattaacaacgctaagagaccactgtggataaatattcctaattaacaacgctaagggaccactgttgacaatcattgtacatgccctaatatttatctacctcaaactgacccttacttccttacttaattacttaatcttaatcttcatctattcaggtgccgctactggatggtcagacaatgcagcagtaaagggagaatataaatgagcaaaactcatggttcaaccaactcaatcatgtagaagaaagttatttcatcataggcgtcactttgtaaacacttcaaaattggtttttaatgcgaatttctttctatcagcctggcactattatcgaacgtcagaacagacactcgtttgatattgcaggaagccaaatgaaatccagtcggacaacaacagagagtaactatcgagagatcatgatgtcacatatcaaaaaccgtttcaagtcggtacacattgcaagaaatgccaacacctatccaacaaaatacagacgactgccaatttgatgaaacacagagtatatcacaaactgtaatatgttgggcttgctatccccaatctatggacatcactaagctcgtagattctgagcctcctgaagtgcttcctgcagattctttacggcgctgtcatagtacacgaagcccatgaaccagaactcatgattatcaacggaaaccacctggatgtatttctcagatgcatttgttctgctcgttgaaggattcactgatctcagttgggtgtggggaatgacaacctgttgtttcagacagaacaatgataagttatgcacttctataaaatgattcacgcaaatggagaaataacagcaggctaatggaagagaaagaaatctgcgactagtttcatgaagaaaagtaaaaggaaagcacataaaccaattcactactttgctttctacacagtacattatggtaagatatcttgcttcaggagaaatttgtcacactgattatcaccagcggttgtattgtgaagcagactcggtatgatctcaatatatgatgaaaaacacatacaggtaatcagaataccttatagtagctccactcatctttgtctccaaccttgtaagcaagtggattatcgctacagaatgccagctttttattggacaggtatagcacacccatgacaggaccagcagaggttgacagataacatgcatatggtttcttcagtttctcgtcagggaggacatcaaatgtttgatggaagattttatcatatccaccttctgctatgactttggtgatctgggaaaccctgcccattgctgcatctgtaatgcttggtccagttttcactgtttcaaggcaaattaagattcgtgttatgactatattatctcacgctgctcgaattcaatttaagaaacttataccatatcatttcaagggatcaacagtacaatgagcatgtgaacaaagaaggctcaatgcatgaatacaacaccaaatcagtgcaactagaaaataagggagaggtagcacaatgagacatctatctggaatgatcagcattataaaacactgcaagaatttaaaacatctttttactctctacattgttaagacatatggtttacctaacaaattaatatgcatgagctattcactgcaaataaattgtgttatgactgatagaatatacccagcatttctccgttgtcatcaacaacgccaactccacataaatccaattacatagcctaatagcaacagcaccacccataatccatatgcgctggaccaattcaaagtttcaaacagaccaaagaagccaatagatagtgaaccttcttcattcagcattactataacccacagatctcaccagacagcacaaatacccaatcaagcactactgtaattcacaattctcaccaggccgccttttttttttcgaactcatcaacacgaattatcgtcaaattccattagcgctaactaccgatataatacccagttcccccacttaatttaattacatgctactcataactccaaaacgaagataatatgcagaaaaaccaagcattggtaaactgatacagaacaaaaaccaataacttcagaattgaagcttacagtgttgccagaagttgccggtgagggtctccgtcttgcgagccgcctctccaaacctcttccccatcttgccgagaacatccttcaccgtatccattgtatctgcaaaaggggaaatccgaaacagttaaaaaaaaaaaaccccgcaagttatcctgccaacaacggagggcagattcggctgcaggaacgcactcttggaggcgggcgcgacgccgccggcgggtgaggagacgtaggggttgcccgagtagggcggcgcggaggaggcggcagcgtggtaggacggaggggggggcggggccacgtcctccggcgagagcctcgggtagtgcgcgtagtccgacgctgttgctgcggctgcgccggtcgcgggggccggcgccgccgtggcgtggtctcctccggcggcggccggcgggtgcatgtcgacggcggggaggtggggcctactggtcagacggtacagctgggcgccgcgtcgtgctcgacgtaattcctggacccaacggacgcttcaggtggttgccttttttttcttttctcccctttttttcttttcgaggatatcgtgactgcctgtctccgaagctgatgcggtatatatacataatcgaaatattgaattttccattgcttcaaaaaaaaatgccacacttaaataacacgatgaggtcatcgctaaggatttcgagtcttcggcgaacttgtaccaacaaatgcttagccacgaaggtgctttcatagcccgctctgatctgtagtgtaacgcccgaggtctctcggtcagcgacgcgttaatatttagcggcccacatgtcagtcctgtataggtgagaatgagatcggatccaaccaagtgttgctcctcctccttccaacccgttaattccgctgcttcgcgtagtactacagcagcaacggttcattcctgcctttcggaccccaaactctcccaaggcccacctcacgtgagccctgtcgctccaccgcccaacgaacggcccagcctgcgtttcgactcgcgcgggtgcagcactgcagccgcgtctctccgctcggcgcgttgcactccgcagcgagcggcgagcnnnnnnnnnnnnnnnnnnnnnngggagaatccggggaatcgcacgcgcgcacgaggagcgcaccgtgcgtgcgcccacggccacggggcccgggtggaaaaaacgcccccgtgtgctgggccgtccatccgaacgcgtacaccaccgcgcgcgcgcggcacgatgggccgccgatcctctcgcccgcctcgcgtagacgcgtacgtatacggcggcccaagcacttgggggggatcttggggaatactggaaattggaaaagaaatggagatacggggctacggatacctacctactactagtgcctagtggagtagtcgttttttgcacctgaaagtgagagccccaggctgaactcgcaacctgccactagcgggaaagaccagcaggggggccacctttggagatgcacgaggggcattgcccaaaagttggccactaattgggttctttttttttcctctcataaacgactagcttagcactgctttattagactaaccgtggatctttttatgaccattactatatatctatttgcttcatggtctcttgttcggttttcaaaaggcaccgtgctttctctttgtgtgagaaatagagggaaaggaacctcctttctcttcattaatttttgctcatacgaattgaaatgatttcccttttgtccttaacaaatgggaattttccttatcattgattttcagctaatgttgttactcttgttagcttagacctgatcaatgatcccacgaatatagtatttactgtataagattgattctagctcaacacaaaactgggaaattcacttctgagtttggtctgaacaaaacaacaaccagtcatggaccaggatatggagttatctctttacaatcttaaaaagaagcggataccttaaagaagactattcttaggttttgtgcttggccccggatatcaaatcaaacgtcattgtagctcctctcctctgatcctctcccctgttgtgtcgaataataatagacagaggcctgaatgggaggaagctgaaccttatagataagactttaccttttttgcttctcccttatctccatctccttagtttttatatactacctccgtcctacaatataagagattttaagtttttgtttggaacgtttgaccactcgtcttattcaaattatttaaaaaaaagaaaaattgtacttaaaataatatagataataaattaagtcacaaataaaataaataataattttaaaaaaatttgaataatacgagtggtcaaacgttacaagcaaaaacttaaaattccttatattatgggacggagacggaggaagtacttattatggggatataatgactgtaaatatgtgggagaaatatagcttaaaacacacgtggctgacatgcatacaacggtaaatcacatgatgaagcatgtaaatttggggatcacaagagcacaggtaaagatggtatcattatgcctagttagttagcatgaaggatctctggacaaactggtagatggtttgattccagctcttgtaaacaaatgatagaaaagtacagtgtttggtcagcactacataaataacaattaacatgggacagatcaaaatgtattccaccatgaaataaaataatttatcataaggaagtactcagaaaataatatgccttgctgaacagaagttgatatggagtcacatggcacagtgcaagccagttctttttccctgaaaacaattatttgcagcaactatcacacgaagaagagaatttattggacaaaattaggaatggacaactgtattttttttcttttgtaaaagaagataaatcactggcaatatcgtgaggccagggtgcagtaagtgcttgagtggacaatctgagttgtctttatcatcatcatctctttctttctttctttcttttttttgaaacaaactttagtaccatctttcttgaaagaaattgactttcctgcttgtacagatggatcaatatcagaaacgaatattgcatcatgtacctgtcaaaagatcgagaggaagcagaatacttacgttttcattgcatgcatacagcccttgaaacaaggtaagaactagtgctcaagatttagcaagaagccactattagataaaaatacaatgaatgaggattgatgaacaatgtagttgtgtagatgcacagttgtatgtgaaggtccacaagtcctttcctctgagagtttttgagtcgtaaatgatcagttcaaccaaagaaaaaggagaatcgagatgtgcaggaagtccactgagaaagttggccacttttgcctctagtttttatttctccgtgcaggtaaatggattatgttattgcaggtcaaataatagtgcatggcttttggtgttaggagatgtacagctcatctgcaaatcaccaaaaaacaaaacgcagttactctgaagtcgtaacagcacaatcaacgacctggcctttttgaaatctcgtgctaattaattaagcaaggatgtgagagctagcagcacgtaaagtaaaactgcactaatcgttaaaaaaatgttattacaagtaaactaacccaacaccccaccggccaagcgtgatgtgacaaattaaaagcatgttgtgaaaaactgttatctgaataagtcgtagtaccacgtcacactaattggaaaaagggtcatcaaataccaatcagttttgttaacattgtaaaagattgtgttttgcatgcgtggctgttgcctgttctctgaaagaatgtccaattattatgtggtgttgtgaacagcttgtgcctgaatttgcatggcatctgaagtcctcaaagagtagcagcaaatcgctagactgacagaaaggaagaagaggccttgatgagagaatctgagatgactgcaagcaccgaatgctcattctgtacacttctcaagtttctggagcatcaaagtgtgttctctgcattccgttcaaaaaggaaaaaagaggagctcgatttggatcttagaaaggtattaactgatcagacacagtaacagaaccaaccagcttcaatcacactcacaatggtatcatgcatggttaatccatgtcatgtacttgggcttagggttctctcctcctccaaggtcttatcatataaaccaactggccaaattttgaatacaaggcgcctgcatagatcgatcaaattcggagaatataaaaattgggacagtatgagctgtgtttcttgttttctaaaactaaagaaataattctttcgaaaaaaaatacattggaattaaagaactgggaggggggtaaacaagggtgtgcgtaaactactgtctgcactaagaatcccaatgccttgactgacagcaatccctgcctgaaaggccgaccaagcacaataaaagatgtggaaggaaacaaaaacaaagaacctttccttggcctatctctcgcctctttactgttgcgtttctaaacaaagtcccttgtgcatgtggactggggcaagggtgaaggatttgttttttcggatcattttcaaatgcctttccggatgggcaagggggctcatcatctgtgagcatatgacaagttcaaaggttagtaatgaccaccatgctcctacaccacatcaccaactaaaagaacaaacacgatatttgtttaaattagattgattgaaattaaggacctttcaaggactttctcccattcagatgaacggttttggtcgctattctttgtatccaatatataaggaagtagtagttgagagttgagactagacagaagttattctgtagctagaaagtcttttgtttgtcatgtatgcgagtgtgaaaacactttcatatctggaataatttaaccaattcctcagaagctatttccaatcattattcagctccagaccatccttaggggggttttaacttgaaataccatcatcgcttcaatagagaagacaactagatatccgagttgttaatactataagagtaaaatcttgtgctaacaagaaactgaacaatttctttctttacataagttagatcacacattttgatcttatgaatcgctttaatgtctacacatatatatgtcctccacttttcgtcttttcatggctaatgtcacttccacactaccactcatctcatatccattctctctcgccatagtcgcaagccatactatcctgtttgcgtgcctcatcctatatctcaggtatagatctcaaaggctagtgtgatcgaacaattgtttcaccatcgcggttggtccattctttcaaaatgcataactccacgttcttccgtctctacgttgctacttgtatttacacgtatcttcctcctcagctagtagctatcagtgacactttttagtacatattactcaaatctatatagatgataggacatatgtgacaaccgaagacactaaaatttgattttgataataaactgtaattgaaataaccatcttcactaccagaacaaagcattcaaatagctttcaacgaatcaaaacatgcctagctggaagagagaaattcaggtgtccaaaactccccccgtgcatacaatctctttcacgctttcatcacaccatctgaaaaaagcacaaaggccgagtttagttccaaattttttcttcaaacttcaaacttttacatcacatcaaaactttcctacacacataaactttcaactttttcatcacatcgttccaattttattttgacatgaactaaccacacctaagcaaataatgagagatgtttacatctatcccagcttccctctctttgcctttgccagtcccacggggggggcgggcactgtggtggtgccgccgtggtgtgtgccgttctgtagagcactgcggctcccggcccaaccgcagcagcagcagcaaacatacaacacaacaacaagtacacgcctccctcccacacaccaccccggctccgcgcgagaggtcgctcacgccgacggaccggcccagtcgccgagcgggttcgccgcggggcgtctccactccactccactcctcgccggccaccaaccaaccacgcgagtggtgggggggtgggtggggcccacatgtccgaggaggacgacgaccagccgccgccgctgccggcgcagaagcggccgcgcgcgtcgccgccgccggaccaggtgctcgacaacgtcctcgagacggtgctccagttcctcgactcggcgcgggaccggtgcgcggcgtcgctggtgtgccgctcgtggagccgggccgagtccgccacccgcgcctccgtcgccgtccgcaacctcctcgccgcgtccccggcgcgcgtcgcgcgacgcttcccggccgcgcggcgcgtcctcctcaagggccgcccgcgcttcgccgacttcaacctcctcccgccaggctgggccggcgccgacttccgcccctgggcagccgccgtcgccgccgccgcgttccccgcgctcgcctccctcttcctcaagcgcatcaccgtcaccgacgacgacctggacctcgtctcccgctccctccccgcctccttccgcgacctctcgctcctcctctgcgacggcttctcctccgctggcctcgcatccatcgcttcccattgcaggtaatgcatctctccatggaactttccaacttccaacttactagtagtagttgttgttcttgttgttgtctagtcgtccgtggtaatggcggattcgatgcggtttgctctcgctctgtttcttgcagggggctgcgagtgctcgatgtggttgactgcgagatgaacgacgacgacgacgaggtggtggactgggtggcggcgttcccgccggggacgaccgacctcgaatcgctctccttcgagtgctacgtccggccggtgtccttcgccgcgctcgaggcgctcgtggcgcgctcgccgcgcctcacccgcctgggcgtcaacgagcacgtgtcgctggggcagctgcgccggctcatggcgaacacgcctcgcctgacgcacctcggcaccggagcgttccggccgggggacggccccgaggatgtggggctcgacatcgagcagatggcgtccgcgttcgcgtccgctggccggacgaacacgctggtttcgctgtctggcttccgcgagttcgagccggagtacctgcccaccattgccgccgtgtccggcaacctaacgaacctcgacttcagctattgcccggtcactcccgatcaattcctgcccttcatcgggcaatgccacaaccttgagagactatatgtaatgcctggattgcttcatcagcttggtttcgactgaactgcgcgattctgcttttctgacgatgatttgtttgccaggtgcttgattcggtgcgtgacgaggggctccaggccacggcgaggacttgcaagaagctccaggttctccatgtgcttccattgaacgcacttgaggatgccgatgagctggtgtcggaggtcgggcttactgccattgctgagggctgccgagggctccgttcgacgctttacttctgccagagtatgaccaacgctgcggtgatcgccatttctcaaaattgcgtggaccttaaggtattccggttatgcataatgggacgtcaccagcctgaccatgtgactggggagcccatggatgaagggtttggtgccattgttaggaactgcagcaagcttactaggctctccacatctggacacctgactgatcgagctttcgagtacattggcaagtatgccaagtcgctccggacgctctctgttgcgttcgctggagacagcaatctggcgttgcaacacatcctccaggggtgctcgaagctggagaagctggagataagggattgcccatttggggatgctggcctcctctccggaatgcaccatttctataacatgcggttcctctggatgtcaggttgcaaccttacgctgcaaggttgcaaggaggtcgcacggaggctaccaagattggtggtggagctgataaatagccagcctgagaacgaaaggaccgacagcgtggacatcttatacatgtatcggtcgcttgaagggccaagagaggatgtaccaccattcgtgaagatcctataagctgcttctgcagagtggcacttgatacgctgaatgcggcctaagcaacaagggaaggtaagatagctggagtcaggcgtatgatcattttttgtatgcttgaagttggaaggagttctaaagccatctatcagagctgcaaatggttaaattgttgtactactagtagggggggcatcggtatatgcaaaattttctaccgcaagatcataagtgcatcagagcaggcttcttcgagggggcttcatcccctcagttttgtttgctgctctgatggccttctgtttgaggggggcaatctatctatgccggcacaaccaccatggttcctctaatttttttcccaactgaagcttgtcatcagattaaattcattaacacatttcctgtttcttgcctttataattccttctgttttcgcattcgtatgttggaactcagaaaaacagaaaccctgctgaattgagcttatgtttaaattcctactactatgtgctcaaattttgggtgatctctggttcaggcttgaaaaaaaagtctttgaacttgtcttttcgttatctcctctgaatcctgcactttgtctgttgatatcattacctggaggtcctactcctcacaacctgaaagctctatccatgggttccttattgggaggtcagcaaaagttaggccctagtccatcaagtgattattgcttgacagcccccagtttccggcctacgtgttctccttccacgccagtgaaaacgacggccggcagctgcctccgtctccggtgatccaccaccattttttttgcccatcagaaacatatctcatgctgatactgttggagaaaatagtcgccacagcctttttcttttcttttttctttttttcctttgttctcttgtggctgcatctgcttctgctgctgcagctggtcactcacagcttcttctgagaaagaaagaaaagctttgtaggatggtgaccaatcctacaaggaagcctgggtgcatccaagcctgagctcaaaaagattgatagtgaaggggtggcaaatgatgagggagtgatgaccggtcgatccatccctgatggggattgatcgatcgttttgactgatccccacgagtccctgactgtcctcacccccccccc

SEQ ID NO: 32282 - DNA, 3042 bp, Oryza sativa
  unsure (1)..(3042): unsure at all n locations
ccccccccccccccccccccagctgcagctgctgctgctgcgacgagcagtccacaggtagtaggagtagtagatgccaacccaagtggggatccatccacagtaaaaaactctgcagctggtgaaaagccttcctcaccaaactcattggctcccttgaccatttctccctgtgtgtatctcaagatgaagatgtgatgctgtgcaatgttattctgatgattttttttttggttctttctctttcggtttcttggggtgtctgtccattctttggccaaagaaaaaaaaagggtgataggtttctctgaaagtgagagatgcagccactcattgtcaaagcaagatgtccgaaatttttgtgcttaaaatcaggagatctcgactgatatttttttttctttctgatcatccgaggctgaactgagctttttttggtgatggtacatttgaggctatagatggatctcctcttgccctttgccatctctgaaacatcttgtcaaataattggctactattgccactccggcttaagaaaacgaaagaacattttagtttcttcagatctgggaggaatgcggatctcaatatctcatatgctcgcaacaagctgcgatccggccacgggattgaatgagactgatgtggaagaaagcgcaaagcttgggctgtttcaaacgcaggagtagtaatgagggggactgtgattgattcacccaagcagaaagctgcaagggctatacgccatttggtacagcgttttcatatgtgtaaactttattactgcctctactactatttacatgaacagagctattaccagtttaccactggggtaataattcaggttcagacaagagacttgtaatcaggagacagttcatgtcaagaactcaagattacttgtggctttaatactgaaaacctggggggttcttcttctggttacaccctcctctgaatccatttccattgcgtttgcttttgcattgtgtttacctaaacctgcatttgtggttctatgttgagagccatatttgggaactgcatccatggtccacacatcttctcttgcagtgttctttcagggttgtcaatgatgatcctgtcttagctcttgtcaaacacgacgtaaattatagcttttttcagacgcattatgcttggcaaaggagagaaatgatggcacaaagttgattcttttttttaactgctgacttttccctatttctaccagttcagtggctccaatcttagcaataggtgaagaagatactccttttctatagccatcaagactgcatgcatgggaacagatcatttttctgtgtgcatcaggcaaaatctcttctgaaagttaggcgtgcgtttccatatgtgcagaaacattagagcagtttttaatcagatcttgtcagttataaggtacaatacaactgcatatggctgctggacttgggaagctttttaatcactactagtttggtcaggaaacctttttcctctgatgattatagaacgatcaagcacaagtttaactgctaactacttcctccaatgtgggcctatggcagtagtagggctttgcaatcatccaagcttgtgaacagtgataagattggatttataggcttactttatggtgtgtcaacaccttggttttatttattttttctgtcacatcaacttttctgattgaagtagtagtagtgtcatgttcctaaatatccaagattatatgaacagagtgtccacatgttgtatgaaatatgaaggccctcatagaagtgaagtgctttattaaattttagaaaagctatttaccttaattgctttctctatatctgatgttttgtantgggaattatatactgtaaatgttaaagctcttgatggaacgctgtaagcgcatcttttgtcaaaacatcagcaaagtatattgctttataggaaaaaggaaaagcaaagtggctttgtatttgtgaaagatggtttgcaagaacatattctgtaatctgaaccatgacttatacttttggaaaataccggatttactctcgcagtaaattagtcagtgatttctcgtacatcactagattttcttgataatagaataaatatctcgttatctcgtacacatcatgaaatagttctggaagaagttatactcttgatttgtccttaggctttgctgattagatcgaacctagttgtcagttgtgactggtgactgattttgctcgttcatttccaaaacttgagatgaattaaattaaaaaaatcaccgacaattcttgaaacagtttatgagtgatcgtaataaacatcaaatgtcttgttgggacaagaaagggattttcagttcttgcaaaagaccattattcatcttctagccaactacatttccctggcatgactagcatttaagttggcaagatctaatctcattagcttgacatttctgtctgtttgatggaaactcatacctgactgaagcttttctactctaagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtctatctctctcatccgattcctgcgtttttcctgcgctcgaatcaaacgaccattcctgtgtttttcctgtgttttgcaatcctctgttttacactttaattcctgtcagaatcctatgtttttcctattcctccgttttttctaccctgcgattcaaaggggccctaaatattctcattagccaacagatgccaaacgcatgacccaaagaaaatgtgcagtgaactgctggatgcagagagttgcatacaccaagcactcctcaggcaatgatcatcaaattatatatagaacaaataaaggagtattcagcattgcacaaaaaaatta

SEQ ID NO: 32283 - DNA, 148 bp, Oryza sativa
cggtttccacgcacttgaaaactcacgtgtccaagccggaaaaccatggctcgcttcgccgtagtcgccgccatcgtcgccctcctcgcggtcacggccgccgcgcaggccccgggagcggcccccgtcccggcgcccaagatggccc

SEQ ID NO: 32284 - DNA, 4173 bp, Oryza sativa
  unsure (1)..(4173): unsure at all n locations
tcctgcagccctgcacttagccatgtattgtacaaaggggaagaagaaatgtgtgttctaacattgtgttacattcttgaaatatttcagcaaagatggcatatgggtgggtcatctgctctctggttactcattgcctatggaagtgtcacctcaaggaaatggaaaaagttatagtgatgttggtggaatgtggaagcattccatcaaagtttcatatgatgccacgaaggcagcatttcctggtggtcaagttatagcacatcttgatcaaaagtaagtgtcatatcctttttgtcggtgatatctaatcgactaaccgtataaaagatgctacttcattaccttgtgcttctctgatgtataataatcttgaactgttttagtttaacattctaattctatcagttggtgcttgacttgtaggagcttcaagggctggcaaaagaatgctatcatgagctacttgcaggagctgaacataaggataggaaaacctaatgatttcatctaatatgctgcagcaggtgtccacataaaatttttctgcgtcgtatatcaggtttgcttctactcatgttttggtgccaaattcacttctgcataattttttttttgagaattacacagcacaacacagacacataatgcatgcacactcacccctatgaacgcacgcacgcaaaccctacccctatgagtaggggtggaaacgggtcgggttcggtcggatcttatccttcccatatcctaacccacatttcataatcgggatcgggtcgggcacgaatattgtcggatacgaatacaagcacggataatatcgggaataaatacggaacaaatacgtaccaagacggatacaaacactatcggttgcgaatacttattcagatatgaaatcaaagcaacatccatatataccatataggcaataggcgttcaaccagtccatatatgtataatatgaatatgttagaggcgtagggaatagtaatgcctatcagcacaacagaaccaaagtggctgtggttgcatcgtgtagtaccaatgcatttggtgccaacacttcggtaccagccagagatgcacctgtgcttgcacagatactagtgtttgcatcaccactagccattctatcctaatcctacaggcaaccaacaaaagtaaaataagaaaaaaatccttcaagtcgtaaagtgatgttgataaagggcaataaaacacttaacttttgctcacctgatggctgggcctggatgactgctgagaggtgactaccagaggagatggtcggcgcctcggcggtgaccggcggggccttgcgacggtggtcggcggcggtcaaacggctgtcgcatatctaccggcgattgcaacagtggccagcgggcgcgggtacgcagcaacgtagccactagtagctagcacatcgcctagcggctagcatgcgcggcggcggtgctggctgtatgcctgtgcctgtgattggttgctcgcgtgcggcgtgcggcgccctctggctgctgcctgctcgcctccctgacctgaggctgagtgttagcgctcggtgggccttttgggctgttatgcaattgtgttgatgcctggtggtggtagcagtccgggtcatatacgggtagttaaccgggtaatacccgcacaatttaccggatactctgtatccgtcggatactgtcctcctgaacccgatcttatatccgtcagaaaaaatccgtttttgaatccgatatccgtgtaagcactcgggtatcaaattttgacccgaatttgtcccgtattaatacgggcgggcgggcgggaaatacccgccccgttttcacccttacctatgatcatcttcgaagactaggccggcaaatcctggagatttgacacgcccagattatgtaaatatataatttgagggaaatgtcaattttcatctttgttaaagtcttttgagtttctaacgataccagtatcatggattgttcgttctatttttttctttgtttctgcttagatcacatgtcttctgttggagaaagtcctgaaaatttgcaaaatagtagttcattaactcaaaattgctggcctatctgaggcctacccaatattctgttgaattttgctaacatccgacatttttatagtagaaactagaaaacacaacattatcagctaacaatgctgctttaatattntgtcaaactggccccagaaacattntaggaaggcagaaatatangaaatgccacantngtttttggtattcgtgcaagcaaatatatataacaaaacccaggttttatgattgaagttgcaaaatcaaaggggatttttttagaacacgcaggagatctgcatatcatttcattaagatagagggaagaaggtggacagcgttagagaaaaactccgacacccacccacccgaaagttcaacagcaacaccacacacccacaaggaacaaaacggccctagtatcctagcactatagccttagacaaaagatcatagagcttagaagctcctgctagtcaccgtcctggtttaaaggtttcacaaaggtccaaccatattaaaatctttagttattttttatccactttgacctattttgttcaaggcattaataaatttatccagctagagtaattaattaagtactaataaataactcgataatattcacagatgtattgcatggcatttaaatgaaaaatgagattttatgagaccttgagaccacaatacctgtgttatgtgccacaaccgtagtatgtagggttttctgcaattttgacatgagaatatgggttttcttaaccttactcttctttgtatggatgactgaacaacttcactcctgcggctgcacaacaactgcaaacatggtttctttttcatgaggtgtaattggttatggtattctctcctaaaactcaggtaacaatagtgcctacaactatcattttactatatactagctaaaggctcgtgtgttgcaacggatattataagagataaaagcaaaagcaaaagcaaaagctacaagtttatagcataggtagttgattaggcatataatgccatattcagagcaaaagcattcacgtgtggagaccttatggattcatatgtcagcttgttgacgttggacgccaccactagcatcatttaaagtagtatagagtatagataacacttctaacataaacctttcaaccaaattaaaattaaatctcagaaaattagctagagttagatgttttttttaaaaaataaaaacagagcaagagaaaacctagatgtctctcaaaataaaaatattaacccaaaagtgatagcttgggtgagcaggttaaccccccttgctgtggtttatatacccagctaagaccttgttttgctggccagtgttccggctcattccccatgggttagctaggatattcaactaaccaaggcctaagatgacatctgtaaactcactttctacgtgtatcataggcttgtattgtgtgactcacagtttgcatgtctggctctggcatatgtgcagggacaaatggtaaaggtgcagccctgtgccagggaggcaaaggagaatgcagcctcgtgagttgatgatgttaatgttcctggatgctacacatgagaagtgagaagcaagcaatagtcatccttaatattgcaagggaagccaggatcgatgctgctctgaagaaacggtctagagtcatgtcaggaaaggtggcagcaaaccatccagctagcacgttatctaggctttcatatactagctgtctagtaggagtatttctcaggtttgtgcatatggtggccaaataaaaattagtacaaaagagacccatataaaaagggacacattttagtattataaatctggacaatagtgatactaggttactatattatgaaacaaatagagtactttgttttggggatgcaactagttggactccaacagggaactcttgaacattttttcttattataaatagtatgactaccaaagtaacaaatgactatgtgtgcacattatagaacaaactttttctatgatcagtgtaaaccttttgttatatagtttagcagtcagcaatgaaagctcaaccttttaactgttacacctgcataaaagg

SEQ ID NO: 32285 - DNA, 3527 bp, Oryza sativa
  unsure (1)..(3527): unsure at all n locations
aacagaggtagtagaaagcattaggatagggagaatagccaatatgatccctaaagtttcgctcctggatcattttagttcttaatctttcatattgtacaaacaagttctttaaatttgtcatgtgggctgatatagtctttggtcccaccaaaatcgccacatggacatgccacgtcaccttcctatgtaaaatctatatgatttatccaatttaccctcacatgtatcataggaaaataaaaacaaaagaaaaagttaaaaaaatatggtatatgtaagagcaaaaatatacttcaaaagggtgaaaaaaagaagtatttttttcctatgttatgtctaattcacacctatatttatttttctatgatatacgtaagggtaaattggacaattcattatcgattttgcatgaatgatgacatggcatatccatatgatgattttggtggacccaaggactattctaggccttatgacaaagtttaaggatttctttggaccatttaaaaggtcagagactaaactgatcctatagagaaactttatggactaaagtagctattctcccaaaaataattaggaaaagggtggaagcataggcatggtgaggcaaaattatatggaagagaggagaatggaaagccgatggttgttcttcccagctggctgctgcccttgctgatgccaagtgtcctttctcttttgttttttttctcaattacacatcagatgtacatgcacacgaacaccacatgcacacgcctgcgagtgtgcccctgatacacggttaaagacatagaaaccaacagcacatatttggccctagtaaattcctattcaaagatcactcgcgtgttttatcggtggaccctaggatttgaacctgataggtggcgatcagacaacctctgcctaaggcctacatgcgtgacaagagctttcttgagtttttttccattgtaaaatggagttaaaactcaaaacatgttgctctctctatctaaaatattgaacattgctaagttatttagcagagattaagattgaataggaaagactttggtgcgctttattagttgagaaatggttgagggtgagagagtagttaagggtaagttggtggataggacaagccttgttccggccaactaaatcaagtggccatattttaacaaatatacttatattaccttgtcctatagttatgatatttttgttttatcattattatccataaacattccatgattgacatatcatgtaaattgtcacacttttctcgtgaagtcttgccaccatagttattttgagccatcaatgattggtctatgctgcaaattatctctcctcacaaagccacactattctagaccaatcattgatggctcagaaaaaggacccgtcaaaggtgacggttatctgtgactaattcatagggccatcactggtgtgccgtcacagatgtagggttctggcgtagtgtctaactcgaacgtgcatatttaaaaccgagcgtatcaaaatgtcacgtcaaccggctagatttttatcatatgcctaaatattggaagctggcctaccatatagaaacatacatttacactgtatcaacgacgattcaaataaaacaataaccctgatgagcaacatatacacttgactctattgccacactaccgatgtgcttccatgaagaatttagtgaggatttacggtccacacgttgatgcaataataattagcaatgactatatatttagtggtactccctccggttctatattaattaacgttttggacaaggttaaggtcaaacttttataatttagactagcaataactttaaaaatatttagtttaaagtaactagaacaacttatatagatttatcttttaaagtactataataaaagtaaacatgtatttatttattatatatattataatagaaaataaggttaaagatgtatcttgtagatcgtgtcattgtccaaaacgtcaattaaaatgaaaccggagggagtagtaaataagctagattgaaaatatatattgacgtttgagactgagcatgccagagatccaacgttattgctatagcaattaatagagaacaataatcacccatgttgagtgttttaactatatagagaaataaatgatatcttaaagagggtatactgccgtatgactgcatacactccatctggtgtgtatatgtgcaccatctggtgtgtacatgcatatgcaccatataatcgaaaaagaaaaatcatcactaagaatacattgagtttgcttgtcatgtcatttttttttaaaaaaatcgaactagcctatattccggcctgtaagtgtggtctgtggaggtccatatactagtcttgaatgttggaacatgctaatcagtcagaatcacaatataacacttttaagtacgaatttaggttatgtcaactgttaatcaatccccaacacgacaagtctcagtgtaaagtaaacactcacccgctgccaactgaaagtggttaattttgaattagccttccgatagaatgcttttaaagaagacagggttgccgtcagtttccatccagctcggtttgatttggtactcaatttcgagtttggcaccaagtaacaatcatgtcagcactcaaactgatctaaggcatgtacagtgttcctgtgatggcagttaaatgttcactttcttaggagacaaatgaagccttgtgctgccagaaaaatcgtaagaggtcatatcatggatatttgacatattaatctggaagtcctcgaattcaatttaaccctgggtttttcgcatggaattttctactagctagtaactgttcttgacatgccccggaatttctataattccaatgtgagcccttgtgatttcactcaactttctttttgaggaaacactcaatttctaatctattactaaattatattttgattactcatatgccctgagtttttttattttaatctgatattagttgaacatgagttgactgctttttttctctctcaagcctttgacttttaacattaaggacctctagataaagggaatgtatacataagcttaggtgcacacacactaaagacaccaactaataaatatcataagaaattctataaaaaatttacacttacttataataatattatacataagtgcacgtttcatctttaaattcatcaaataataataagttcatccaaaaccacaatttgtttttgcataataacaaatatataacttcgaaactatatagatgtatgctatatttactccaatgagaagtctagctgtgcaagggagtaaaatgtcattcattatgtcagattttaaactttcataaactcgaactatataaactagtttgtcattaaattattgataaatatcattgcctcctatccaagccacttaagttcnnnnnnnnnnnnnnnnnnnnnnnnnnnnnnnnnnnnnnnnnnnnnnnnnnnnnnnnnnnnnnnnnnnn

SEQ ID NO: 32286 - DNA, 2511 bp, Oryza sativa
gttatagtcttatagatctagagttttcattttttgtgtgcgctgctctgtgcattttcggaagttccgaaaatcatttcggaatttccaaaaattcctagcctagctccgaaaattactgcttccgcatttcttaagttttaaattagcctattcacccccctctaggcctaattgaccctttcaattggtatcagagcctaatctcctaattaggcttaactgcttggagagatcttgtcaggccaagcgggggatgggaacgatggtgataagggagctaagatcccttatgactatccctctacatctacatcttttgtgagtacctatagcggcaaagctccgtacttcaatggtacggactatgccgcttggaaacataagatgaagatgcatttgaagtctattaacccatctatttggagaatagtcgaaaaaggctatgttttgcagaatcccgaagatcccaccaaggaggacgacgagaacgagcacaagaacgttcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggtaatttgagagatttgtgatgttggatggtgagagcccaagcgacatgtacgaccggttgagcaagatcgtcaatgagatcaagggacttggctccaaggacatgaccgatgaggttgtggtcaagaagatggttcgagcaatcactccaaggaactctaacttggtgaccatcattcgtgagcgtccggactacaagactctcacacctcacgatttgctcggacgcatctttgcccatgacatgctcgtacaagagtccaaggatgtcatccaatacatcaaccaaagctcaaccgcaagcatcaagaaggaagacttggctttgaaggcaaaggaagaagaagaagagaaccgcaagagcaagagcaaggcggagatcgatgatgaagagatggctctcttcgtcaagaaattcggcaagttcatgaggcgaagcggcttcttcaagggaggattttccagcactactccaacaagtcaagtggaagacactctgcaagagtgtgctacgtgtgcaaagagcccgggcacttcatcgcggattgcccccacctcaaggatggttcccccatcaaggaagataagaagaagagtgagaagaaggatgagaagaaggagaagcaccagcatagcaagagggaacattatggccaatctcaccttgggatgatctttggctccgactccgagtcaagctcaagtgatgaagaaggagtcgccacgttcgccgtcaagccttcatcaccaccgagactctttgactactcaagtgatgaggatgctccggtttgcctcatggcaaaggagcctaaggtaccttctcctcttaagtcatttaatgttgatcttgttagtgatgaggaggatgaggttgaggatgagattatggatgacgaattgttcaagtccataactaaggaatccctaccacacttgagtgagttgcttgggagaattgaggaccaatatgcaattcttgagaggcaagagactttgctcattcgtgagaaagagcggtctcatgaactcaagagtgagcttgttaaggagagagagaaaaatgaggcattggtacggctttacaagcaaaccaaagagtctcatgctaatcttgatgtggcgaacgctcaacttcaagagagagtggatggcttggacaaagcatacctcactcttgaagaaaagttcgaaaccttaaagaatagtgtctctctccctagcgagccatcttgttccaaaattgtcccaagcaatgaaccatgtgtgagatgcaaagatattgatattaacgcttgtgctactaactctattgccttgagtggtttgcaaaagcaaaatgagaagcttacgggactccttcacaatggcctacttaagtgctatatgggtagtaaggccctaaatgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcataggcgctcaactggggtataagccaggactccacctaagacttcttctccaaagcttctcttactgaagggggggaaaagattgagcaagagtgagtacaaccacagtactcagcaagccacaccggagatgcataattaatgcaagggagtacaaggggataataatataggggttaagttttgcagtaaacagcatttaaaagtcacttacttgcccaaagctattttgtaaacacgatc

SEQ ID NO: 32287 - DNA, 6886 bp, Oryza sativa
tcctgcagcccaagtccgaggcgacgacggcggcggaccggagctcggcggcgtcggcggagagagaggacgacggcgcgagctcgattccgacggggagagagagcggcgagtggcggaaacggaggagggaggcacggggaacgtttaaatagtgttgggagggggagagagcggccggatgaggggaatcggccgcggaagatccggccgccattgatgcgccggcgaaggttgcgggagcgtttccaaacgaatccgagggagagagagagggaaaagtggggggaaagagggagggaatcacggggagtgatttccccctctttattgcgcgcggggacggcgggaggcggcgggattcgcggcggctgcggcgctagggcacgggcgaggctgcgggagcggcgggaggatagggatgacaggtgggccccacccgtcagcgagggtggcgggcgggcccgcccgtcagcggcgcgcgcgcggggagaggccgagtgggccgcggggaggagagagagggaaagagatgggccgagccggcccaagagggggagggggggaaaagactttttagggtttttctttttataaaatcattttaactttgtttatttcttaataattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagagaatgatttttatttcgggatgaatttatcaggacgtgacactaaaggagtacctaggctatcaaagggacaacttcaaccatgagggtcttgggtatgttcctccaccaaaagggaaggtggacaagagtgtgatgatcaagaggccgcaaggtcttagcaattttgttaaggccaaaagtatccttcctaatgattatgcttgacattgttcttttgatgcatcttatattcttaggaagaatgctagtggtcgtgttgttgctaagtatgtaggcccaaggggcaagaatatttctatcaagagagtactttgggtgcctaaggcacttgttactaacatgagaggacccaaacaagtatgggtacctaaaactagaaattgatctcttgtaggaatatgtctccggtggaagaagttgggtgattgatagtggatgcaccaatcacatgaccggagaagaatcaatgttttcatctcttgatccaaatggcacttcacaagataacatagtgttcggggacgatggaaagggaaaggttatgggattgggtaagattgcaatctctaatgatctttccattgccaacgttctcttggtaaaatctctaaactacaatcttttgtccgtttctcaattatgttctatgggttacaattgtctttttaccgatgttgatgtgaccgtctataaaaggaatgattcctcggtagtctttaagggtgttctcaagggaaagctttaccttgtggatttttcctcaagtaaagccaaacatgagacatgcttagtggctaagtccaacacggggtggctttggcatcggaggctagcccatgttggtatgaggaatcttcacaagcttctaaagcacgattacatccttggactaacaaatgttcaatttgagaaagatagggtgtgtagcgcgtgtcaagccggcaaacaaattggagcacatcatcccgtcaagaatgtgatgaccactacaaaaccattggagcttctccagatggacctcttcgggccaattgcttatctaagcattggaggtaacaaatatggtcttgttattgttgatgacttttcacgcttcacgtaggtgttctttttgcatgacaagagtgagacacaagccatcttcaagaagtttgcaagaagagcacaaaacgagttcgacctcaagatcaagaacattcgaagcgacaacggcaaggaattcaagaacacgtgcatcgagagtttccttgatgaagaaggcatcaagcatgagttctcagctccatattcacctcaacaaaatggagtagccgagaggaagaataggactgtcattgagatggcgaggaccatgttagatgagtacaagacatcggaccgtttttgggccgaagccgtcaacaccgcatgccacgccatcaaccgcctttatcttcaccgccttcttaagaagactccctatgagcttcttaccggtaacaaaccaaatgtctcttactttcgtgttttcggtagtaagtgttacattcttaataagaaggctagatcctctaagttcgctcctaaagtggatgagggattcttgcttgggtatgggtcaaatgaatgcgcataccgcgtcttcaacaaaacctccggtattgttgagatcgcgcgtgatgtgacatttgacgaaactaatggctctcaagtagagcaagttgactcacatgtgttaggtgaagaggaggacccgagtgaagcaatcaaaaggttggctcttggggacatacgccctagggagccacaacaaggagcctcttcctcaacataagtggagccacctacatcaactcaagccgacgatccctctacctcaagcttggatcaaggtgaagaaggcgagcaagtaccaccctcaccgatcaatttagctcgcccagaatccaccaaagtatccaaagagatcatcccaccgacaacttaggagacatcaacaagggagtatccactcattctcgtattgcaaatttttgcgagcattactcgtttgtgtcttctcttgaacctctaagggtggaagaagctcttaatgatccggattgggtgatggcgatgcaagaggagttgaacaatttcacccggaatgaagtgtggactttggtggagcgacctcggcaaaatatgattggcacaaagtggatcttccgcaacaagcaagacgaggccggggtcgtaataaggaacaaggccgaggttagtggcgcaagggttcacccaaatcgaaggattagattttggtgaaacttttgcgccggtagctagacttgagtcaattcgcatattgcttgcttttgctactaacctcaattttaagctatatcaaatggatgtcaaaagcgcctttctcaacgggcctatcaacgagttggtatacgtggagcaaccaccgggcttcgaggatccaaaatttcccaaccacgtgtacaagctccataaggcactatatgggcttaagcaagcccctagagcttggtatgagtgtcttcgcaattttcttgtgaaaaacggctttgagatcgggaaagcgattcaactctttttactaaaaggcataataatgatatttttgtgtgccaaatatatgtcgatgacattatatttggttctactaacaagtcttttagtgaagagtttagtaggatgatgaccaagcgttttgagatgtccatgatgggtgaatttaagttctcctccggtcttcaaatcaaccaactcaaggaaggaactttcatttgccaaccaaagtatttgaaggacatgctcaagaagtttgaaatggagaatgcgaagccaatccacactcccatgccatcaaatggccacctcgacctcaacgagcaaggtaaagacgtcgaccaaaaggtataccgttccatcattggctcactcctttatctttgtgcatctaggcccgatattatgcttagtgtgtgcatgtgtgcaagatttcaagccgctccgaaggagtgtcaccttgtggccgtgaagagaattcttagtatttagtgcacactcctaaccttggtctttggtatcctaagggaacgaggtttgatctcattggctatgccgatgcggattatgccgggtgcaaagtgaataggaaaagcacatcgggtacttgccaattcttgggtaggtcccttgtttcttgtcttccaagaagcaaaactccgtcgccctatccaccgccgaagcggaatatgtttcggcggggaattgttgtgctcaacttctttggatgaagcaaaccttgagagactatggcctcaatgtatccaaaatcccactcctatgtgacaatgagagcgccattaagatagccaacaaccccgttcaacactcccgaaccaaacatatcgatattcgccaccatttcttgagagatcattccacaagaggcgacatagacatccaacatgtgagaaccgacaaacaattggtagatatctttaccaagcctctagatgaagctaggttttgtgagttgaggagtgaactaaatattttggattctcggaatgtggcttgatctattgcatgcatgtttgcttggtagaatatgtttgcataccactttgtgacaaaatgatcattcaattcatggatggacactagtcacttttgtggagaacttgaatctatgtgtatggggatctcatttttcaatgaattttggtcctagcacaatttgcaatagattcgcacattccctccttcgagggtgaatcatcttgtctcatggtaattcactctcttttgatctttggatcatccatttgtcttgtggctattgttttgtgtggttgattgcgtgctagccataagctcaaatggggcctaaatgttcgaccattcttttcactccttcttctatccaaagatttgcaaattgctttcatcaaaattcccagtgcgaattctcttgaaaaatgcatttcaaaatgtttgcaaaattgtttttcatcaaaattccggcgcgaatcctttcagaaaggggtttttgttagctttccaggttttttcggagttattccgaaaattatcggataattccgaaaattttcagaaccattgcgtcgcttctgtatattttcggaacttccgaaaatttccagaacagtcaaaatgtttctataaattttcggatctatccgaaaattttcgggacttccgaaaattcttggaggatacttaaacccccgaccgtggacctcttttctttctctcctctttcttctccacggtttcctctttttctccctcccctctccggcgacccaatcctctccggtgattcctcggcgattccccggcactcccctccactccaaccttgtgggagcaaggttgggagtcttcttggcggctacattgttgatcttccccgagttcttcacgttcttcgtgttcttgaggtatccaacttaaaatcgaatccctcgattcctcgagtttaatcttgcgatttccttcggtggagttgttaccctagtgccatagaccctgtagattcaatttcacaagtttttgttggtggatttgtgcaggatctaagttgtagtgctcgggctgaaattttcggaagttccgaaaattttcggaattattttcggaagttccgaaaattcctggctgagccctccaaccttggtttcgcatgattcttgcctccaatcacttgtaaatcttctctttggcttccttatactcattgttactcttgtcttgattgaaggatgcctcattgcaagcaaacttctcgcaagtccaagcgctctagggatcggtctcccactccttccccatcctctcatgaggactcggaccgtgattggtccgggcgagaagaagaggagaccggccctcaggtggccaatgttccccggggctcctctctcccacctcggcgctccactcatggggatgaagggtcctcgcggcagcctcgtgcttcctctggcgagggctcttctcgccaagctcacaccactgcgcctcctccggcgaggcttattggccccctcatgcttcatgctccctcacgccatcctcgccgagctgttcgtgactggcgccaaaagtctgacattgtggctgtggagcggaatcaggatcctcgctccatgccgcgcaccgcctctgatgacaggttctggacctctttccagcaagactacaatgcccatgcaatggatcgattgggaggctttggcgaccttggatgatcctgacctcaatgccgtcattggtgcttgtgagatgggggttcgcaatttcatgacccttcagcaagcttggtgcaaggagatcattgctcaattctatgccacagcctattttaatggtgatcgtgacattcattggatgactcagggctcgtggtattctatctcttatgaccagcttgccaatctgtggggttttaatgagaactggatgcggtacatgacccacttgcataacattgtgattcctcacaatcatgatttgcgccctctgtatcttcctggtggcaagttggggactactgaagggctgaagccttatcatatctatcaaaaccgcatccttaggcggaccttgactccaaaggatggtgatgctagcaacatcaaccatttctcccgctccatgctcctcaggttcaatcccccctgtcgtccctttcatgtctttctatttgtttggtaggaaatccgcatggcttctcttcagtataagagagggcttccctatgctcctcatataatgcggatgattgaacatgtcactcaccttcagtttgtgtgcgaggagccacataccgctctttccttgcgcttgcctaagcgcgggcctgtgcctcaggacatcccctccacatcctctcagtcgccttttgctcctgagtgtccttcctctgtggctcgtcgtgagccgtctcccttatttcgcattttgcggactctttttggcctttgctctacggaggctaaaaagaaccgccgattgcggaatttggcgaagaaaacggctcgtgatgtcaagtacctcaaggggctgcagga

SEQ ID NO: 32288 - DNA, 1141 bp, Oryza sativa
cccctccgggtttcgaggctgaacccgatgagcccgaggaggaagagatagaggatccatttgttggggtgcctcctgattatgatttctttggttatggccatggctatggctatccccctccgcctcctccagaggatcctcctcaggcgccccttgcttgagtctgtgtctcttcgtcctctctttttggtgtcttgatgccaaagggggagactatctatcatctctatccttatgttggtcgaacattagtggctttttatttgtatgagacttgtgtgtttcttaagttagtttaatgctttgtaagactttattgtttaattatagatgatgggatgtaatggatattatggtgccttatgtttaatgtgatgtcatgtctcttttattctatattgtggttgtgatgagatgatgatgtatttgttgcaatggtctattctctccatgttgtgttggtgttgagatgaaatgattactttgtttaaatgcgattctgatatgatgaattgatccttcatgcatatattgtgatgatacttgttgttttgtgagcttcaatgtggatgcaaagatttagggggagctctccacttgcttttatgcacactcttagggggagctttcactaaacctttgcaccaaaatcatctaatattattattctctcttgtgatttaatcgaattgtcatcaatcaccaaaaagggggagattgaaagtgcatctaggcccctaatgattttgatgattgattacaatgcgattagagaggactaacatttttattcaagcaaatgtgaatgttgttaagtcctcaacatgttgtaatacaatgcatatcccgtgaatgcgacatcgcgatgcaatgcggcaatgatcaaatggtatattgtatctttttcctcgcattgtgtcgtaggaaagccgtactattaagggggatgatgtatagacatataaggagtgatgtgtgtgctcaaaatcaatttttcttcgaagcatttctcttttggagtgttctggaaattttcggaagttccgaaaatagttttcggaagttccgaaaatacacagaatcgtgtttgagtgttctggaaatttttggaagttccgaaaagaaaatttccaaaata

SEQ ID NO: 32289 - DNA, 587 bp, Oryza sativa
tcgtgcatgtcgaaagtcatctaaaggtgacttctcaaaatttgccttgggctcctgggtctcagacttgatcttaagttcttgttctcagtcaataagatctgaaatatgcactctcataagcttgttatgcccatcaaactcatccagacagtttcaactattgaacttgcttatgtcgttactccctagaacactgtcagctggtgaaagtgccgcagagtactttgagttacttgggacaatgattgatacagaagcttcacgtcttttcttaactgttcgtggttgtttgaccacattatgttctttgataacaaaagaagtgtccaatgttgaatcacaggagagaagccttagcattgacatttcacaaggattcattcttcacaagcttgttgagcttctcaacaaatttcttgaaattcccaatattagagcaaggtaactcttaatataccctgcatgtccaaccctaatttcttggtttgtggaacatccgctcccatgcagttctttctcattgtatctttaatttcccatatgtcgcagatttatgagtgataatttattatctgatgtgctgg

SEQ ID NO: 32290 - DNA, 446 bp, Oryza sativa
accatgctatatacaagcctgaatgtattctccaacaacaatttgtagtagtccatgaaaagatcagtgggatgggacttggcatatgaatctgagaaaaagggagagaagtttcccgctggtaactctctccgtactgtcaatagggatccacagcctgaactagaagagccaccttcaccatttatggatgatgacttgaaaacatgaacaagttgttgcagtatatccatcaaatagttcagaaaggattgctgcctgagggcagaacaagcagaattaactgggaagcaaactcatttttatcatggtcatcattggaggattgaagagtcgtggttgatacttggacatgaacaggacctttttctgtcaaatcagagctcccacctgacttcgaatgagaagccatcagtcccaggctgatgccagttacggaacataag

SEQ ID NO: 32291 - DNA, 1024 bp, Oryza sativa
tagttaaagatacaataaaattaaatccttacttaggggtcaagttgtaccatctatataaggatgggattttatctatccttagggatcaagttgtaccaaggatgggattttatctatccttataaggatgggatttatctatccttacttaggggtcaagttgtaccatctatcaattaagcaatgaatatcaattagtctaatctctcccccccaataatgttcttctccctagcctaaatctacatcccttctccaggagccgacgccgcccggctatcttcccggcggtgtttatcccgtcatggcctctggtcatgacaatggactacaaaaatacccacccacagataaatttcatcgagatcaatatcatagctctgagtttggtgttagcgaccaattttatttggacccaaccaccaaccatatatctacaggactgtactacagacatacaattagattgaaatttacaattatcaacacaatagtttagacttcttgctacagttcagtacataagtcaaatgattctcatacaatatggaaaaagtttgaaatattcaatgtgcattgttttattaggcaggcatctcctttacagaaggatgagatacattgcaggcaatgcatcaatagaagctgtcttaactaataagccataaattcacatcagtgcttacatgacaatatccatatggcgaggagcatagtgaccacctcctataccaagtagaactttttcactattactgcatcgcaagaaataaggcttagtgcttaaaacggaaacaagaataaggaaaggatacttacttagaaggaaaacaaacatcaccatatcagatactccctccatcccaaacacaagtttatttctaggctctaccatttatcccaaagtaaattcatttctatcaccttatccacccttggtcaccacaaaatgaggagttttatcctttcaataccccttaccttcccacccaccaattctattttcctattaatgagggca

SEQ ID NO: 32292 - DNA, 20261 bp, Oryza sativa
ttggatggccatggcgactgaccttagcagtagcccagagctgctgctacaacgacagtatctaatctactaatagcaatgatctgcaaccggagtattcagaaataaaacaaattaaggtgcagcaatacataaaaccggtatatgcatatatatgatctttagagtcgtcatataataccatgatcatgaattggctcctttaacaaattgtacatactaaataaatttcaatgttgttgaatagggacagtataaatctgaagaagaaacaaatccaaataaatgtcagtcgtgttgaatagggacggtagaaatctgaagtgacaaatccaaataaatttcaatcctattgaatagggacagtacaaatctgaagaagagacaaatccaaataaatattgggacagtggaaatctgaagaagagccgaaaccaaatcaatactcgtatgtccttaatccattgataatctggtatataacatgaacaaatcaatcgagtgcgattcaaaggagaaatgtaagccaataaattgaatgaacatatatggttatggttcaagaaaaggaggaagaagcatacctttggtagatgaatatatacccctgaggtttcttgaaggtgaggaggcggctgaagctttaaaggcagggaaaacgaatggaacgatggtttccggtgtgaaatagtatgcagtaggaagtgaatcgggcagcgtgtgaggattcgaccgaacaggatgtggaggatgatagtttcttgaagttgaggagacaacaactatcttgatgacagctataaagtttgagcgatcgaaccacgacaggtgagcggtggtttccatttggaggtgagcagtccaagagctggcggggaaccacgacgctacgcaggatctggaaggtgaggcgccggcgccgcactcgcagtttctagcggcgcagggagacgtgaccgctcgaactcaagagggtaacgggaatggtggtgtggatggagtgtgggaagatgcggtggaaattgggccaaggagtgtggactgggcttgatggtgtgtaaagttgggcttgttggccagcaaaagaaaacagagggactgcacattaaccattgatatttgatccaatggattgccaacagattgaccgggagaagcgcttgatcgagatccaatggctaggagaaaacggggtgacgtggaagcatgaggatgcagagaattgctagtagtggggatgattgtataggtatataggattcactattttttttgtaacatttgaccactcgtcttattcaaaaaatttgtgcaaatataaaaaacgaaaagtcgtgcttaaagtactttggataataaagtaagtcacaaataaaataaataataattccaaatttttttaaataagacgaatggtcaaacagtgcaagtaaaatgtcaaaattccttatattaggggacggagggagtaaatgtgtatataattttgctagctgactcttccctgctcaagaaggttacacgtatctaaggcaaactatctaagtttacacaagtacacaactacaagtggaacatgattaaattaaaagtttcaaatttacatgaatgatcaaatgattactaatgcttaatattagttatctgtgaaatcacaaattctttttgattatgaaatgcccattgcaatagttgcaactatcccccaaaaaagtcctagcatgtgtttaggcattgatgattgacatttgggaggcaaagagcacaaaacaaatgtacagcatgaaacacctgagtaagctaatggcgcagatgtttctgaaactataaaagacatgtaaagggcaatgacaaaaaccagtttgtaggaagctttacaaaacaccctaccatacatgctaatacagagaatataagcatggaagtagatctatacctatctcaacaaacatcgttggtgtattggtgactggtccatggtgagtagcttccagtgtaatcttcacaagcaataagaattagaattttaaaagcagaaagttcagaagaaaaaaaaaatcatcaacagaaaaggtacctcaaactctggaacaagaccttggtctaccgcaatcttttgcatcaaacggagccatggaccaattcgaggattgggcagagctgcccatcctggtctccctccttgaggtggcgtctcatcttctcttagatgtggcacaccttaaggtgcgacacaccaaagaaaaatgacaccatgtttaatataaaataattgaatacatgtggtactatgaagtatgaaccattaatttacacaaataagcatatgtattgcactcaaaaaagtacagatgcattatttgtaaacaaacaaataacaaaatacaagttcagtaccttttcaggtttattaaccaccatttatgtcatatcttatttaggtattcaatataactcaaacacagaaaaatattaaacatttaacagagccagggataaacaagaaacatatagcactttatgactaaaaataaccaaccgattggatggacagtaagcgcaggacggttggagacagcagtgtgtttgctgaggaatatgacctcagaaacagcctctccagtggctgcctgccaccggttgtcaagatcatcctccgcaatgatgctgcgttcatgcttcaatagtcgaacgtccccgtttgtaaagctctccatcccctcctacaaaacatataccatcagagatttatatggaattgtcgcggcattctaacaaattaaagaactgcaaaatgccagaaacataacatctgatggatgttacaaaaaaaattgtaacaataatttttgaagctaaaacttaataaaacaaacagagtcactggaacataatagatatgtgttggtgtacatgatctgcattctgatcactcattgccttctatgttgcctgaagtagggaaaagcaatttacacgcagacaaaaccttggaaagttcagggacaccggattctgaccaactctttttcgacataccattatttatcactgatgatagaagaaacatagcactgttattctccatggttctgctatgcgtctttaggaacaggtttatcagctccatagtcacctaaatctggatttatttgttgattgaggcagatatattttcgcaaacatttgttctgatgaggctaattgatcaaattggtgacttaccttcttctgccatacacttaaattagcaagttctattattcaaaggtaagagacagattccccctaatattttatggaggcgtatagctgtaagtgcacgatatctgcttgcattattcatggataaaagctcgagtgtcatctttaaatatatcgacgttcttatatattatcatacatacaaatggtttaccttttccttgtcactaaaaagaacagtatagacgccactctccattttgctgtgactcatcatgtcatgtcaattttaatgtggcagcatgtggacggtaactatgtgacaaagtccagaggagcttgaaaagctaagggcaatatatatttttatactatcaatatccattcatgaattaatttgcaatgatgtaaaaacagattataacatccggaatcgtcctgcgatctgcgtagcaactagtatggacatgcaaatctctatctagtatctgtaattgcataaacccgcaccaaaagcgcatcctataacctgggcacctggccgcatatgcttgcaaagctcagaacagaagaacaattccagtcttcagaaaagaaaacgcctgccgcatcgaacaagatacctgctccacaaccataaacactagccatagccatggcccaaaccctaattaaggagcagcgcttccccgtgctacactacaagtcttggggaatttgagattggggtggatgggactagataagatggggggcggtgggttgcttacggggatgggcgggccgggagaccagccgggcatggcgaggaaggcggcggctgggccgatagacgccgggtccgacgccgtcgccaccaccagcaccaccatctcctcttcctcctactccgactccgaccacgcctccctctcctctcctccaccagagcaccgctcgcgctcgtgctcggctgctgcttctcttgtccaggagaaaaatcgatagaatgccgctcctctacggtgggccgtgggcttgataagttgtgatttgtctagggcctatttcaacttcttttcttaccttatactccgtagaaaaagaaaagaacgaaaatattgaaactcaatgtataaaatggagttctatacaatttttcctttttttttatttttgacagtagacgtagtcacgtagcacaccacttatacatacagcaccatacttataccctaagcgtaatattcgtgggtactacgatttgaatcctggtgggtaaagttgtgaaccatcacaccactaaggctgtgaaccatcacatcactaaggctgcattcaatagggtaacattgtgagataatttgttttgttttccgtatgcacacttcccaaactattaaacagtgtgtgttttgcaaaaaaatttctatatgaaagttgctttaaaaaatcatattaatccattttttaagtttaaaatagtttatactcaattaatcatgcgctaatggctcacctcgttttatatatcttctcttttcctctcttctcaaactcaccctaatgctttcttcattctattcattttttttattttcaagatagggctatttttatgatattccatgtaaacttaccaaatatttcataaaacgggttttccgactagaaaaagcttgattgtttgctttgcggggaaaagtgttttggtttacatattacaccggattttaactttttatgataatctcttactaggaataatatttgtttaatttagtctcacccatcatgtgttagattcatttttttagtttgcgtaggctctctgcctaaagtttttggtcttgattggcaggatgcgcactttgcaactccatacaaaatgtaccatagcagcgtaaattttgaaatgaccaaatgctgaaaaaaaaaagctccgtgcaaatgctgccagtgagtagcatatatgttactgcaagtttgcaattaatccgctgtagacctctttcaggttagcatggaagagcataaaagcaaacaatgtagagctaaggctgtgtttagttcacaccacaattgaaaatttagttgaaattgaaacaatataacagaaaagttggaagtttgtgtgtgtagaaaagttttgatgtgatggaaaagttgaaaatttgaagaattattttgacggcctaaatatgcagcttcatattcgaagcaccatagccttatggtgtgttcggcaccccctcttcccaacccctctccctcttccatacgtacgcttttcaaaccgctaaacggtgcgttttttgcaaaatgtttctatatgaaagttgcttaaaaaaattaaattaatccatttttgaaaaaaatagctaatatttaattaattacgcgctaatgaaccgctctgttttccgtacggaacacagccttagagcatctccgattcaggcccaaaagttacttccttggattgggactattctaaaaaattttagacctaaaaatctatttcatctccacctaaaaatataatcccaaaaattagttggttgaccatataggattggatgggcccataattgttaccgacgctttgttttgcttttttttaacatatgcacggatcaaatcactcctgatcctgccactgcccttcctaacgccgccggctcctgctgccgtcagagaatccctcgccgaccacggttgactgatggaagatttcgcctctaatgtggaaaagcggaaggctagctaatcctctacacgaccatgacatcaatttgaaggttaatatcctaggcgatcctcatgttaggattttctctattaatcacgttctttttttttaatttgatctgataatatcgctaggggagaaagtttctgttggtgatgaataatggtttggcagttaatttgatctgtgatgaatcatacttactcttgtttcaagggcttgtgcatgaatcatcgtccgatgatgacgatgatttttttgggtcgcagcacaaatcatgcatagctattggtactctgtcaatacatcaaaacatggtgggtatgtcatgggacatgaagtggttgatcgcaacagagaaacatgacacttgaaattttaccaagattactttttcgataatcctacctatgacctagttttattcaagcacaggtttgtattgagccaattttatttgatttatctttgttatatgcatagatatgtatgtctcattagtaatgactacgcaggaatagaatgagcagacccctgtttctttgcataattaatgcaatagaggatcaagatgactattttgtgcagaagataaatgcaatcagtatacttgggttaagttgtcatcaagagatcactgcagcaatccgtcagtcagcttatggtatagcagcagatgctttggatgaatatgttggtcttgcagaaagtaccgctatagagaatctgagaaggtatgtgaaagcaattgttgaagtttttgaacatgagtacttaagatcatccaatgagaacgatacaactcgattacttgcacttggagagaatagaggtttccctagtatgttaggctcttgttaacggtgaaatttagtaagccccgaagtcatcataggcctagagtcagtatcggcttcagagtcatggaatcggccgataggaattatcaagtcgtcaatagtcggattcttggtagattcggttaacgaaattaatcaattaaaggaactttatccagaaaagactgagttgaaggaggatgcagcatgacagtttatctattaattagaaagtgtctgttagtttccttttatatttaagaaagtgtgtttagtatccgataaggattttatgttttcctttatctttaggaaagtttctttcttatccaacaaggactagtatctacccatgggtataaatatttacacccggggtcattgtcaattatctcacagatcaatgcaactactctcggcacattgccaccctctttcccgaggtttttacttatcacggcggaacttggcacctaacgtggggctgcatcggttttcgatctccgatgaaggggtaagtcctacgttcctccggccctggcaattgtatcggctacattagtgttgttcaaggctgcatcgcttcgatgtcttggatcactttggttcggttgacattttttcctacctatttatcacatatcttagttaatctagtttatcatcttaatttgatcatatcggctgagattcgttttagggtttatgctggtattgactaaattatcttactagattagattaactaaggtatcgatcaccctgaaaaatagtcaaaggcttgattgtttagactttatgcttctttgcatactttgcgatgcatcatccctagtcgtacttagaatcataaaagctaacatgtctttgattataataagggtttcatcagggtttcaaccgatgagttccagccgatcggctctttggtgatcttcaatttatatatcttgtcagttgcaggatcaaactgactgtcatgcctgcatctcatcaagatttggacctgcactggacctaagcagatcttccaggccattgtgttcgtcgacttagtttgtgccaccacaaatctgacaccatcgaccgagcgcggatttttcatcaatagctctgtagaccgtatgcattgaaagtgtaagaactgccctacggaatgctagggtatgtactaagggcacgtgcatgagcctataatgattctagagtcgttgcttcgaaagatctctggatttgacacgcttcacttttttttgtttgcacggatctcataacgatatcaatgtacttcatcgaatccccactatttgcattgcaatttggaggagatcacttcggaggtgttcagctcgtataggtgcagggctagcaccaagatataaaattttgatatttcattattttgttttagaacatgttgttatgtttattttctacttcagtttggtgtggaactatgtgatgttggtcgttgtacgtgtttaacgcagtggcagggttatctcaccaccagaaaaagggttttttatggctgtatcaaatttttttcgttggcggtcacatgagaaatcgacttgtaaaattctaacgaggggtggagggtttaggaccgccaacgaaaatccattttcgttggcggttgcttaagaagtccgcttgcaaaaataaccctttttttaaccggcgtgcctcttaactagatttttgctggcgggtactaaaagcaccgcccttgaaaaaatccacgcacattgaaaaatcattgcccattacaaaaatcaccacccaccactccttatccacaccgctccaaattacaaaaatctcctctggttcctccaccagcatccatagtacaaaaaaaccggaccggctcggcggttgaaccggaaaaaaccagaaccagagggctaggcggctcggtttgctgtaaagaccgcccctgcatttgaaccggaataaaccgcctgaaccgccagttttcatgtgaaccggtgaaccagagcgagccgagccggccggtttgtcatgccaagagaggatgggccttgatgggacagtctaggccttgtgcacgtgcatgtgtactactgaaaatagcaagaaaaagggatggaacgggggttcgaacgctggttggctgactgaaagccctatgcatccaccacccagctaactttcacaagtgataagaagagaatatgcatacaatataacacgtcgggttcaacattcgaaccgtgtgaaccggcggttgaaccgctggaccggtgacccaaggactcgagcgattcgatcgccggttcggttttttcaactatgccagcatcctctcctcctcccccttcagatccacccaccagcatcatctcctcctccctccccataggcagcggcagtggctctaacggcggttcttgggcgatggcggtggctccgacagcgatgcgcaacggtgacggtgataggaggcgggcgcttcttcttctcctcctccccctccctctcccacgatctcactgccaccacctcctcggcggcggctgggcttcctagatccggtggctccaccgccagatttgacggtgacagttgtggggcttggtgaggcgagaggagctcagcggcagtgaggtccgatgaggcgggaaaagctcagtgacggtggggcttcccacatacggtggcttcctcatctgatccaacggtgaaaagcatcaactgctgctcggtcggtgacggtgacgacgacccccttcctttctcccggccagattggtggtggaggcagattcggtggcgatgcttctagctgttgttgttgttcttttttttcatgttcttttgtttgttcaaaatgcttgtatgcgtgttcacttgcatgctaattgcatctaatgaactctctggatgaggatttgaatcgtagcctgaaaacttggatgcgaaaatctgagttattttctcttttctttgcgaaaatatattttggggatttattttttttcatggaaaatcattttcgctggcggtttgcttaatcttgccgactgtagaagtcgattttcgttggcagtccacttaaccatgccgccagcgaaaatctatttttgctggcagatgaagcccgcttgtgaagatagcctattttctctggcctttgatcgcatgcgattagcttagacgccagcaattgatgcagcaacggggggttcccgatctttcgatgagaggaggataaactttgatttgggggaggacacgacgttggcggtccgactacaactaccacaggggtgctgcgccttagcaaccggtacaccgactccacgttgttgttgttcttgccgtgccaagaataaccttgaacctgtaagcaatcgaagaacaagcaagaacaagttgacaaggaaacagcttacggcacttgtcaaatgatgaaactgaaacaaaccaaaatggggttctgaatacaagtatccgggtggtctagccgacacacgcgagtacaagaaagtagctgcagctaaacttacatccaaacaaaacccaaagtgcaaaatggtggctgctaggagtttatataggtgaaggaatgaccaggagaggaggtgggagcaaacccttggttttgtggacccctaatgggctgtaaagatacaaggcccaagcccaagtttctgatgtgaagaactattttcgtcattctgagcagcctgggtcaaatttgatggtgaggctacacatagctgaaagtagacgacgagatctttccaacaagtactcatttgccccgtttgccctccggagtgaagagcattgacttcatcaaatcagcgctgctagtgctgctttcgatctggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgcaataggcatggttgtatcgttggaagggatgtcctcatcaggtggtggaggcagattcggtggcgatgcttctagctgttgttgttctttttttccatgttcatctgtttgttcaaaatgcttgtatgtgtgttcacttgcatgttaattgaatctaatgaactctctgaatgaggatttgaatcatagcctgaaaacttggatgcgaaaatctgagttattttctcttttttttgcgaaaatatattttggggatttatttttttcatggaaaatcattttcgctggcggtttgcttaatcttgccgactgtagaagtcgattttcgttggcagtccacttaaccatgccgccagcgaaaatctatttttgcttgcagatgaatcccgcttgtgaagatagcctattttctctggcctttgatcgcatgcgattagcttagccgccagcaaagatggattttagccgccagaaaaagcaatttttttagtagaccctattatcttctttatggattaaatccattttgcatcgattgaatatacaaccgcttattacaaaggccttagttaaaagtcaaggataaacgtatttaacaaagatgacgcattaaaagccacaaaaaatgaggaagaaatttgtatggttgttggtcgtcttcacacctttgttgttagacccaaaaccccaagctaacatgttagcttgaatagtacatgcatgtaactatagttggagatttatactatgtcatttctacaactaaattattttaagaaaaactttttggctttagtcatgcgtcctaaataactcaaagaagtaggcccggccttcccttcgaggacgaaatcttcagcatatacttaggaaaggcccttaatccttagcatatacatactcctactacaagaaagttaaagggcgaaatctagaaagaagatagattagttgccacggctaattattaatcaaatcaatcaacaaaaatacaaaaggttaaaggtgctaaatccagcttgtaaagcagggttgcggcgtcagctgtgcgaaaagaaaaggaaaaaaataggggacaaaagattcctctcctgccaatcaggcaatcaccccacctgtgttttgtattagctgctgcggagtaaggctgtgtttagttccacactaaaattagattttagaagtttaaaaaaaaaggtagaagttggtgtgacgctgtgtttagttccgaaatatttcttcaaactttcaacttttccatcacatcaaaacttttctacacgagcaccgctacggtgctctctacttatagtattctactacaagtagaagcaatctgaaccattaatttataaaggcaaattagtattttactaatttacggttaagggtaatttttaacttttatttttttcttaatagtaggatcagttcgtctgtgtcaccgctccttttgttctcgcgtgcgcccgactccggcggcagtgcccactccggcatatgcgagctcctccgtggctccgtcaaacagataatactacaaagaactactgaacaaagctatatagtcaaatcgagcagcaagagcaaatgtgctgttataaactcaccatgattatctttaaaacctatttgattagtttctccacatgttgtgttttcagttcttaaataattaagccattaacatcgctaaatttgtccaaggatggtaccgaagtatttaagttcagagtggtcatttgctcagttcagagcgatgctcaaaacaccgtaatattgattggcttcgatggcgttgaaatcgttgaattgatctgacttcttgtcgtggttcagggcttcaggctcgctggttatatgtctccttctcgggtctggcgtggaacgcgtactgatctccagcatttgagccgctgggcaaggagtagcctcccgaggctgatcccccaccgtaatcccgcaacgatctcatggaagcacgccgccgatctgctcatcgcatctgctccgccacactcaccctaaacctagcacggcccaacgatgctcaagtgtttctaactgatatgcaaaattacgaattcaaccatcccgtccatatttttttggacaattataccctctaacgtttctactaccgctatttaagatagtagtataaatagatctgatccattagatataaaaagatcaacggttttaattaatttatactccgagtagaaagcaccggagtgggactctttctacacacataaaacttccaacttttctgtcacatcgttcaaatttcaaccaaactttcaattttggagtgaactaaacacagcctgagtaggaaaattttgatgtgatgaaaaagttagaagtttgaagaaaaaagttgagaactaaacaaggcctaagcttgcactgtccccgtgctgtcctatttctctccttcgattttgcacagcacacattgctgtccaaagcattgacttggatgtccagtggtcaatccttacgagtcccacgagtgatcaccggtaagttcttttacaaggaacattgaccaaatttaaacttggaacattggtcttttacaacagaagtttgcctggtccaaatttacaacaattctagatttcagttgaccgaaacctttttttttttggcaattgcttatttgaccccgttttgaactgtaactattaatttgaccatactttttaaagtttgcttatttgaccattcttttcaaaagtgaagcttccgtctgactctgattcgctaactccgttagggttagatttcttttttttttaaaaaaagaaaatatttctaatattactaatgcccaagatgccctccaaaccctatccaaacccaagactctctctctctatcgtgcggcggcggagatctgtgggggtggcggcggcgagggggcaacggctatgttggccgcgcgtcgagggagcagtagtggcggccgtgcgaggagggagggagcagcggctgcatcggcagcgtcggcgttggccaagcgcaaaggaccggtggcggccgcgtgaggagggaccgggggcggccgcacgcgggaggagggagcggctgccgcgctcaaagcgaagtgagggagcggcggcggctgccgggctcggagcagagggaaggagtggcagtggggctgttgccgcgcggaggggcgacagcgctggttgctgccgtggggggaagggagggagtaggggcagcagcggcggctgctactgtgcggaagggaggcgaaggcggcggcggcgtcggtgtgcgcagcagggagggtggcggaggccggcgcgcagcgaagggagggaggggagccaggcctagcggcgacggctggcaccgccggcacgcggaggaaggaaggaggcggcggcagaagaagagagaagagaggaggagaggagagcagagaactgacgggtgggccccacatgtaatagggtcaaatgagtaagggcaaaaaggacattttatactccagttaacaccgttagaagcccttaacagaatagggtcgtactgtatcttcaattttgaaaagaatggtcaaataagtaaagttgataaaagagggtcaaattggtagttagctttcaaaatagggtcaaatgcgcaaatgccttttttttgtcatctaaaattgtacaccactaagtctaaaatacaatgtgctacataacatataacttagttacttctattgttaattttattagtataaatggtattaatttatcttgggtaattttacatttaaattgtaaatgtctatatgttgtaaatttatttcatatctaggttagaacaactatttatttaacctttatctaataaataagtgattgcggagtgatgagagattagattttatcaagattttgaaaaatgaccaaaagttttctttcttcatacgtgcatgacatctgcgcatcatttattaataagaagaataatggtcgaaagtttttaactatgaaagatctacaatcccattactattttcttactctgatagttttaaacttatctagttacgacttacgagaacaaaatatacaaactttctataaatcattgtatgaggaacgtgaccatgcaagataagtcattacaatttagcactactagctaaacactgaatttggttaaccgtacatgttgcaaatcaagagttttacagatgggatcctctgcactgaaggagaaaacgcagaggtgctgcattagctcatgttctgatgcgttagatcttcatccaacggtgtaaaccagcgtgctacaataaaaaggaggtcgatagtaaaatcagacacggttggctacagtatatatctaatgcaaatcactatagcacaagactcgatcactgtgcaaatagtattctctagtattacagcagatgacctgcatccaagttttactacattggagatgaagggttgacagaagtcagtggtgaattgagaagaaaaattactagggtctacttgcataattatcgagtaattttatactcctaattaatatagggtaaatagttggaaatagatatcttacgcggtgtccatactatgttgtaaggccttgtttattttctaatttattttcccaaaaacgtcacatcgaatctttgaacacatgcacagagtattaaacatagataaaaagaaaaattacttgcacagtttacatggaaatcgcgagacgaatctttagagcctaattagtccatgattagtcataagtgctacagtaaaccacatgtgctaatgaatgattaattgggcttaataaatttgtctcgcggtttccaggcgagttatgaaattagttttttcatccgtgtctgaaaactttttccgacatccggtcaaacgtccgatgtgatatctaaaaaattttcttttcgcgaaacagtgcctaaatgtaataggttcctcactattagaagtttgaaaaacgttgagtaataaattgtgtaaaacacacttatattttacaaatcttctccaacgtttgaaccattttgtttaaaatttgcacatctagctgaagacttattatactcttttgagtagcatagttattttcagaattttaaaataaacaacattctaccatctccctctcaaaagagaatcacaattttatttgatactccatcatcaaatatagaaaaaaaagttgagcatccaatgaatgggacccagatatctcgcaagggctatagtgaaaaacacagaaaaatatcatcacaaccgacttacaaaatacgtactatatactatacagtatacagtctaacaggaaaaatcaagcaccgccttttctttagaattattaaagaagaaatcttaccgttgggaaaagaaataaagaaaatactttaaccccaaccccggtggaggcgacgaggctcttcgtcatcatcgtcgctcgcctttcttcctccccacgcccatctctcctctctctctttctctctcttctttctctctctagaacaaacacctggaggaggagtgtaagtaaaacccttgctccccgcgggcgatcgatccggacacgctgtctctctagggctccgccgccgatcggagatccccgtctccgcggtatggcggcggagatctcggcgctgctcgacctcctcctccatccgcccgccgccgcggcgggggaccgggacccgcccgcgcgccgcctccgcgggcccgcggcgcgggcggggctcgaggccctcgcgggggcgctcgccgcgggcccgccggccgacccggcccgcgcgcgcgccgtcctcgccgccgcgcgcgccgtagtctccgcggtcctctccgcctcaggtagagtgttcccacccccctccacccccgcgatcccgacctagctctggctggctcgctgctccctcccgttttggattctttggtcgttgccggtgagggttttggatttaggctctgatcttgcagctgtaaaagcttggtgctcatgagatgcgctcctgctggtactgccttgttggcttggttttgatgctgtttgtagaactttttcttaggaagcagggttcgcttggttttgagagttggtcctgtgaaatcacgaccagttgttcttgttgattacaacaaccgacctagttatctccccttttatcttttattattagtattagtatttggttttatgtgttttatatcttgtttggtgatcaactttgccaacttgaattgttgtatcccttcctctctttgcttggttgtatgctatctccggagattatctaatagggcatttgatcccctttgtttgatatattttcttgaggccctttgtttgatatatattttcttgatgcagcagcgctttcatgttttgtcaggaagcccaacaccgttcattttttgtgcattctctatccacttctttactcttctccaattgcctttctcgtgcctcattatagtcacacacattgtgaaattgtgttgcattagcacgagtactacaggtgctgcaaggtcacgaatgatcaccagtgtgtgcatcttgttaatatttatctacaatctatttactcgtataagttctataattgcgttttagatacttttggtatgcacatgcatgcattgtacatgtttgttttacttatttttctatgcctagtgatgcaacacattttgctatgcctagggatgcatgaaatccagttttcttatttgtagtaactagctttagactagctgagcttggttctgaattgcctgataagatgactagcaatcagtgggaattatctagagattggatatttttacttgtgatgttggtaattttactttccctgttccatgttcaaattaggattaaggtgtttgcatttgagaataaacttgccaacatcggaaactttttgccaataaaattggttattgctatgaccagcagattttttattgactttggttagtagttgtaatttttcttgacagctttaaggtttctgaacattcattacaaaatttgtcttttgatatattgcttccatgaatgcgcaaaaacaatcaattaccagtttccacttctgatccatccattccatttggtttcgaaaataatatgaaatgtgaagtcagcactgtagttgagttgagtgtaccaccatcctttattgaggggcgttacacttttgttttaggtatatctttgtctcttttaagcgtggatctatagttggtgccttagagtaaatacattgctgcttctgattctagtttacatcgttcttttctttttgtgctttatatttagcagaatgtctttctatccaaagctatgagtcacttatgcagatcatatggtattatggttcccattgaaagtactgtagcttcaagtcacttatgatgttagtactgaaaaaaatgcggcaataatccttttgtagtcattttctcattgactaaagcatttctcatatcccctgcatttcactgtctatgtgctttttattaaccgttaggaacaccttgaaagagtcaccatgacatgtctatcatgtcctcgataaacgaatgtctagcaacctgcaaggttttaatatcaccttctatgttacctttgcacgttttgttatcagtggagcaagtggagtcaacggttgtggagattgtggagaggtctttggaattctgtctattgtatctcgaaaaatcatcatatgcatgtgaagactatgggttactggtaagttctttatgcttgatttattttttgggaaatgatcgtgttgacctaaaacagatcactttgttgttaccttttgcaatatgatgtaatatcaccatgctgatcatgttccttttacttcagtctgcatttttggggagtttcttaagttctctaacgtagcattattattatttttattatgtttttcatcttttcagaacgaggttgcctatttcatggaatgcgtgctgcttagagggactcccagcaaggtttactcgttggaacccagtgtcgtaaatgatgttattgagcagtggtcgtctgtccaagttgattctgagcgtatcagcccacaagagaagtatttctgctatttaaaaggtgaactcttggaaacttgtcctttaaaatgcaattcaaggtttatggaatgttggtgctttatttgctgattgttttttgatggcacaaccaggcttcaattgctcaaatagtggagatgatctgcaacggtttcgtttgacgttatcacctgaatgtttacagcaagattatgttattgcagagaatactgaatcatcacacacagcatccccaaacggcatggtgtcaatagcacagcattttgcagttgttcacctacattgcataccagtccttcttacattggttcagaagctttgccagtctccagctttggatgtgatagaagataccaactttaatatgaggttgtcttttggccaaagaattttgaagttagtacatggtttggctatggaatttccttgtgatgcttctgatgcgatgatgctttgttcagtagcaagatgtactgatagtctgccagtcttgtttaaacttaagttcaagttcgctaaccatgacagagtgttttctggagatggtgttggaactgtgttgctgcaaatacttgacgaatttctgcagctaattcatattatcttctgcaacagtgatatttgttgtacagtacaagtatgcatacttgcttccctgttggaaattttcagcccagaaaaatggaaatatgacagatctgctgcttgcttgatgccccctttagtttactcaccccacattgttcaatatgtgcttaaacttctcaatgataccaaacgttggacaagtcgtgttgacagggacagacctggcaaagatgttctaggttattcatgcaattccgagacagatggtttgtcttgccatgctcgttcaaagaaagtgccattgctgaagaaatacacatctgaggagtatctgcaattaatcttcccttcagaagagcaatggttggatgatttggtacatctcatctttttcctccatgaagagggagtaaaatcaatgcctctacttgagaagccgcagatgagttgcacaaagcaagttactctttcagagttggagtctgtggctagtcatgaggaagaagcactttttggtaatctatttgctgaagcccgctctacaggagtagctgacagtgttgaacagccaatttctctagggagtggcccttcgagcagccagcatggccctattcaattagctgctgatttgatatgctttatgaagatgtccatcttctcccctgaatggtgcactgctatatatgtggatgcttgcaggaagttccacagcaatcatttggaacagtttctgtcaatacttcaa

SEQ ID NO: 32293 - DNA, 1048 bp, Oryza sativa
tgtacatctttacccacaagaaacatcttccttacgtgtaaccacctgccacataccaccacggataacggacggaagacgtgacgtagttcccaacccatcctagccataaacaagagtaccgacccaatcccacctacggccggaaccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttataaccagtctgagctacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaaccacctaatgttgtcctattaaacagcgaagcatctacctaaattcatactagtggaaccatgaatagagtacccactagttggggttttgtttattctagggtgaacaaggtaataataacaatagcaataataatgtcataacaaaggtaaataggcatggctaaacaaaacagtgataacgcgggaatttaaataaagcggtaatgcattaatttaaatcaaaataattttataaactgagattcaatatgctcaaggatgatgtgacttgccttgctcgctttcccaaacgtcggcttcaacttccacgaagagcggatcttccgaagctgcagcgtttacacgaccaacggaaaagaaacggcttttactctactaaactccatataacaagcggaaactaagcacaaaaatgggttcttggctccttaatgaaaaattagagacttgaactgtccattttcgagttcaaatgg

SEQ ID NO: 32294 - DNA, 11517 bp, Oryza sativa
  unsure (1)..(11517): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcttttctagcaaagcataggcagatctcaaataacagtaacataaattataggcaaatttggccatgtgacaagatagtttgtactttgtagcatgtgctgtaggacactaaaatcattggcgcagctatggctatgccgcataattttgcaactatctgtggccactattatacatcttaccaaaacaggatagagaatctaaacaagaggtaaatttacccttgatttgagtgtttttctctacgttacctagaacagaccatgtgcgcctcatctttcctaactaaactactgtatggcctaaccagtgttcataacagtccgagacaattcaacagttcagttgacaatgaaagaagtcatacttttgatccgcaaatggatggatccagaactggtcaggcttaagtcatccatttggtctagcaaacaaattaaggtcaaaagtttctttcggtttatctctggtttaagtcacacatgcatattacgataattgccagcgtgtgttatccaaatagccacaaaactagagcgccccttggttgagccacaatttttttcttgaaagcacacgagagcattgcaccacattttattgtctcacaacaaaagatgcaaaatataggcacttttgcctaattcgaaactaatatataatttctccaataaacataagttgtccacaaagtaaattttaaagggttatgaaaccccacaaaatttatcatgcaaacaaaaaaccatcaatatgcggatcgcatataaaatcatggcatgagtgaatattttttttccagagtacaaataaaaatgaaagcataatttgcagatcctctaaggctcatgtattcacgaaacaatccaggtaagattttgaaggtggagaagattgcgaacttaaatatttattggaaacaagaagtcgaaagggtatttatgtagtttaatgtctaagaaaattataattgtcattcaccatagcagtagacttgtctaatatcataatgacttcaaatcgaaagttcccatgtcctacttttggatatatttaatcacctccaagcatattttagaagccatatcaacagaacatgaacaaaatgtgtacctgccgcataatgatgggattatccctgctatagttgacaacataattaagcaatttatccaaatcatcccgcactgctatgtatccatataattgtatgcagtcattgtcaataggaattttagccaactttagtgagaaaatttgcatcatggcacatgctgaatgcatactgcaagtttcccaactaggtcggcaatctgttggctccgagaacatcattggctccaaccgagcttcaccaaaagatatcaactcacaaattataacaatagacaatgcttattacaaagtgataattatgctttccctattatgtgctaagtaccgaattttgtgtggaaaatatttaaagggacattgaagttgaccaaattgtcttttgttagagcatgctaaacttccatattgccaataagtagatcgtttcccatgtctgcagcataggtcaagcataggttttttctgggactattctaataaaataacatgagttcttaagtaagtacgcagaattaagagaataataagtccggcaccaccaaatacactctctaggtctaatagccacattggttaggacaagaatatgtaggcttttcttattacactttatggctacttatacatatgtggtaatgctgggaacatttcatggccataaatatttaggcatgtgtgttatttgtgaaattttagaaaaacaatgcatgtttgcatatgagtacgtaggtagagctttctaacataatcatgtatatgtgttttatgattgagaacaactaattagctattacattttaattttatatttgtaaggtgttttgtcggatcagtataatttttggagagatatgaatgatgctttagtgctttatgctgcagtacagctaaggttttgaaaactggtattcacaaaaatattggtctcctaacctccaaaaatttaaacttttgattggtaaatttaagaattgaaattttaatttacattaatatcctgccgaccagtaactggtacctaaatgacccgtcttaggcagttacataatagatggtatgtttgaaccatagatatatacataatgagcagcaggatcggctagaattacaacaatatttggatttcacctaagtggattgattgcacatacgaatgaaaacaatagtaggaaagaagaaaatataaagaaatcatattgtagttagagtaacaaatttacttggcattttggttaccagaatccatattatatttattagtactaaaacaaatcatatcaaattagaaaaagaaggagaaggttttgatcacttactctcatcgcggttagtgatacagaaatgtccttcaaaggccttatttctatatatagaaccatcacggtgtcttgaattctcaatgattgtcatcgagaacatgtcaacagcggaatggctaacaacgagcccattaattccccctctcttctctgctcgatacatctcttcagtgacagctcagtggtcgccttgggcagtgttgtacaaagatgcattggcatgaggggggaagcatctgctccgaaatggcttgccccatttgttctcccctttccctccaatgctggttgttgttgatccatacgaaaacctagtaccaaggagcacaaatgactagtgtatgggtcaaataagatactaccatatatcatcatctgctatgtggggaattcccttggaacgtcgcaggaatgcgagagaccagtaagtgcgcatggtgcgccacagcggtgttctcgccatcatgtgttgctcgcattagataagaattatccttaatgtttgaggtttgtttcagttagttcctattcattagcagattgtaatcacctatagaaggccagttcgtgatggaataaatcaagaaaaaattaatctacaaacttccttcctttcttacaccacggctccggggagggcgaggcctccccgtcgagcaccgctacaaccttcgcagcagtaatctctttctactctacaaatgaagcctgctaaataaataattgtaaacctaaataagctgatgtatcagattgagaacttaatttcttcgaatatatatcaatttcaatttttcttccggttagatttaatgtggaattaagaaaactttgtccgaatttgattttaaacactctagattcatagttcgcccaatccagattcaaaagaaaaaaaatcagcagaacgagctacagaagtagggaaacggaagaactcaccgggaagcccgttgtagatgccgccatgagtggagcatctcgctgatagggatatatagagggggaagagaagccacagcacaaggcgaaggaagatcggagaggcccggcgtcggattagggtgagagcgtccacagagacagggactccgaggagctacggctctggatccgccgcgctggtcgacctggattggatggggcttctggttaggctgcgggaatcgctccagaatcaagagctagcgcgttcctgtaggccttttgggaagaaaattttgtgagacatagggtttgttcatttacgagtaaattgcattgatagtactgtttagagcatcatcaacagattatctataattttctcctaaaaatttatttttggtttcctaaactgaaaataagaagtgaaaaaactcctctcttcaagagatagcctaaattcaatcttcaaaacttaaaagtgggcccttacgttaaactaccaagagaaaattccgttttttttctttcacgcgcagaaagatcgctatctcccacgcgtgggaacgaaggagagaggcgggattgcgtgattgggagcgactttcgcgcccgcatataaacggagcgaggaaccgggggaagggaactccaaaactcgggtagaagcgtaggagatctgttggagctgacttttggactaaaatctctcaaaattagttttgggaatcatataggtagactgttggtgatgctcggtgtaacttactgtataaacttgtgaaatgatagttttgatacatgaatttatctagttcgtgcgaacaaggaccaaaatagcttgacaatgttaattttatgaactgatattgattaggatgtgacgtgcatacgtgtagcgagtatactaagatatgtaatatttataaatttggtctctactttaattatcctttatcatggaagtgatgaattttatatatttctaacccttatatcattgctcggtttttttatctttttctacgaacactatatccattctatttttattcctagtttgcgtgcgtgcgttcatacaggtgagtgtacgtgcgttgtaagtgtttgtgtcgtactagtaattttaaaaaaatatatattttatctaaataaaaatgattcatacaattaatattatcagcaaaaccagatcaatagatttgtcaagctataaataaatgaatagtaaattgcatcgctggtacacgaggtgcaatctagttgacgaatttgtaaaatgctcgttttggtgcatgaacttatctggtgcgtgtggaggaaggaaaaaggacaccacatggctaatcttattaatgtaggggcttattaggatactatataaacatatatctaagaaggtttgctattagacatacacgggtccagatatccttagatacccggcctgatgggcacgggcatgggtgtaatttttttcccgtgagcatgcccgtccgagactcgagaacatagcgggagtagccgggtattgttttttgccagcagataatccatgcccgacccgatacatatgtatttgctaattttggtccatctcttattcctcatactataacatcccgggttttagctgtagtcctggtcacgctaatgacttggtcacactagttgagagcggtgtcgatggagccacgatgctggctaggacctataaatatgttgattgttgttctattatggatcaaataattttttgatcgtttccttgtcatttatttatcaagtcgtccatatccatatggatcattgatttatttatagttagagtaaacctggtgaggagtgggataatttagttttgtagcgtagattagttgtcacgaggtacacatgtgcacagtagaaatcacaattctttatttacaatttaccacgacaggtctgcatacatatatgcatataattgtacaatagaaatcttatacagcatgcatcacatatattgtgcatatacatggtgcttatagattatcataaactgaatcatctcagtcaaagattcaataattatttatttttcagaaaaactcttaagctctagggcaattgcatatcagtccctaaatttgtagtaatttacaattttaccatacttgagggattcaagtgcaaaagatcaaacacatcagactaccaattctccaataattagggaaattaacaaataggtctggttattccaccgaacaagctgtttacacctaaatttgatacctaggattaaaatagaaaatattaccaaaatttgaaagtctaccggtttcctccgaagtgggccggtctaaccgctgtgtgttgggcggtcagaccgccggttgagggccggtcagaccggcggtgtgtggccggtctgaccggcaggtccgagtccgactctgtttcgtcgggtctcgaagtttccttgctcgggaaggcatgtttcgggtttcctttggtttctaccccgagttggacgtggaggagggcctgtagagggcaagaccaacccctatataagggacatggccggttcattgtaaaaatcaatctactatcaatcaatcgaatcgtttttcatattgcttttagtttttctcttagtttgtccatctttacaaaacccatctaggtttagctctttgctagatcgaggtggttggcgactctaggatcaccgcaaggcttaaagtgctgcgatcgtgcttgtcaacttgtcaaaaaagttgccaacacaagccatgttgaggtgtcacaggtacagaatgggaatagccatgcaagcaggtgaatcaccagtacaagatccaccagggataaaataatttgtgtgaatcatttccaacccaagtctcgttttggtcgtgcaaaacaacacaagcagcagctgcggcagtagtagttacaaccatagaaccaagctataggaaaatcagctagagtgttagctccacccagagagaaatagctcaactgaagtccagctcaaaccaatacatgaaccaacagtagtagtaaccatggccaagcaatcagagagcggtgaaccaaatctaaaggaaaagtagaggtgttcagttcttggatgaactccaactataggaggagatgaaacttaggtcaagaagcaagatggagcgaaaaatcaagcaagaggatcagtctcaagaggaggaagagaatcaccagtagcagatcaagaaagatgtcaggaagtagtcaagcattaccagtagggtaagagccaaggaggagaattacctgagttccaagtagagtagggggttcagttcaagaaggggaacaatcaaccaagctcaaggtggagaagctcagttctagcaaaatcaccttagatctaaaagagcagcagtagaagagaagacttggatttctgaaggaggagctgaaccacacatttttcaatcactgtagaatcatcagaggtaaccaaaaactaaaataggggaggagagtagatcctgcatttatagtaacagcatttgttagagctagagtttcatgcagatatataccatccatcctgacctaaaaccttagcaattctaaatgaataaaagtaacaaaagttgatgataaagttaaagataagttcatgtctttaaatcctgacatatataaattatcatagaagaaatctgaatagtaacaataagcgtctgtagctataattttttaataaaatcaactagtgttcatgacataaattatttaggaatagagcatatatagaagaaccaaatcatgcatgtaacttataagctttcagattctagtcatctaaacagggcataacattgacatgtgcatatttaattagaattagttataacctaaacaaatcagactctagttccaataatactttagagaaataagtagtttatattagtatccagtagaacatgtagcagcatgttcagtacaagaattattctgaatatatggtataataacagagtaggtatatttacttataacagggtagttagagtaaatgatatttagactagggcatgcatctattagctttcatcagtgtagttttgtacaaattttatcccacagtgaactgaaactgtttcaaaaatcaaccaatgtatttagttcttcatataagtaataccgaatctgcagaattaatatggatagcaagtgtaaacgtacatatttagtttaggtgcagatacatatgcaggaatctacgagtctttatcacaagtcctagaagaacatatatcagttttagaacgatggtaggtgatcaacataaccttgctaagaccaataccatagaacacaattaattacaagttacttaagtaatcagtacattttgatatcaaaatcaagattcataatttttttttgtcatttgatcactttagttatattactatgatgcatttggtatacaggaattcatattaattatctgaattactactcagcacaaggacataaggatctgattctctagtgcagtagcatgtaaaaaaaattcaatatcttgataaccattgcataagtatataaaaggatcaatcctgttattatgatattaatatctgtactaaaaaaaataaatacacatccttgattcatttgagcatgcatccatgtattcatccatggcatatagtcatcatccaactatagtaaatcaattgatttagaaccctagagccagcagtataatcctgagtataacactatctagttggtcattaggactagttcaagaataaaaattcacagcatgttaccacacagaagaacaccattcaaatcacattacagaagtaggtagagaaggggatcagagaggaggagcttggggagacacagctggtgcgagccatgcttcactcaagggcgctggggttggggaattcccaacctgggattttcggttggcgtcgtcgtcgttgggagcagcagccgacgacggcatcgatgggagaggagctaggactgcaaacattggggcttcgctgttttgacactccgagtggatgataaatgggtccatctgtgtctataaaaatgtgggtccagtgtcattatagcaaaagttaatgtttgcagtgtcataattgtaaatcccccccgatgaataaggttgggcatggatgaccaaggagagaagctgtatagagagatttggacggggaatcaggggaagagaggaaagaaggtgtttacccccaaatttggcaccaagggataaaatagggaaaattaccagtttggaagtctgccggtttttctctggttgggccggtttgaccgccatgtataggccggtcagaccggcagtgtgtggccggtctgaccggcagagtctgagtctgggactgtttcatcgggtctcgaggtttccttactcgggaaggcatgtttcgggtttcctttggattctatccctagttggacgtggaggagggcctgtagagggcaagaccaacccctatataagggacatggccggttcattctacaaacaatcaatcgaatcgtttttcatattgcttttagttttttgcttagtttgtccatctttgtcgatttgcgctgtaaatcgtccgccgccgctgcgaaagtgcgacacctctttttaagtttgtcctgaaaaccttccgtttttcccacgagatgggtagttatctatcgttctatttagaattggctctgcaagccggtttagttatcaaaacccatcttgatttagctttgactagattgaggtggttggcgactctactatcaccgcaaagctttaggtgctgtgatcatgtttgtcaacttgtcacaaaaagttgccaacacgattttttgtgactccactggggaaatctgctcaacgtcatctcagctttgacgtcgccataacaaagcctccatcaactaaggcggaggtggaaccatccaatgtcataccaatcacattgaaggagcttgatgagggagcactcaaggccatggaggaacatctcaaggcgtatacccaggaaatgttgatgaagacgtgcactaggacccgtcaaggtgtggttctcaagccgggatggttgcctaaacctaatttcgatgtggtaagtactgaagaggtatcaacttctatccaacaacaaatagcgagtacaatagattcatccattgctactttaaatactaaattagatgcatctattgaatctcgttttgatgattatataaggaacaaactcggttctgtcatagccgattttgtattcaaagataaagcctctaccagtactagcaagcctcctgtagatcaaatatatagtaaaaccgatggagcgaatatgcaaacaacctgcgaagggtgggctacgcacacagccgattcaaccgggccaacggctggtcagaccgggttttatcctggcggtcagaccagtctgaccgcgcctctggacgccggtcagactgggtcctagaccggtcagaccggcgcaattattcctatacagggggtagatccaatgacaaacaatgggtttttataccatattccagcacctaatccccccgtatctactgttagtccccaaattcccccacatatccctaatgcttacaacgatcctactaggggatgtcctcccgatactagatatagctaatataattatattgcgccgcaaacacaacctattagaccaccaaacccaccaccaaaccagcataggcttgagaatatagaggaattaattagtggtatcattagggataaattcgggattgaagctgggaatcctgctaaggtttaccaaaagcctcctcctgattactatgacaatatcctatatcctcatgggtatagagttcccaaatttaccaaatttagtggtgaggatagtaggaccacgtgggagcatgtaggtcaattcttagcgcaatgtggagaggctagtagttccgatactttttaattgcgcttgttttctttttctttgtccggtactgcttttacatggtttagttctttaccggtaaattctattcatacttggcctcaattagagcaaagattttatgattatttctataagggtgaaactgaacttaggctaagtgatttgacatcggttaggcaaaaatacaatgaatctgtcattgattatggtaagggatttagggatgttagaaaccgatgttatagcttgaatataactgatagagatttggctgatcttgcttttaatggtttaattgctcctattaaggaaagattagttggccaacaatttcttgatgttagtcaactcatggaaaaagctccggctcaggaaagccgaattaaagatagtaagaaatttgttagatcatatgttaatttgattgattaccctgaagctagtgattctaataatgagggtgatcatgatatgtatgttgccgagtggtcatgaactaataaaaataagccttttgtttgttctaatttaatgccgactccttgtaaagatcgacaaagtgagattaagtatagctttgatgtggccaaatgtgataagatttttgattatcttttacaagaaaaacaaattgattctcgttctcattctacaatgattgctatgtgtttcgacgataggttcaatcggccatagatgaagaacgattgaaattttccgatggttccaagatgaagcttgatcatgatgcttttccggcgaatacaattaatttcaatgataagaaggtgttgatttggccgaagcaagccgaatctactaaggggaaaggaatggtcagtga

SEQ ID NO: 32295 - DNA, 17060 bp, Oryza sativa
tgttcaatcatatgcctccaatgtaatacaaccaaggatggggaggaccaaggaggccagctcgtgagcgtttatcttcaccaaataatggttagttttatgctaaaaatcaggtcaatgaaggaaagagggaaggaaagcgcatcaaggtggagacaaggacttcagaagtgattactatcaaagtggggtctcatgatgtgctaataccttctggacatgaggttggagagtcttcaagcaacaaattcgaagccagaaccaactcatcgcagtcagccggtctgaccaacctcttaggccggtctgactgggccttcaggccggtctgaccgcctgtcgcaggccggtctgaccgggccttctggccggtctgaccgggcttcagcgccggtttgatgggagaatttcaaagggtagttcgggggtttcatcgtcttcgagtaaaatcaaaagtgggcattatttaccttctggaacagagccgaaactaaggtggatgcctaaggatttgacagctgctcaaaagaggaggttgcaacgtcttcaggcccaagaattaagagagagagagagaggccgaagagcaaagagatagaaggttcaatgagttgcgaccaccgcctacaaagatgtggaggcgtaagtccatagatattgaagaattggttgttgtgcaaaaggaggaggaagaacaatcggttgatgaatcatatccaaaggaagacatggatgtcaacatgatgtgtatgttgcctatggatttttgtgctatggatgaagccgaagttgctcaattttcactaggtcctaaagatgcggtttttgagaagcccgatgagtcaaactgtcatatgaagcctatttatctcaaaggtcatattgatgggaagccggtctctaggatgttggtggatggaggtgccgccgtgaatttgatgccgtactcgttgttcaagaagttggggcgtggagatgatgagctaaagaagaccaacggaggcgaaaaggtatcttttcggtggagcttatcgtgggaaacaagacgtccaaccgctttcttcatcgtctatgtgcaaggtaactacaatgttattttgggtcgttgttggatccatgccaattattgtgcgccttctaccttggatcaatgtttaattcaatgggacgacgatgatgttgagattgttcaagcggatacatcggccgaggttgcaatggccgatgcaacatttgagtggcgtcacggtaatattcaatgcttatcggggatggatctttctagctatgatttcattagtgtttctgatggcaaatttgtacctatttctgtaaagccggctaacatagcacgacaaggccatatcactttatgtaatgagtaaagaagctaatttagagtggttgcaaaaaagggtgcaagaatatcgatctacaaagaacgatattggtgaaactattgaagattttgacgaagtagaaaaggttggtcaagggtttacatcggccgatccattggaggaaatagacataggtgatggaactaagccaaggccgacttttgtaaacaaaaacatgacagccgattataaggttaaaataatcgagctacttaaggagtatgttgattgcttcgaatgagagtatcatgagatgccaggtcttagccgtggtcttgtcgaacatcagcttccaattaaaccgggttttaggccttataaacaagcaccttatcgtttcaatcctttgttatatgaccgggtcaaggaggagatttatcggttattgaaagcggggtttattaggccatgtcgttatgcggagtgggtatctagtatagtcccggtggagaagaaagggagtggtaagattagagtttgcatagactttagagatttaaataaagctactccaaaagatgaatatcctatgcctatagctgacataatgattaatgatacctcgggtcatcaggtgattagctttttggatggtaatgccggctacaatcaaatctttatggcgtaggaggatatgtacaagacggcttttaggtgcccgggatttgttggtttatttcagtgggtggttatgacttttggattaaagaacgcctgtgcaacatatcaaagggtaatgaatttgattttccatgattttctaggtatcatcttagaagtctatattgatgatattgttgtcaaatcggatggtatggagggacatatagccgatttgaagttagcttttgaaaggatgcgccggtatggtttgaacgtgaacctactcatgtgtgcttttggtatgtcggcagggaggatcttaaggtttatggtgcatgagagaggagttgagattgatcctaagaagatagaaaagattcgtgatttcaaagcgccgacatgcaagaaagaggtgcaaaagttactaggtaaggtgaattatttgaggagatttatatctaacctagctggtaaaatcgatgcttttgtccctatacttcgcttgaaaaaagaagccaattttacttgggggcaaaacaacaagaggcgtttgaggaattgaaaaggtatttgtctactccacccgtggtgcgggcgcctaaagccggaataccgtttcggttatatattgcctccgaagacaaagtcattggtgctgttttgacacaagaggaagatggtaaggaatatatcattacatatccgtcttttgggactcggattcggtgacatcgctatggcatggcacagtgtgacattggagcaatctggagcgttgaaatctgatcgaacggtccgctgcgccggcccacctgcagcctccattttcacccccaagcgctccgtttcctgccgcccaatgcccaatcccgcggctcgcccaaatcccacacgcgcgctccagtcctgccgtcccgcacgcgcccggtcctgcggaggtcccaatcccgcaccggagcagggctgccggcagagttccaatcccgcgaaggtcccaatcccgcttggagcagggttgccggcgccggggaagtgcagcacgccaaccagccgaggccggggccagagcgcctgccccgccgtcgccaccggataggtgggaggcaggcgtgcccctcgccgtgattggggaggtaggccggccgccgtgaggccgggggccgaggcccctgccctgccgccaagatttcggggaggagggctgccagagtgagccaagcatctgcagaggaggattgcaagtgagtgttgtcacatttgacacaacttttggcacaaacaaagaatataggccattcggtgtttttcttgggctcaatcagtttagagaaaccactatttttggtgctgcacttctatttgatgaaacagaagcatcatttacatggttgtttgagacttttctacctgcacataatggaaagcaacctaaaacaatttacacggatcaagatgcagcaataggaaaagccataaagatagtattcacagaatcatatcatggtctctgcacctttcacataatgcagaatgctgtgaagcatttatctccagtgaagggtaaagaggaagatgaaggtgaagaggaagacgaaggtgaagaggaatcgcatgttctctctgattttagtgcttgtatgtttggccatgaagatgaggcatcatttgaagaggcatttcagattatgagatccaaagttcataagcaaacatggttagatagcatttacaaggtgaaagagaaatgggctgaatgttatatgagagatgtcttaatgctatctgtgatgtctgaatgctccaagtttctatatggctgtttatcaacttctatatggctgtttatctctttctgtgttgtctcaatccatccaccaattatggggacatgctgtcaaatttttcagaaaataacatcacacaagttactgatttattcatccattgattcattcaaattacagcataggtcatacaaccaaaccaatctctcaattttcccaggtgttgctgctcacaaaaaaattacagaatcattctcccagcagcaatgacaacttccttatcaaccacaatggttaacacagtgcaacctcaacaaattattgtttcaggacaatgcacagcctaaggtaatcaggttcaggtacaccatgaagcagaaggacaaacagctaaactactgctgctgcaatcttggagatagagaacaaacacctaaacaacaattttggaaaacaaatagctaaacagcatgaaatcccatcgcctccatcggcaccccgacggccggctgcctccatcgccaaggatgacggtggcagggcagggccccggccctggcctcgcacggctgccgcctggtcccctccccacttgcggcggagcggcgccttgccggctcccatctagttcgcggcggcggccaaacgcgggcgagggaggcgaagcgacgacacggtcacccggtcccctccccactcgcggcggcacgacagcctggcgtctctccggcctggcgcggtggcgggctgacgtgggcacgggagacgaagtgacaaggcggctgccttgctctccgctggtcgccgtctgggacctctacgccggcagccctgctcccagctcgcgcggcggtggccgcctccctattcgcggcgacggcccggcgtccggtgcgggcgcgtgcggggcggcgggagtggagcgtgtggattgaggcgagccgcgggattggggcgtcgggcggcaggaacggagatcttgggttgaaaacggaggctgcaggtgggctggcgcagcggaccgttcgatcagatttcaacgctccagatttctccaatgtcacaccgtgccatgccatagcgatgttactgaatccgagtcccgtcttttggatgctgaaatgtggtatgtctttatagagagactttgtttatgtctatactatgcttgtaccaaattgcggcactatttgttatctagtatatgcatagttgcttgtcaagccgatgttattagacatatgttgcaaaggccaattctaagtgggtgaattggcaagtgggcatatgttttgattgaatatgatttggcttatgaaccgttgaaatctatgaaaggccaaattgtagtacattttatagtagaccatcatgtcgatattgcttatgatgaagagatttgcttagttgaagttataccttggaagatttattttgatggttcttcttgcaaatagggtcaagttataggtgtagttttattttcacctaatggcatgtgttatgaggcatcggttcgtttgaaatattattatacaaataatcaagctgagtatgatgctttattattcggcttacaagtgatggagatgattggagccaaacacatagaagcatttggtgattcggaattggtggtgcaacaagttgccggggcttacaaatgcttgtacggatcattaaataggtatcttgatcaatgcttggatattattgccaatttatataattttgctattagacatgttgctaggcgtgataattctagagcaaatgatttagtgatgaactctgagctccactcgagacactcaaggctgttgttggcccgatctttcggtgagttgtagataactacgatttgagagaaacgttgacgacctgactacaaccgtacacaacgttgttgtgttgtgccttagcgatcgatacacctctccgtgggttgttgatcttgccggtgcagatcaaccttattcctgcaaggaaatcgaataaacaagcaagaacaagataaaagcaatctgaattgcagataggaattgaatacaaatgataagttgggattccgtaacaggcaaaccagcgatctaaccgatcacgggattacacggcaaagtatcaaagctaaactttaatctaaacaaaacccaagaaatcttgaaggggtacctagctatttatggaggtgggaggatgaccaaggggaccctagggtcgtgctccaactgattggggcgcaccccacatgggccccacttaggccgggtcccaaacgaagttacaagcaatttggcccattataggtgacgtagcaccttatttctgcaatagcagcccactgagaaggaatttggcaatgaggttggatccgttggaaagatgactacgtgagctttccatcaagtactcatggacccaaaacggagctcgtatgcacatttggcggccatttgaattcaatacagtagcaggtggctgaattggattccaataattggaggacttgatcttgttatcatcttgttcatccatgatgtgagcaatggttgtatcaatggtagccatggtcacatcatcctccccttctccttcaaatcatcgagctcacaaaaatcatcaaactgaacatagcccgaattatttaaagaagatgtcaattctcgttcctctatttcattagcaatgtgaacgacatgcttaaaatcggcacacaaagaaacactagaaacaacatgtaagtgaagcattatcacacgactcttctttatcacaaggaacaacaagtaaatcaacttgtgacaaaggcatctcagcaattggttccactaatggctgctctactatagcatgaaaaatagacatgtgtagcttagcttgagaatactcacatttatttatctcagtaccatttaatttaccttgcaaactttcttcagacaccacaggtgcttcatcctctttcttctcaagtacaccattctccctcttttgttgaatgtgatgaattacctgcaaaatgttagtaacaggagagacaaaagattgctcctccaatgtttgcacatcatcattgcatcaggatataggagattcagaaataggagataaatcacattgttcatactttctcgcatttgatatgatctgactctcaatgctacgagcaaacatgaataggtgtccaatatgattatatttcacattagcaagcataacctgaacttcagaactaagccctttgaaaaatctacgcattgtgttttcattgcattcttttagaccactgtagataatgcaaactttgaattcatgaatgtactctcaccttgtgtttcagatgttctaatttctcatgaagaagacatttgtaataagaacttacaaaatgttttcttatcaaggttttgcattcatcccaagtttcaggtttgttactcacataactccaccaaaagagagcaggagaggtaaacttattactagcagccttaatcatttgagcatcagaaaaatcatatttatcaaattcattgtctactgctagctcccaatcaatataagcaacataatcgtatttaccattgtagaatggtaacttagattcaactcatgcaaaattatagtcaggtacctcatatgcatcttgtcgagaagttggcatctctcgtcgatggtgaagaagccgatgttgagcatgaccatctcgtatccccttgcgcaatcctggcatggttaatagcaaacaagaaacatacacaagaatatgcacgctcctatcaactactaggtagtggaagctccgatatcacacacactcaagctttttaccaagttcttaccaaagcaagcggaatggtgacgtacaccaactcggccaagcatcccaatggagtttggatgtatcgataccttggcaaacacttgctatacggctgcaatcaaatatgtggagctctgggtaggcttaaaatgtagcaaaggaatagcaaatgctcaaatcagataatacaaaattgaataatcattcaaagtcagtaccgtactggtcctaggctagaacgtactagagacgcgatcctagacacagacgataccacaagatagctccagaaacaactcaagcacactctgatatactaaagcaaactcaaatataagagctcatttttctcttttccatctttcttctttcttttttttcttttatttttcttttcttttatggtgcggcttttcatttctttttttatgcaccttcctgccttttttttctttctttttttgattttttttaccaaaaacagactcaaggacctcaatgtgatgttacagggactcaaacgtaaatataaaaatttacaaggactcaaatgcaaaagtccgaacccaaaattaaaattatacaaaaatggaatgctgaatttatactggttccatttttttcaaacggatctccaatccgacaatcgaaaacttgtcaccaagctctctagcaactcacggtgtagattgaaatcgagaggagagtggggagtcactcggcttgtagaggtggtgtgaagccgcacgcgagggggtgggaatcggctataaatttggaaatcacgcatggaaggaaacaaagtccagaaaccgatctgctatcctttctttctccttaaccgcacgcaacagcgatatgctatccttcctttctccttaaccgcgcgcaacagatcctcttccttgtgtgaacagaacaagcacaggcgaatgcagacggcaaaccccagatgcaactcagcaactctaagaccgactgataaaaacttctgaaaactagaaaaatagaaccctggcagcatggcggttccattttcgtaggtcccaacgataacaagtacacgacgacgacgacgacagtggtacaaaacgtgaccagaacctgaaactctaaacgaactaaacgctaagaccagcaacatgactcgacaatgcaacgcaaaactcaacaaagcaaaaactgaatgaacaatgcaatggcacaaatatggctaggtataggatgcaatttttttgtatggctattttctggtagtagtgttaacgaccaaatttgagaacactgagcaaaaaaaagctctgataccacctgatgaaccctgagctccactcgagagactcaaggctgttgttggcccgatctttcggtgagttgtagataactacgatttgagagaaacgttgacgacccaactacaaccgtactagacgttgttgtgttgcgccttagcgatcgatacacctatctgtgggttgttgatcttgccagtgcagatcaaccttattcctacaagcaaatcaaagaaacaagcaagaataagataaaagcaatctgaattgcatataggaattgaatacaaatgataagttgggattccgtaacgggcaaactggcgatctaaccgatcacgggattacacggcaaagtagcgaagctaaactttaatctaaacaaaacctaagaaacccagaatgggtacctagctatttatggaggtaggaggacaaccaaggggaccctagggtcatgctccacctggttggggcacaccccacatgggccccacttggcccattataggtgacgcaacaccttgtttctgcaattgcagcccactaagaaggaatttggcaatgagggtagatccgttggaaagacgactccgtgagctttctatcaagtactcatggacccaaaacggagctcgtatgcacatttggcggccatttgaattcagcacagtagcaggtggccgaattggattccaataattggaggacttgatcttgttatcatcttgtttatccatgatgtgagcaatggttttatcaatgatagccatggtcacatcatttagcatggcaagcatatggttataatgtgaagaagggagtattttttatattagaagaaccggtgcttgatttcaaacctttgggtgaaattggcaaaaatgcagaccgggggcggtctaacctgcgttgcacggctggtctgaccggtgactaggggtggtctgaccggccgtatgccgccggtctgaccggccaacccgggcggtctgaccggccgtatgccgccggtctgaccgattctagacagaaggttggggggcacgtcccgattgattcaaaggccgaactaattgtaatttcggacatttgtgcccaggatacagaagaggattggagaattcctttgattaaatatttgaaagaccctacacttaaggttgatcggaagatttggcggcaaatgtttaaatatacattgcttgatgaggatttatatcgccgaaatatagatggggtgcagttgaagtgcttagataatgatcaatctaaagtggctatgggagaggtgcatgaaggaatttatggaactcatcaatcggcccataagatgaattggttgcttagaagagcggggttctattggccgaggatgattgaagattgtttcaaatattataggggatgtgaggcttgtcaacggttcggcaatgttcaattggtgcctgccgccgtgtgaatcctactatcaaaccatggccgttccgaggttgggctatggatttcattggtcaaatttatccttcgtcatcaaaggggcataggttcgttgtagttgcaacggattacttcaccaagtgggcccaagccgtgccgctcaagaatatgattcatacggaggtaattgtctttattttgaagcttattatccatagattcggtatcccgcaaacattgactacgaatcaaggagcttcttttatgtctaaggaagtgaagagttttgccgaattttatggtataacattgttgagttcttctccttactacgctcaggctaatggacaagccgagtcgagtaacaagacgttgtcgaagatagtcaaaaagaagattgaggaacacccaaagaagtggcatgaagtgctttctgaagcattgtgggcgcataggatatctaaacatggtgccactaagtcactccttttgaattggtttatagtcaagaagctgttttgccggttaaggtaaatcttggctctcttcggtatatcaagcaagatgatttatcaagtgaagattacaagaatttgatgggagacaatcttgatgaagtcatcgacaagcgtttgaaggctttggaagagatagagaaagagaagaagaggatggccaaggcatacaacaaaagggtgaaagcaaagttgtttcaagttggagaattggtttggaagacaattttgcctttgggtactcgatccagggagtttggtaagtggtctcctagttgggagggtccttttcgagtatgcgacattgttcgagggaacacatatttttagagacacttcaagcagagcgttttcagcgagcaatcaacagaaaatacttgaagaaatacttcccgagtgtttggcaagacacttaggaggttctatggccagtaattggattatcaccctaagaccaaaacatgttctatggttttagattcacgccattcaccaaaacatgttctatggttttagattcacacccaaattcggcacccagggataaaatatggaaaattgccaaagtttggatgtctgacggttttcctctagttggaccggtctgactgcggtgtataggccggtctgaccgccgaaagtgggccggtcagaccggcggtgtgtggccagtctgacctgtagagtccgagtccgggactgtttcatcgggtctcaaggtttgtgggcccccggctttacacaccagaaaccccatgtgtcttacaataccatttcctagatcagtagatggtacacatatggcacagttgtatatcacaagctgacatcgttatatagtttgaactatacattaatagtacaagggtagcccaaatgggatccaaatagaccgagcatggtcatgtactttgcaaaataccaaaagaagtagatgagatagcggaagcgaagcagcggcggtccaacgtactccacaagcatcgactggtgaacctaggtcccgactccaccggcttcgatatctcttcatcaacattgttcccgtatggtcgactccaactcctttctaaaagatttagttaagcaagggtgagtaccaaccgtactcagcaagccaccactacagaatgcatttagtgcacacagaggttcaaggatggcttggtttatttgcataaagcaagatttcataaatcatttcacaaacctatgactgagcagttttaactgaaaacaacgataagttgaagttatcattaatccgcaagggttcatccaccttccccaagcctcgtttggtccggtttaccctcgcatctagttttccatattcccaacatcatcatcatgaccttcctgcccatcgggcaagatcacaccacttaatctaagcaagattaaaatctatgagactagtcaagtgtagtacaagtcccggcgctcaataaccgcgagcacggctattcgaatatatttgatttactcacactgcagtggatgtacgcttttaatcccacactccgcgacttgcccaacacatgagcctagtcccaacacatgagactttccacgatccggtatttcagtcaccctcgcgtttcggcacccgctccaaggactatgtacctccattgcacccttggcacaacacaccacctcaagccggcggtgaggagagtcctggcgcccctgggatcacaatgggttatattacatataggttaggtccattttagatttctgatgtcataaaccaatccacatcccttcaccttatctcacatcacacttcagaaccaccatgacaggggtgccgtgctatagctgccttcatagctaagtcttcaccagttattatgtttgtgggctctacaccttccatagcctctaaaatgcttgaaacaaccatacaaaggtttctgtcttttcattccttagaaatccacaacccagctaaatatccaaaaaaaaaatacacataagaaagtcatcatagtttggaagtaagttactacaatttgcatagtctgtacagtttgtttttgctggaagtaaatcagtacaattttgaactatagaacagacactaaaagatgtaacttgtaaacttagttacttttttttcttttttttagaaaaaaatgtaacttcacatgctactggaagtaacttcatcaggacttgatgtaactcaatgaatccaacaactaacttaaggtgtactataatgtacaaagttattacagattttttagatttactttttttgcaaaacaaggagtacctgaattgattgcccatgtctgtttatcccaatgaatggtgcacaaggcatgttatacatgttcgtcatgtatgtgcagtcaaacgagatgcaatctttgtagtctttgtaggcatttcttgctgctccatcaacccaaaatatgttctgcaccctgtcttccttattaagttgaatcttgtagaagaaatttgggtcatcctttttgatttcctcgaagtgagcaattgtttgaggcatatctctacacctatacttgctccccatctttgacttgaaattgcttatgtcttttctagtgtagggtacattcctagcccctccatacaattctgacatcaattgcataattctaccagttgagagattaactccgtgcaacattgtgatgaaatctttttcctttttcggtattgctctatgtgaccttagaaatttcttaagtgaaaactttctaaccagaggatgtgtgtgttcttcaacaaactgaattacttcccacctagttcctttcctcttcactgtcatccttactttgcaggcagcctgtcttgttttacttcttttccttttctttggagggcacgcttgtcacgcccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctggattctttttctttaactgaggttgattgattagtgcaagaatgagcatatgacatactcaacaagccacacagcaaatatgcaagtgcacgaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaatctccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaagtaccaccacggcactgcaaagggggaaatcgtgacaataccctttgcacaacacaactcaaaacagtgcaccgttcctggatcataatcaccccctcaaaaaccagaggcatggactccccagcgacccccgtgggcttatctccgccacttctcagtctggtgctccgcaatgaatcatgctatacaaaagataaagccgttgcccacgctggcttgtggttggcacggttaaagtttcacaacagtagctcgcgaaccggtccttaattttcatgagcacgactctcaaaaccatgtgctcacaacccaccattatcaagttttagttggcaagtaattaattaaccaatcacgattaaccatcgtgaactatcattaagccatcattaaataataatgcgtcataagttatcccaatagtgtgctaatgtttctaagcatggctaagcaatcacatctaatatctagctgaaccaatatgtaaagctcaactagtcaagttataaaaacccaaggtatcaaggaataaagtaatcaatgcaaacagcccataacaaaggaatagattcactccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccgacgcactcgcgaaccttcgcaacgacggaaacgacaagctaacacgcaaaacaaggaaaagactaataaaaaccaaataaacaatacataaaaagtaaacaaacatgtagatcataattttagatgaattatgagtcttgaacggcctcattctgacttcaaatgaatttattatgaattttacaagattaaatctatttaaagcccatttaaaaagaattaaataaatttaattcaatttatggacaattttaaaatgtagatctttattttatataacttttgcaacttgaaccacattaaactgagttacaatgaattagttatgtatttttaaagattaaaccggattaaagcatttatatggattttaattgaattatgacgcaataatgaattatttttgaaaagaaaaagaggattattgcgtcagcggctagggtttgcggtggaccgggtgcacggcggcggttcacgagaacggacggccgagatcgatccatccaaaacggacggccgagatcgatcggtccacgaccgggccaccgggaacggcaacgatgacgtcagcaccggcggcggctcggcaacgcatgctcgccggcgaacgacggcgcggcgacgcgaacggagggcaccaggacgatgcgggcattgcggcaaactcaccggtgaccaatgaagcggcggaggagcaacggacggcgccggcgacgaggaagaaacggcggcggtcttcgggtcgacggtgacggcggtgctccggcggtcttcggcggcggcgaagcggcggacgaggacggcgacgacttggcgaccacgatggcgacctccccgagcgacgacgacgaccggaacggcggcggcgcacggctggagcgacggcgacgacggcggcacaagatctcacggcgctagggcgcttccgacggcgagagacgaaggcgagggtggcgacgggtagaggagacacaggggatccttttataggggcaaggaggcggcggcgaaggcccacggctgccggcgacgagaaggaaaggtcggggtttggaggaaagagaccgatccgaatcgacctcgaatccacgaatttccaaacgattttagccggtgattccaaaagagaaaaggtggaggagatcgagaagatcatttcccctctatcaatttcaccggagaaggaaaggatcgagcggattggaaagcggcagcagcgcgactcggctagggttccgggcagcggcggcggcgcgaggaagacgaacctgacaggtgggacccacctgtcagcgacagagagagagaggagagcggcagctcggcggactgggccgacttgggccgagggagagagagaagagaggttttgggccgactttcggcccaaagccaaaagaagacttttaaaaacctttttcaatttacattattcatgaaatgcaattccatttattaaaaatacttccttggctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaaaaatttataatttaaggatttttaaacaagaaaagcacttaacaattataattaatgataaaataattattgaactgttctttgtatcatttaggaattgaggtctgaaaaatccgagaaaattttagagagttgacttaatcatggagaatttaataaaaattaaatccatccatgctttatatttaggaaattttatttcccacatttaacttcacttgttaattaaagaacctttaatataaatt

SEQ ID NO: 32296 - DNA, 6977 bp, Oryza sativa
gttgaaagtcaaggtgaggtatggcacttgtgtgctgcacaaaaaatcctgtgatggcgctgactgtgcttctgaatcatctgtgccagagtgttcacttgaaattgtgttggcagtagcagttgttgcgccagttgcaacactagtatgcattgtgtctgcatgatctgacatttcttcaaatagttgcatctcatcattggcttcaaatacttgcatctgatcattggttgcaaatacctgcatctcatcattggcttcaaatacttgcatctgatcattggttgcaaatacttgcatctcatcattggctacattgtgtgctcgtaaacttccagcatcatcagcagtatacatagtttcaaagtcaaaagtgttgtccaaatttatagtaggaatctccatgctagtgtcagttggatttacagggaattatgtttcacttctgtcttcatcatcaattagtaaatgatgtagtggatgttcattttcaccagaaactaattccgggatactgttgaggtcaaaatccatttttgctgcatgtgtttcagactattagtaagtttatacagagcattcattgaggtaattcagtaattggggggagaagtaacttgcacatcacatgaaagtaaagcttttatttttttcagaggagtaattttgtcagacaattacatctgtggtatagaaaattacttgcatgttttagagggagtaacatttatatgttttgaagtaagccagtacagtttggaagtaagttacatgcaacaggatagcaactcttataactggactcgatgtaattaaataacctatacaaacatttctgtcttttttagatgctttctaggaagcaattttgtcaaattagaccagtggctatactaattgaaagtgcatctaggcccctaatgattttgatgattgattacaatgcgattagagaggactaacatttttattcaagcaaatgtgaaggttgttaagtcctcaacatgttgtaatacaatgcatatcccgtgaatgcgacatcgcgatgcaatgcggcaatgatcaaatggtatattgtatctttttcctcgcattgtgtcgtaggaaagccgtactattaagggggatgatgcatagacatataaggagtgatgcgtgtgctcaaaatcaatttttcttcgaagcatttctcttttggagtgttctggaaatttttggaaggtccgaaaatagttttcggaagttccgaaaatagttttcggaagttccgaaaatacacagaattgtgtttgagtgttctagaaattttcagaagtttcgaaaatagttttcggaagttccgaaaatacacagaaccgtgtttgagcgttctggaaattttcggaagttccaaaaatcattttcggaagttccgaaaatacacagaaccgtttgagagctttctggaaattttcagaagttccgaaaatgatttttggaagtttcgaaaatacacagaagcgttctggaaattttcggaagtactttcggaagtattttcggaagttccgaaaatgggcgttgacttcgatttttctcagatctggaattttcggaagttccgaaaattgtttcggaagttccgaaaatcccttttattgcactccaacgggcagatcttgtgagggctgctggttccattccaattatttgtgcccttggcttgctctctctctctctctctcattcatttgagccttgcttcctcgattcatctctccacccgtgtttgatttggatttggtgtgtgtgtgagagtgtggatttgagcttgtgtgggtgcttcttgtggtctttgtgaagatttgtgagcacttgcatcatctccgggagttctttgcatcatcttttactcttggaggttgaggactcctagacggctaggtgtcactcccgagccatcgatctacttgtggttggccgggagaagtttgtgaaggccggatctcgcctccgcaagagaagagatacctcttagtgaaaggagaagtgcttagtgcaacctcttgaggaaagggttagctaagacccggctcttagtgagctcctcaacggagagtagaatcccctcaaggatttgaactccggggaacaactttgggagctacatcttggtgaaatttcttcatccctctcctctagctttgcttgcttgtgccgctattggtctagttgctgattgtgccttgtatttcctgttatagtcttgtagatctagagttttcattttttgtgtgcgctgctctgtgcattttcggaagttccgaaaatcatctcggaagttccgaaaattcctagcctagctccgaaaattactgcttccgcatttcttaagttttaaattagcctattcaccccccctctaggcctaattgaccctttcactaatgattttttttcacaatttgtttttatgcagtacaagatgaaattgagacgcaaataggggatgcatgtcgggatacccggtttgagtatggtatcccaaaaccacccgcgactgtccaggatttcgatcgtgcatagattgatatacagaacagctttcgatacgtatacccaagtttttacagaaattattatataaaagataactaagacaggttttaggggccgacaggccaaacacactccctacaaacaaaagacccaaacacaaaataggataaaaacaccacaggcaacgcctgagagcagatcgacctagaacaagaactcgtcagcaccatagaattattccccttcctgcgcctcctcagggaagaactgatcatctgaaccacattttatgcaagaggtgagtaccgaggtacccagcaagccacatccataataatacaaatagaatatatgcaaggcgtacaaagaatatagttcatcaaggaggtttcataacaagcctattataaatagtttttccctactttatcaaatattttattcgcaaacaattgtaaatcatcattttaaaacggtagcaatattaatcaccattcatcctcatcttcatcatattccatatttgaatttaaaatctactcataccatgataaataggaatcacccaatgacatagcttcttaaccggaagcacgacacattcgaatgatttaagactcatctctgcagagactgcccagctttacccacctgatgtcaacaactagctaggctgaggacaacatagtcgttcgagagtcccacttactactagttactgctcagtaggatattgatccgtcctagcagtcgggcacttgctgggcctaagcaaggctagacggtcgctgctttcacgggttctgtaatatttgtgatgaacaattggctatgcaaatgatttaatcgttgaattggtttgaaaatatgtgtgaatgttggtgtgagtgcgtgtgactaatgtgggacaggttgtgatatctgtgcccagaaacggttgttttgtctgattatgtgcaggtgacttgaggtcagccttgatcaatggtgaggaccgggactatgttcagggagaaacagaggtctagtgcggtcgggataccatgtgagaaggtgactagagtcaggattctttgaggtcaacttcggtcaacggtgaggatcgggactagactcagagaggagttgaggtccagacggtcaaggataccggttgacgaagttggatacgagatggcatacggtggatggacatcgtatgaggagagatcttcgcaacgggcttcacgaggtgtgcgtgcaagcatcggtgttcgcgaaggagattggaagaaactggagaggagtatatggtgctacagtgctttgggttactgtagtatgcatatgtgtttgcgtactgtggtgagcagtagcagcatatatgtgtgtggtgcatatgcatgtcgttgcatgcatgtgtgtgctgcttgggtgaagcagcagcaggcagctcggcctgggaggaagcagcaggagcgagctggcctgggatgtgcgcaggagatcgagaccgggtgccatacggagatggtggtgtattgacgtcggattggtttcctgcggctgcagttcgagagtttggaggattgagtcctagtgtgactaggagttgttctcctacttcctactttgagtaggaggttttgggtataaatagagagggaggggtggcctcctgggatcggttttagagagacacaagttgagagaaagttagggtttcaagtttagttcgagattttggtgaggagtgctgttggtgcactttgtaaacactagttgatgcaataaagtcgaaaagtttcaatctacatcttcgagtttgtcatctaccggtgtttctgggtcccgacggtctaaccggaggggtgtgcgcggtctgactagtgggatagcggcggtctgaccgtaggtgttcaagcgatctgaccagcgaggtgttggcggtctgaccggcggcaggagggcggttcaaccggcggcgactggacttcgtcatcgacttcgttcgagggtaatctttaattccgcaaaagattttgggtttttgattttcgctaccattcatccccccctctggtaggttcgtttggtcttgtacgatcctacaggttccaccgttgtggatcatgtcaacctggccaaagccccttccacatgtccaccccaaacctgctcatagagccaccctacagtctttcatatagtgagacaatgtactaggctaagtttgattactcagtcctgtggatgggcgcaaattacatcattttccatggcataggggtagtccttatatccggggaaaaccaccaaaactagcacaggcccgtgcatacttcaagtgtaaatatacactttccacaaaataattataacaacattgtcacgcccagaaattcacgaaccagaatttctaagctgaatgtgcattaaatccctatccaggaccagccagggtacacaaacgacaattgttgacctacagatccacgttttacaaaaatagaaaagattacaaaatgcagcaaaaaagataaaacgagctagacttggaaacttgacttcagtagcggggcgactccactccacaggcaaaccttgacggcagcgacgaaaccaactccaacaggacagctcccactaggaagatcttcagctctggtgtgggggaaaagaaagcaagactgagtactacccactgtactcagcaagtcataccggaagaggaggtatgatgcaggatataaccaaaggaggctaaaggttcttgtgcataaagcaggcatttcaaagcagtagttgaaagcagtaaaacagtagtagtaattaagcagtattaaccaattactgtctaacgctacaccacgttgcaacaggcccaaccaaccacctgaactacaccagttcattaaactaaactcggggtgagactaatcacggtgaatctggttgatcgcccataaccgcgggcacggctattcgaatagttttactctggccaaaggtgtacaactgtacccacaagacacgattccacacatgtcgccataccccgaagtatcatcatgatactgcaaagggggaaatcgtgataagaccctccacatatccctcccctaaccatccacaccacgctaaggtttcacccccacccctcaaaagcagtgggcggtcccctcttgcgccgcgatgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtgcttaactgccatgggtgcgaccagcaaaaccatgcacccacagcccaccattcagtgtattttaattaactaacaccattgcggtggcaccaatccaaagctatgctcgtagacaaagtctatgtaataatgtgatccccatttgtgtactagttgaactaagcatggctaagcatttcctaagccaacatctagtcattttgatacccaagttatcaatggcatatggtaaacaatatatggctgagtaataggacccatcccacatgacattgtaaaagaatgcaatatttaatagaaatgcgggatatttgtaaattgggtacaatatgatcaattgtattgcatgacttgccttgctctcgaaccgatgagacctcaacaacgtcttcgagaaaccgcggatcgacgaaacggccgaattctacgcgacaaacaaagcacacaagcaaaacatgctataagactactgaaacaggaaacaaaaccatttttaatggattctttgcatttttcttgacttactgagacttgaatggacttaaacggagctcggatgaattacttatgaattttagaagataaactgtgtttttactaataaagaaaaagtccttaattatttattgcgcaataaatgcccagggctgacgtcatcagggggggcgtcagcacgtgggccccatgggtcagcggcacaaggcggccggtccaccgtggaccgggaccacgcgggtggtccaccggcggtgaccggcggcgcgggagacggcggcggccggcgcgaaggcggcggcggcggccgaagacgacggcgcacgcgcggagggcggcggcgctcatgggagagagggaaggaaggaggagagcggattcctcaccggcgagcacggcggccggcgcgaaggaagaaaacggcggtgatgaccggcgatgccgaggcgcggacgggcagcggcggcaccctaagagagagcagagaggggttaggggaagggaaggcgaccacggcggcttgaattgctggccggagatggagaggagagaaggtctcaccggcgcgcgaggagaaaagggctccggcgttgttcggcgg

SEQ ID NO: 32297 - DNA, 7144 bp, Oryza sativa
ttcaaaatgaatcccgcccatttcgtgcgtgcgcgcgggcgggaaaggcggaggagtggggcggcaacgtgggcgcgcggcacgggcggagtggggcgcggagaacggcgggaaacggcggcagcggcgtgggcggtttcgacggcagcggcggttgctggaggtaggagacgaccgacaggtggggcccacctgtcggcgtcccagagagaggagggaggggcgcatgggccgtcccaacaaaggggaggccgagcgcgggagggagtgggccgacggcccaatagagaaaaaagaaggaaaagaaaaaggaaaagaagaaaggattttccagggattaaaaatattgcgcttgctcatttttaattggttaaaattatttccaaggctttgaaaattccactaaaaatcctgttaatatattgtgacatgtggaacccaagaaaaattccaccatgccgaatttgattattaaatgcatttattaattagggatttagctctaggttaatttaaacaatttcttcgagcaatttatttagccaatttttaaagcaaggagagggggaaacttcaaggcgtgacaaacatgcacggtctcacacaccacaacatccatcgtcacccggaattaatcttccatatcactctaggcgagtgacttatatcaaataacatattttatatcacccgtcacgccaccacgtgacgacgggtaaactatgtatatgaatatagatatttggtggtcttatccactaggttatcaaaggggcgtgatatagcaattcatggatttggccaataataacaatgtaataatgggtaataactaaactaataagtttattcaaaaataatttatacgcaaaataatttatataaaataactaagtggttctctactaggtttcaatatgatcaaagattggaactgtggcttgccttgtggaaggtggccttccgaagcttcagcgtagccttctaggtccacttcagttcctgtgagtccggtggaatcttcaacaccatctaacgtacgcacacgaagaaacgaccaaataagcctataataaaaatactacaaataaacgataaaataaatattgtgaatcggagccagaacaaaagaaaatgataaatcaagagttaacttgatttggatgacaaaagatttattctagggttatgattcatggtatgtgtagtagtggttgcaatttggaattaatgctatagatgacagaggtgaaaactgaaattgatttggagttttagagctcgaacatgagaaaaacatcctaatggaattgtttggactggtttattgtggttaggcactatttaggtggttttgatgggattggttgggttcaaccaataggaaacagcgctgccggaactgttcatgttcttcccgtggcttttcacgtgagtaacagaggtagagagaaaagctctagagctccagtgagggaacggcgatggatacgatagcatgacgtgttccacaggctgacacccccacaggacgtggacactgggctggaagacaacagagctaaccggaacgcgagttccagatcgggagctatggtgacaccgggcatggaagtggcagctccggtggcgaacgcgggcaggtgagtgcgtcaaaacgtgttcctggatgagaaggttccatttttgtggttagttgatagagatgaagcgtcggccatgccgacctcggtggcagccatggtggtggacaggagcacgataggaacccgatagaagcaaggaaagaaggggacaaaggttattgagaattctcaccgatgagaggtgttcctgcggtgctgtggtgcagcagcagagggacgacgacgacgaatcggctacacagctggccttggctgtggctgaggaaattttgggatgaaaacgagtttaacgcttccagggaaagaagaagaaggagaaaaaggaaaagagtgcaaggtctaggaaccgaccggggagatcgatggcgaggcgagctcagcctctcgctatgatttgcgcgacggctaatggagatcggcgcgtggctgatgtgaggcggcacgggcgggcgtgtgcgagcacgggaaggtcgcgaggctgcttgcgtgtagcgcgagagcggccctggatggcgtcggcctgcagaggctcggctggagccgggctgcctaggctgggccaggacatggggtagaacagcccaacacagagagtgaccagggaaaaggaaatccggaatatgggctggattgcaaggaactcggtccgagaagaaacacagtgatctatttgaatttttggagagatttttgtatagaaatttggtaggatatttttgaataggaaatcgttaagactgatttttagaatatttgaatgatgactccgggataacttaaaataaacacgagctcttctgatgattttcggaattttctctggatatctcagatttggtttggagagggaaactaaacaaggttacgtgggagtcggaaacttagagggaacaaaagaaatataaggattgggaggctccaattcgaaagaacgaagaacattgactttaaatattttcacaaaaattttaccctgaaaaatctagtatgttacaatgcatcatgctgtatatagaaacaaggtacaaaatgtgtaactaggaaatgtaaattcaagtttatagggaagtaactttgcatgtttctaggaagtaactcattgaattgttacaagtaactttctgctaaaaatacactgagactctgttaaaattgctatgagaattaacctaatgcacagtgagaagttacttaatacacagtgagaagtaatttagtgtactgtaggaagtaactcattgaagtgttagaagtaactttttgttaaaaatgcactgagacttctgttaaaattgctttgagatttccaacaccattactcatgcctatgtaactagggaatgcaaatttaagtttattttgggaagtaaagtaactttttgttcaaattgctctgagaggcaaccaaatggaatgtatcatgctgtgtaaactagggattgtgaattcaagtttatctggaagtaagttgcaagttcataggaagtaacttactgatttgttagaagtaacttcctgttaaaatcgctttgagattttgaaacaccagtactcatgccttttcaataactttttttctcagcagcactagaaagtgaatttggggtataaaggaagacagaaaacaacactacagctcattacttacaaaattacagcacatattcatatgaattcttttctcgaagaatacagaaaagatctaaaagtttctaggttagttctatttgtttttttttttggatggatctcaaagaagacagaatttgaacttcatgtgtactttacctggatattttcttggatttactcctcctccttcccctcttccaagatggcgatttttttcttcttagatttgctcctcctccttcccctcttccaagatggcgatttgtttctgatttttaccgctgtggcaactgcgtggcgattgatgtcgccgatgtccggatttgatgggttggagcgggggagagaggcgcatcgcgctgtcttagctggggcccacgccagctagcgacgtgtggcgttgcacggcgcttgcgcgcgcaagcgcgcactttcctttcctttttgagccatggcgcacgcgggggcccgggaaaacgctgtttccttttttggcatgggcgcgcgcacgtcgcgcgatagggctatcgcgataccggtctcggtgtagtcgcgtccaaatggaatctaggtaccttcatctacctccagaaaaatcccctctaattttatcatgtccacaaattaaactatagatttaaaaagtaagggggagagaaataatcttgaaaataactgaaaaatcaattttcactcaaaatcctacccatcccttacacccacacctagaccacaccaccctggacccacctgtcatcatctctgggtcgctgtccaagtgttcacctcctccagccgaccagagacacatagggagggagggagcacgctctgccgcccttcagagtccgaacgcgcgcgacgcgtggctatgacgtgtagacgccctcaaaatgccgagctcctcctctactcctctccctgacgcatcgccaaacttcactgtccaccctgagccgaagaaacccaaggagagagctccaactctccctctccacctctctttcgtcgtcggccgccgatcaccaacgagccgtctccatccctatctaattcacgttccgttatcttctctccatgccgagcaaatcctcttttcactccatcttgtttcgtccactgcaacgacgggaacgtgacctcgtctacgggagctctagagcgtgctccaagcgccgccgcaagtgtcgaaacaagatttcggcaatactaaaagggggtggctatcaagctggaaaagtggatgagtttagagacaaggaattttatacaggttcaggccttcttaatcaagaagtaataccctacacctgtccggggattgatccgccgagtgtattatagatcgtatgatcttggagaaaaatcgtaccccaagaggcacccggacccctccttatataggggaggagtccgtattacaaagtacagcccatatccctaacggaataggtagttacagataagatacaatcataaccgactaagatcccgggtatttccttgacaaacaagtttggattttaacccgagtccctttaaagataatctatctatatatggcaccccatacccagtcggatatacatgccgtgtaggtatggggtatccataatctctacagtagcccctgagacctttacagtcgacgaaatagtcttctctcgtaattcaaaacaataatccgagtgctccaacttcttctgccttggtctcccgagtactaaaatcaaagactgtgaagggctaaaatagaaaaaatcaggtgcatcaactagatgcacctaattaggtgtagcccccaactatgtgattagttaaataaaaactaaacacatagttaaagtgcaactaacatccatccgagtggttttacaaccgaatcgtccaaggtatcacatagctaagcatatgcgacgtttgataaaacatccagccgactgctttagctttaatacacaaaaaaggagatataaagagacccgagtgagaaacactctaaaggtctataaatcaacacatatgataagaatccgagtaaaaactctcaaaaagatccatcaaatgtgatataaagcatgacaaacgatgagtctaaatagcctaagttatgactcacgccatgaccaaaataagcatataacgtgccgagaaaatgactactcaaaaccagtcatctcaacaaaacccaaacagcttttgcagcctaaaaagcttgcaaaattagtataacacttttccgttgggcacctttttatttgcatcgtagtaattccaaagaattatttaactgcgtcaaaaaggattttaacagcattaggctatattgttgtgagcaaatattgccgaagcaaaaatgcctaagtccctaaggatcacaacttagccacgccgatagcaaaattgggctgaagtactgtttaggcccatgcccattagtacttccaataccctaatgaaacaacactgaagatcaagcgccgtttcgtcttccccgccgaaaccctcgccactttccccattttctgctacagtacgaacccgcgccggcgaaactagggttcaccgattcgctccactccatcctccaaaacttcacgaaaatctcccacacaaccaccgcatcaatctcccattcattcctagccacaccccgaaccaaatcacctcattcagatcgcatccatggtggaagagagagagagagctttgagagtcagtgggcgccctccgatgtaacggaggagaacctgaaggagatggtggcgcacggtgttcttccggcaaaggagatcattgggtggcgtccagcatacggcgaagcattcccaactcctgacacacatgtggtcgtggtattttctcatttcttctacggcggattttctcttccgacctcaagtttcttcagaggaattttggatttctatggaatcagcctacaccacctaaaccccaattccatagtccatatcgccaatttcatccatgcttgcgaagcttttctggggattaggccacatttcgctttattccgctgcatcttcttcctcaagccccaggcaaacaaaagcaaaccatgcgtagttgggggagccggatttcaactgagggggaccttgagccaaaaatacttctccatgccattcaaaacctcgaacaaaggttggcacgcgaactggttctatgtgcaaaaccccaagccagcgcttcccggatactcctgtcttcccccagtctatcgcgatacctggaactcactgccgatgggagaagaagccgcccaagcgctcgacttgtttgatcgcatgctgaagctgaacgaacagggtctacaaggggaacaaatcactcggcacttcatcaagaccttgttggcaccaatcaaggaaagatctagaacagcctttgaatttgacggcaagcatgaccccaaccgagagaacccagaatctcttgagttcaaaattatgcaggagaggatgtaaaaaatcttctcgaatgccatcgtggtcagctattcacacacgttgccagtcataccatacaacgccttcaatcctcccccaccggtatgcatcatacatctcagcctctctcaaagcatgcttttattttctgtaaggtaggttgaaaactcggaataccatgcacaggaatttgctttgatgaaatctgaccctccgattgctcaacgccgctcaccccgttggaagacaagccaagccagtggagggccgaaaatccggtctattgatcaacctgacacttcaaagtcgactaaccagtctgactctcgtaagagaaaattggttgtgagtgacgacgagggcgatgacgctgaaaaagctggcaacaaagggatg

SEQ ID NO: 32298 - DNA, 19529 bp, Oryza sativa
tgcaggagaggatgtaaaaaatcttctcgaatgccatcgtggtcagctattcacacacgttgccagtcataccatacaacgccttcaatcctcccccaccggtatgcatcatacatctcagcctctctcaaagcatgcttttattttctgtaaggtaggttgaaaactcggaataccatgcacaggaatttgctttgatgaaatctgaccctccgattgctcaacgccgctcaccccgttggaagacaagccaagccagtggagggccgaaaatccggtctattgatcaacctgacacttcaaagtcgactaaccagtctgactctcgtaagagaaaattggttgtgagtgacgacgagggcgatgacgctgaaaaagctggcaacaaagggatgactggaaaacaaccaagataagctaacccaaagaagaaaacatccagttgccctatgccgaaaatcaggaagtcctccaggtacaaatcatttggccattttccttgtattgcttctcactcactactgaagtagcactgatagcatacctcaaatttgtaggaagccatctgacatagatccttctggaaaagaccccgagccaactgacacggagacgggtccttcaaaggaaaccgggccgactgccgaagatcgcccgagtgataatcaaccagcaaccgacaatgtagagactagcaatgagcccccgactggaaatcattctgccgaagctggagtcggcgctaatcaggagcccccgactagtaaccgactagaaaccagttgggtacagaacaaaataatgacatcccggaagtagaagctcaaactaacagccctcccaagacggacactggtgctgactctggaactagttctcctgttagggtgcaaggacctgctcgtcccagaccggaaattatcacaggtaaactagtcctccaaacctgctttgattcgacaacctttattcaattacttcactattactcatgaatatataagggccaatgattggtgatgaagaagaggtcctccgggtacaatcggctgaagattcccgcccaccaatattagtcaagtggagggatgatgaaatgcggccacaaggaattgtaataaataagcagagggaagatgaggaagtatgtctactgaaaaagacactgggccaagctactcgtcttgtaaatgtaagtccactcttacagaacctcaatcatcctgtcgaccactttacttgaacagggataaatttgtggtgtagagaatccatcttaggaatgaagcgaagacagcaaccctcgagaagttagttccacaccttggaacccttgaagccaccagagaccagctgcacgaagccaaggagcttgccaggaagactgagcatgatctgagagaccgtatcaccaagcttcaagactccaatttctcgataagcggctcatcaaaaggtaactctcatccttgtctgactcatttgatgttgctatccatatgctatcaaccaacaagaagcaatacagtgcaagccgcaaagatatccgatctggaaaagcggatcaaggctctggaaaaggataaggatgaattgacaaagcagagggactcggccttgaaagatgtcgaaggtacttgcagctggaacttcaaaaaatcactcttatcttcatgccctcttgctgatgtgaatgtacttgtgcagatcgtaaaatcaaatcctaggctcaattcgacgtcttggtcaacaaaatcaagaggcttgaaggagctagagatgaagtcgccaacgccgctacaccactcgtccaagccatgttcttcaataacaatggtccgagttcatttgacattgccgagatcttcgacaagctgagaattgctccggatacatattttaagaatatcaaggaagctggaagcatgggagcaagcctggcgttggcgatgaccaagtccttgtacccgaagattgatattaatgccattgatggctttgcagacgggacaagcaaagaggctgctcttgacctcatcaatgatgcacaaatagctgctgataaaatagctgctgacgtcgttgagagattctaggacaacgacctccagccgactagatctaacaattctgatgatgaaaagactgatactgattgatgttgaattctaacaatgatgatgacgatgatgatggagttacaatttgtacaatactgatgaatttatgctgtgcttgatgatttaaactcagctcctgatttcttaaaagtttttgtcaaaccttattgagcctagaactcgcaaaagttgttgaaaaactttcagtcctcattgactaagccaaaaaatcaaacaaggcaatgataaatcaagtaagcaaattgaattgataagagatcacactccattattattataatagccccctgataacttcaagtacaaacttgatgttaacgttcaaagaggaaaatacaaaatgtaatgcctaagcataacaacgacggagatgttcaatgttccgagagttgtcgacatgagtaccgtcttcacgtttgagtcggtaagaacctggccgagtaacctcagaaattatgaatggcccttcccataagggagataacttgtgccgatctcgcgtagtttgaatttttctcaaaaccaggtctccaactaagaaagcacgtgatcgaacattgcgattgtgataacagcgcatcccttgtaaataccgagccgattgaattaaggctgcttcacaggctcctccagtcggttgatatcatctactcggtcttctccgtagcgctcctcgctgaaattacgaaatcgcagcaactcaaattccgcttcgcttggcaacatcgcatctgctccatagactagaaaaaacggcgactggcccgtggccagactgggtgtggtgcgcagggaccaaaagatagatggcaactattctacccatttgccagcatagggatgtagtcggtcgaaaactcgtgtttttattccttgaagtaccataccattggcacgttcgacttgtccgtagctcatggggtgcgctacagaggcataacaaattttgatgccgaagtcctcacaaaaatctttaaatactccgccagtaaactgagtgccgttatcagtgatgatccgattgggtaccccaaaccggtgcacaatgttgatgaagaaatctctagccttgtctgccgtgattgtgatgaccggtttggcttcgatccatttggaaaacttgtcaacagctacaaagagatgaatataaccaccgacagcctttttaaacgggccgaccatgtcgagcccccataccgcaaacggccaagacaacaggatggtttgcaactcttgagccggtagatgagtctgccgggcaaaaaacggacaaccctcacatgttcgcacaattttgtcagcgtcggatacagctgtaggccagaaaaaaccttgccgatatgccttgccaactatggttcgtgcagcagcgtgattgccacagatgcctgaatgtatatcctttagtaattgttttccctcctccaaagacacacagcgttgcaagattcctgatggacttttcttgtacagctcggtctcatgtacaacataaagtctgctacgcctggagatccgctcggcttcgtctttatcttgagggagttcttgtttggtcaaaaatcttatgaagggctctctccagtcggcttcaatcatgtttacgtctcaggcgtccgtggccttgtttatttcttaatttggtacgatcggctcataaagatgttcaacgaacacgtcggaaggagctgtttctcgttttgagccaaaattggccagtctgtcggctgcctcattattatgtcgaagaacgtgggttagctcgaggccatcgaatttatcttctattttgcgtacctcctgccgataggcagtcatgttatcatcaaggcaggaccactctttcatgacttgattaacaaccaactgagagtctccacgaactatcagatgccgaattcctaaggagatcgcaatccttagcccgtgaagaagtgcctcgtatcccgccacattgtgagacgcagaaaaatgtatccacaatacgtagctcaacctctctccagtcgggaaaattagaacaacccccgctccagtgcctgaaagcctctttgacccgtcaaaatgcatagtccaatgctctatcttttccgcaggcgtgtcttcttggcacttggtccattcggcgacgaagtctgctaaagcttgggacttgatcgaagttcgcggcttgaaggatagatccaaagacatcaactctaaggcccactttgtgatccgcccatttgcttcgcgattgtgaagtatatccccgagtagaaatgacgtaaccaccgtaaccgagtgaccttgaaagtagtgagataatttcctgacggtaatcaaaacaccacataatagcttttgaacttgaggatatcttgtcttggagtcagccaaaacttcgctaacaaaataaattggtcgttggactttttggatatggccttcctcctcacgctcaacaaccagaactgtgctcacaacctgggcagttgccgacacatatagcaacagcggctcttgcggatgtggcaaagccaagaccggtggagtagtgaggagtttcttgaagtcttcaaaggctttttgtgcttcgggcccccactggaaattgtcagttttctttaacagcttgaagaagggcatcccccgctcgccgagtcgtgagacaaaccagctgaacgccgccatgcaaccagtcaactttagaatgtctttctgagagctcggcggtttcatgttgagaatggcgttgattttctccgggttggcttgtatgcccctatgggataccataaagccaagcaacttccctgacggtactccgaagatgcacttttcagggtttaatttcatcctgaaagcgcggatgctcgcaaaggtctcttctaaatccgtgatcaaatcatccttctgcttggtcttgacgactacatcatcaacataggcttcaacgttacgaccgatctgagttgaaaaacatctctggattatgcgttgataagttgctcctgcattctttaacccgaaaggcatggtgatgtagcaatagaccccaaagggtgtaataaacgaagtctttaaacagtcggactcctttagtcggatctgatgatatcctgagtagcaatccaaaatgctaagtagttcgcagctggccgttgagtcaactacctggtcaatgcgaggtaacccgaagggatctttgggacaagacttgttgaggtaatcaacacacatgcgccattgccccgtcttcttccgaactaggattgggttggccagccagtcgggatgaatgacttccttgatgaagcctgctgctaacagcttggtcaattcctccttgatcgcgtccttcctatcttgtacgaaacggcggagtcgttgcttgataggtttagcatcttccttaacatgtaaagagtgctcactcacctctctaggaataccaggcatattagatggtttccatgcaaagatatctttattattttgaagaaaggtgatgagcgcgctttcctatttacaatctaactcaacgcctattacagcagtcttagtaggatcagagggatcaagaggaatcttcttggtcttggcgtcgccttctccgctctttgtcatcttggttgcaggcacttctccttcggttgctgtggacgcggccagtcggatctcttgtcgggcgagcgtgatctcgcgggtctgggccatctcgcagctttccttgtcgcaagtgacggcttgcttgatgtcgctccgcagggatatgactcctcggggacctggcatcttcatcatcatgtaggtgtagtgtgggacagccatgaacttggctaacgccgggcgtccgagtatggcatggtacgctgtctcgaaatcagcaacttcgaagcaaatattctctgtgcaagagttctcccgagtaccgaaagtaaccggcaaagtgctctggccgagtggagtagaagacagcccggggatgacttcgtgaaagggcgcgttactcggtttcaattccgtacaagggatctgcatgtcatccagagtcttggcgaaaaggatgttgagtgcactgccaccatcgatgagggatcgtcaaagcttgacgttgcgaaccactgggtctagtaccagggggtaccgccccgggtggaccactcggtcagggtgatccgagcagtcaaacttgatagctatctctaaccaccaaagatattggggtgtgccgggctgaacagcattgatctcccgttcggtcagcttttgctttcgtttggattcataagccaagggtccaccaaagatgtggttaagttccttgcgatggtcttgaaaaccagtcggggcatcatcttcatcatccttcttctttgacgtgctttgatctccgtcattcgtcttgcgtgcgttcttggcgtattgttctgcaaactgcttgtagacgaagcaatctttggccgtgtgattggaatttggatgatgtggacattgggagttcatgatcttatcaaaagtgttgacgcgcgaacgttgtcgggaggatggtgtagtggttgccacaagttcctcgggcttgcacttatgattcttgtgattggtatttccactccccccctgtggtcggcatatctgtcttcggcttccaagtagtgcccgactgcttggacgcggtaatggcatcttcggctttggcatactcattggctttttcgaacatctgcttgaccgtcctgggaggcttgcgcccaaacttgccgactaggtcatcgtggcgaatgcccttagtgaaggcggcgatgatgacgtcatcggtgatgtcggagatcttgttgcgttgctcggaaaagcgccggatgtaatctcgaaaggattctccggacttctggacaacgttgtagagatcgaactgagtgccagggcgttcaaaggtgccttggaaattggcgatgaagtggtcgcgaagttccgcccaagatccgattgtgccacggggaagcccgtgaagccaggaccgggcagaatgcgctagtgctacaggcagatagtttgccatagctttgctgtctcctcctgctgcgcaaattgcaagaccgtagacggtgagccaagactcagggttagtggtgccgtcatgcttctcgattccagtcggcttgaagccggccgaccaatccactcgacgcaggtcgcttgtgaatgcagcgactccatccacgtcgtcgtcgtagcgatctggtgaatggtggggacgtagcctctcgctgcgcggcgctggttgatagtttcgcgaagatcgatgggacgcctgcgatgcggggagcggggacgttcagctcgacgctccctgcgtcggtcaggaggcgagtggacggatcgctcgttgtggtccctactcctgcgactagatccggcaccgacggcgctgaggctcggttggtgatagtcttaagatcgaagaggggggactcgactgccagtcggtgtgcgaatgcttgcggagttaatcgggaccaaagttgcgatcatggtcttggtctggttcaagatgttgacgacgtgattggcttgattgagtgcgtcttccatgaggagggtgtcgaggagggtgatcgctgcaaccgcgtctgttgaggagtgtgaaaaaccgcagttcccttgacgtcttgctgcccaatgagttctcgtgctcgtcacctggcatccaaggcgcgttgtcgccggtcctcagcctcctttgcagcccgttcgcgctcctattgctcatgctgcagccgttctcgctcttgtgcttggcgctcctcttcgagtcggtgtcgttcggcttccttttgtacgcattgttcttctgcttcccgggctttacgctgttcttccgtctcgttgtcggccatgaaaatgccgaagtagagaggcgtgtaattatcttcaaagtcttcgccaaagtcgtcgaggttgcggtagtcgtagcggtagccgaagtcgtcgtactcaatgatctccgttggccgtgagtcgacgccgggggagctgaggtagccatccagttgttccgtcaaaactgtgccgagaggctagagtatgacgccgacttccttagagctagactggatcggggccgaggccggatcccgcctagacctacgggaagaagacgcccttgtggtgaagacggcagccaaatcatcggggagtttcatcaggattgggggataagctccatcgtcttgatcatgtcgtgttatagtagattggatctcgtccgagtggtttgaggccaactcggctgagatgatcttggggtagatctaagccgagttcggaataccgaacggggcagagacctagcctcttcccgactggttcgaatccgagtcgaagagagaaatcttgccgaagtcgttggtgatgaagtcgaggctgccaaaccagaacgtctgcccgggtgggaagacgaagtcattgatgccggagacgaaacccatcgcactaatcctcgaagaacttgacgcggcccctacctggcgcgccaactgtcgaaacaagatttcggcaatactaaaagggggtggctatcaagctagaaaagtggatgagtttagagacaagaaattttatacaggttcaggccttcttaatcaagaagtaataccctactcctgtccagtgattgatccgccgagtgtattatagatcgtatgatctgggagaaaaatcgtaccccaagaggcacctggacccctccttatataggggaggagtccgtattacaaagtacagcccatatccttaacggaataggtagttacagataagatacaatcgtaaccgactaagatcccgggtatttccttgacatacaagtttggattttaacccgagtccctttaaagatagtatatctatacatggcaccccatacccagttggacatacataccgtgtaggtatggggtatccataatctccatagcagccgatatcgtcctcgttccgaccgctgtagaccaagccgagccgagccgtcgcgccaacgtcttctccttgatgtcctcctcaaaacccctcaaaaatcccaggcaatggcgcgattccgcctcctccggtgagccattgttcgtttactcgcgcacacaccatttctctggactcactaacctcatggacacacatgctgacatgcacgatagttcttggagccgattgagctgtcgccgttcaccccggaggttcttgccgcagccgagccgtcacacgagctgccgtcgtcaacttagcttcgccagccttgttttacatctcggtcagcaccctggactccttagaaagcacatgcatgcactcccttagtcgattcgcacctatggcacaacatgcctacccatgccaaaacatcctccgctcggactcgccgccgacgttactccggcgtcttttggtcgcacccccaaacgagccatcgtttgccgccggcgagctcgagatcgagctcggccatggcgctctgttctgtccaggtcgcagggactttggtttgagaatttaaacaattataaggttcaatatgaaaacatactaaacactgacatatgggcctaggactgcgggttggtttctagaaatctcaaaggcctttttgcatattgtccgtatgactgatagtggaccactaaaaacaaaatctgagattatataagaaaagtacctaaaagttgtaaaatccatataaaatcaaatataactctttttgagatgattcgaatttctgtgaactcaccaagtcattaactttaatgttaaggaataaaaacttgcactcacagtacaaatttcacctctaaaatttatctaagaaaaattatacataaagcatacacaaaattataaaatgcatacgaaattcatctcaactcattttggggtaaattaacatttcacagactcaccaacttacactctctggtatagtgaaataaaatcatctacttactttttgtcaaatgtctctaaaactagtataatcaaaataattagttttctgtaggctgaactttagaagtttatataaaattcatcttagatcctttttgagtaaaccaaagttctgtagaatcaccaaaacatatacttccaagttataaaataaaattatgtacttactttataataaaagcctctaaatatttatataagaaataaccaacatagaatagcctttaattgtaaaatttgtagaaaattcatctttagtccaaatggagtgaaccaagtttctatagaaccagaaaatagtgagcttcaacatagtaaaataaaatatggcaccttttgtgcaggttatagctctaatctttaaataggtaatctaagagttaatcactgttgatgcgaaaaacacacactggcctggaagatctgcttaacttcagtgcaggtccaaaatcttgcttttaggttcgtgagcgtgccagttgatttgatcctgcaatcaacaagaaagaaagacaaaaaaaaccgcggttaaatccataaacgatagccgatagtctagttgctgatgacatatcatttatcctcgagtcgatgtcatattggaatcgatcggcaatcataaataaataagatagaactaaatctacttgatcaggtatagatattaacgatgtataatccttccttcgatgtatatttaaactaagtgattgggatagatcggtcaccatgccgagacggtataaaccacttaagtcgaagtatacattaaagcaatgattatataaacgtttatagcataaccgaccagatagatctagcatgtatcagctaatactccgataccactttatattaagatattaaaatagacagaatatatcaaacaagaagcctaatataccttaatgcttggcggatttgctcaacttccctttccgattaaaactagggtttccttaaccgattccgttttggccgttaccgcactcccttttaaatagtaaccactgctttgctcgtttcacggcgtcagctcccgttttaaccgctctagtgaaaaaactttccccaatctcttcctcgagctctcccgcgacaccttcgaagtttccggcgacccaaatgcgattctctgcaactccaaccctcaccgccggcaatgtcgacgtccgcaagtccaccaagcgcatcaaccgccgaatacgtcaaggtaagtacctgtaacgccccgattttcggtcggaattaaaaatcatttaataatgcattgtctagaaattaaataaaagataaatcaatttaatcaagtgaaattatggaggaaattaaaatttcctttaaaaataattagccgagaatattttgtaatattctttgtgccctaatatattctccggaattttccgtgaattttcggagctcaagaaataattttaatagcacaaagttcattgaatcaattaaataaaaagaaaacaaattaaaaactccccttcctccttgggccattttcggcccaagaatccttcccctcctccgcggcccgcgtgcgcccctccccctatcgggcctctctctctccccctcggcccgctcgcccttgaagtctaaataaagccctagtccctctctccctctggccgacaagtgggaccgcgggacccacttgtcaggtccatccccaaccatcctccatcctggccagcaaccgcccgaagccgccatgccgcccgttgccgcccacgtcgccgccgattccggtcctcccgctcgcgccctcgcgcccaaaccacataaaatcggttcccctccacctcctccaccaaatcccccacttttcccaaatttttggcgccaaatcgagcccccacttcgcccacgatgtcgcccacgtcgccggccgttgccgcttcaaatccgccacgtccggccactatttctcctccccgagcctataaaaaccaccctcgtgctctcctcttccgtttccccctcctccccgagctcctcgcaccctctcctgtgctccccgcacgaggccgctctccgccgctttccggcgagctccggctgcacgctgtcgtcgccgtagccaccgccgcgccgcgccgcttgcaccgccagcttcgccatgcctcgccgcacaccggccaccgctccatttgcacaaacctccgccgaaactccccttccaccgtgcacccgagccgccaccaccttaaaccgcctccagccgcatgttgtcgccacctgagccgctcccgcgccctgccaccaccgcagccagcttcgccgccccgcgggcaagcccggtcaccacgccgctcccccatgatacaaaataactgaaaccaaaccttgacatgtcgaccagatactcaaacctaacccactcaaatatagacaaaaaaaatacaaccttaatatataagtctcaaataaaatataagttgtagcaaataagatttcccaaataaaacatggttggatttaattttattaagctctccgtgattaattacgctatgtgaaattttctcagaatttttaaagctcaatttcgaattttaataatattgacaacatttatttaaataaaaacactcctttctattgggctgaaaataaaaaccctcctttcttttggaccattttcagcccatctgagttttcttgcctcgaatcctactatgccccactaatgatgagatgttaccgttccgttttaaaaggaaacaatttttaatacatcataaaagaaaaactcatcgtacatataaaagaacatatcaataataggctcagtttagatggaagtggttggtagtaaactcctatcactaagttttgatagtatatttgatatcttttatgtaacagttaatggttaaagtttccacttaacaaccgtcaacaagggtgtgccacgcgtggcacggtggcggtggtgcgagactgcgagctcctgcctcctgctcgacgtggtgactgatcggatgggcgcagcgacggtgagggcacggccgcagaagccttttcctcaacatgatgcggtgacggcaggcgtacggcgcggagatggcagcgacagccatccataccccttccgtctcctcgtcgacgggggtatggcgcgaagacagtgacgacggccgtccctcccctctctccctctcctccttagcctcttcgtttctgccatcaaatcagggagacggtggcggtggggactggagctcgagggagatgacagcggatccaagatgacgatgacgacagtggcttggttggtgagttcagcttgatccgctaatttgtttgattcgtcgatttgttgcctcgtgatgcaatattcactactatataaacacgcaaagatgtccgcattatagataccggaatggctaaaaccagcacatatagtgcatttctggcctaaacacatgcccatggggatgtcaatagcaaaaaccgtcagcttagtatacaaatagatgccgctcataggtgctggttccggttaataaacagacacttttatgcagattgagccgatattatccaatcgagccgtgcgaacattttttttctctgccctcacttctcctttatttttcgcccaaccctccttttctgcacctgcacatctttttcttttttccttctctttttctgcgcctcctcttttgccacctccatcctctcttgcctcctctcccgtctcctcaaatactaagtgacgacggcggctactgctgctctccctccccgacgtggtggcaatggctgcgaccctctcgccagttgcccactcaccttcctgacgtgcagccgatggcggctactactcccccccccccccccggcgtggcggtggcggctacttccctccctggtgtggtggcagcagctccacccctccccccaactgacccctcacctcctcgacgtggagctgacggtggttctctccagcatggcggcggtttgatttgtgaatattttgaggattttgtgttttggatgttgatttagtacgacggggattaagtttcttggggatcaaattcatgagctctagattaaattggcttttccgtgctgtattttgttgtgtcgttgattgattgatttggggatctaccttgttttttttggacgatgaactcggactcaaaggatggacaaaacggacgaagggaagccttataaatatttttctattatatattactagaaaaactgcccgtgcgttgcaacgggaaaaactaatgttatgataatgattataatttattttaagaaagagacaacatattcttcacttattggataatctctgctacttaaaaaatccatattgatgatggtgaagccaacacacacgatccaacatagacacgcgatctattaaccatgcatggataaaaaatcgaacgctgcagagcgatcccatcgtgctcctccgcaccaccatcgcgcgactcctctggatcgcgatccgcactcaacaagaaaataacggcgcccctaatcccccaacgatagaaaacactttcaggtcttgttcgatttggaggggattgaagaggattggagaggattgagggggaataattccttaccacaacatgtgtggaatgaattctctccaattccaccctcacgatgattaaccaaacaagaccttagtgggcccacaaccatcgcgaacgatcccgtgcgtagcaaatagatctagacagcgggcagcccttctccggatcgatgactgcgcgcgcatgccgatgttcagccgttgctcgcacgttccttttccgtggtcacctggtttgtgtctcctctccactccgctcaaccatcgcgattaattcttagatttctcgatcggtccatggaggtcatgcccgatccctatcaacccagagaacaacttgcagtttccttttcggtgtaaatcttgtcgaagttagcctctgatttgtttgaattggacgacgacgtgaggtgcctcgccaagtgatggtcatcgctgcctgcagcgcaggtcgctgccgcagctgtgagcacgagcagcgccgtcgctgcgcggagagcggctgagcgacatgagcaccaccccccagtgtgctccctcggccaggtccgagaaagtcagcctcctcaggatcttcacatagatcaatcaaaatgcaagtgtcatggcaagcttagctttggaaagcttttgtgtgtcgcagactgtatgcgacaacacagatggccacaaggatgtactttcattttgatcatatatattttatatgtgcatgcataattgattcttaattaataagatagagttaacacaatagccaatctattgtattggttgtctgtggtataaactacaaaataacacattacttagagcaaacaactagccatgctattgaccttgttctaagccgataggagccgagcacaccgatctcgattggatcgatcggattggcttccagctatggtgtgcttgaattgcctgttttagggaagaaggggcggaagaaggggggagagcgtgatgcgtgacctgatgagaagggaatggcggccggcgcggcgagtgtatgcacgcggtatgcctagagagcaggggcggtaatggatcagaagccatgaaccctttcccaacccatctaaaccttaagaacttgtttgtttaattcctaagaaaaagggaattaaggaaattgagggggaaattgatcgggtcttcttgttcatctcttcatgtgtacatggaaaaatgaagaattacatttgccggctattaatgtaagtcctgactggcattgatcatttgaatattatatcatataattagaaatatttaacttacaaagaaaatacatgtgcaggatggtgacaagctaatgcaatttttttttgctaaatctactgatgtaccaacaaaatgagtgtgaaagcaacatacctaatggcgcacgggatattattaagtgtatcacaaatacacaatattagggtagttatttacctatatagaataatttaatttgaggtgatcatccatgagaaataccatatctgaaaatccttaatgttctagatttaatgtttgtgctttaatttgtatgacatcatcaaattttcgtagcaggcttttacctatgttgcctttttataatttaataaacactgtaagattgttttatgcgacaaaaagcttggattatgcttctgtaatgaaaacaaatttcttgcttgaaattaatctacataactattatgatttctagtttctttgattgccagattttttttcctatgttcaacaaattttcactcaatgattatttaatatcttttcacttaatataatttgaaattgatatacaacatttcccgttgcaacgcacagtcactttactagtaacttaaaaattcaaactgttttgcatttccatgtatccctgaactgtatggttgattcccactagccaacaagatctaaaccatcaagggtgtgtttggataatgggaaatgaggggtggggttgagatagggaaatgaacgaagggttaggattaaatagaagagggagaatgaatggttaggatttaaagatgggtgggaaatcattttccttttccatttgacaaacactgcccgaggttatggattttgtcaccccttctgacaggaactatttatcctaattgttttctgaatctttcattaaaatagaatttagcaaaatttattttagatgtgatcaaattttgattaacattttaaattaattcaaaccaaaattaccacaatttccaaattttcgatcctatctgtgtcggagagaggaatagggaaaccaatagcacgtacacaagcttacaacaccggtgatcttgtagtctaattttgtcttaggcacttagctccttgaatggagcacaaccaatgaacctaaacgtgtacgtgaaatgatcacgagcaagtagggctgtcaaaaaagctcgaggctcgcgagctgcttgagcttggctcgctgtagactcggctcgagctcgattcgtcaacaatttgagccgaactcaagcctagctccaagcttgcgagcttgacgagccgagctcgaatagctcgtcgagcccagatttccctctcttaaattttcaatgcaacagctagtactactcctactcccaatgaaaagctgtatagaaacacagagcgtgcagggctgcaccgtgcaggcactagcctactagtactactttactctgcagcactagcctattagtactactagcatacatgcagctctatttaatagtactactagttgtcatatcatgtttgaaaaagctactagtactagtagtactcgacaagcatgcatgcagcctcctttcatctgtattggttatttgagggcacacgagttaggctcgagaaagctcgaggctcgagcgagccgagctcgagcccatttctaagcttgtagtttaaacaggctcgactcgagctcggctcaagttggtgccgagctcgagcctatataggtaagctcgcttgagctcggctcgttgacagccctacgagcaagtagtaaaaaaatcaacacgatggagagaggagcatgtgtgtgtgttctctcttacttttcaccgctgcatgcaatgtatttagatagaaaattaaattttcgtctctccacgcaaggaagtaaaatctctactacttaaaaaatacgaaacgtttccttcatccgtcaaaataaaataaatagcgaaaaaaaactatctaaactaaaaagtccgattcccagaagatgtggcaaaaaataaaaaaaaaatacacccttaaaaaatccgattccgagaagaagtggcaaaaaataaaaaaaaaacgtagaagtccaattcccaggggtagcgaaaaaacaaaaaaaaaacgtaattccccttaaaaaggggaaaacaaaaaaaaatcggagaaaaatagcgaaaaatctttaaaaaaaatccgattccccctataaaaggtgaaaaaaccaaaataaatctgtagatccgattcaaaatacaaaatgtttccttcgtcagtcaaaataaaataaatagcaaaaaaaacaacctaaactaagtccgattcccataagatgtggcaaaaaaattttaaaaaatacacccttaaaaatccaattctgagaagaagtggcaaaaaaaattaaaaaaaaatagaagtccgattcgcaggagaagtagcaaaaaaacaaaaaaaaaaacgtagatccgattccccaaaaaaatggggaaaacaaaaaaaatcggagaaaaatctaaaaaaaatccgattcccccgataaaaggtgaaaaaaaccaaaaaatgaaaaaaaaaaaggcgaaaaaaatcatagatccgattccccttaaaaacaaatgggaagaacaaaaaaaaatatgattcctatgaaaggcaaaaaaacaaaaaaaaatccaaaaaattaggtaaaacattaaaagagttgcgaaataacggttcgtaaaaaataaaaaaacacgcgagactgtatatatcttttctctatctctaatcaaatcaaatctaactatataaaagagaagttttcatcgtacaactaaaaataaaaaaatacgcgataaaataaaaacggttttaaaaagtgtaagaaaaaaaaaagcaaaaaacgcgtgagaaaataagttagaaaaaagcgcaaagaaaggattccgtcgtcctaaaaaataaaaaaacacgcgaggaaaaatatttccatcgtccgtaaaaaataaaaaaatgcatgcgaggaaaaaattgtaagaaaaaactgtgcaggaaaaaaacgtttataaaaaaacaagctgctctaaaaaaatgtcaaaaaaaaaactaaattgatggacgcttgggtcggatagaatccttcaattttttttccatctcctacacgacttttatttcgtcatttatgctcctatattagaaaaaagcaaaaaaaaaacactcgagaaaaaacaagcaagaaaaatgcgcgagaaaaaaatgtcagaaaaaacaggcaaaagaacacacgagaaaagaaggcaaaaaaaacacgagaaaaatacggttttcatcgtctgtaaaaaacagaaaaacaaacgtgctaggaaagaaatttcagaaagaaatgcaacgtttgtgaaaatggtttgagaaaattgcgcaagaaaaaaacaccgtttattgaaaaaaagccactctgaaaaaactattagaaaaaaacactgtttataacgaagccaaatctaaaaaacaatcggattcaatgcgagaaaaagccgttgtttctacaagtggttcgagaaaaccgtccgactcaacgcgagagaaaaacc

SEQ ID NO: 32299 - DNA, 13229 bp, Oryza sativa
  unsure (1)..(13229): unsure at all n locations
tgttagtatttagagaagagtgcacagtgactctgttttgatagatttgaccctgcgatgcagtgtaggatttgatttgatttgatgttgtcatatgaataatctaattatttaggtaaacaagcatcggtatggttgacatcgttgaggttgggccattagattgaagatgttccaattttctgaatgtcttagcaataaatgatccatacaaacatttgcattgacacggttatgcatgataaaatgtatattatcattataatttttcacccgttgcaacgcacgggcatttttgctagtaaaataaaatgtacggacatgcctgtgtactaggtaaaaaaaataaaatggacatagaaaaatgcattttgttataattcttaaagaattacaataatacaaaatccttagtgtgcgctccacggcctataggcaaggtggatctgacttgacaattatgtttaccaggttcccgtggtttcggaagacaccaggtcaattatacctccgattaagctacgctggtcatcgttgtcggtcttcgcttcatgttctgccatgcatgattgtgatggtggtgatagtgtagatgtatgtgggcgccatgaagaggtcttcagcgagagcatgaatgacatcggtggtagcgttgagcctgagagtattcttcctttacttaagtctatatttcctcccaactttgacggtttatcacctacattcaaatatacaccaacactcctggaatatgttagaattaaaccctactactatgttggatgtttcattaattatgttttatgcaggtattggcggcatagaattagcatttaacagccgtcaacagaggtacgactacaactggtcttcaaccagcggcgtagagattcacccactacctctgcgatttgttgagaacaactacacatctggtctttgcccagtgtggtggtcgtctcattatcccatgtgcgtcaacttctgtaagtatttatatgtgcaaaatttgttcgttgatccccttttcttatatcgtcgtgtcttgaagtcgatcatattgttcctttacgctattctgacagcctccaagaaacataaggggatttcgtctagggacgcgcgcccagagctgataagtccttgtcagatgcttcagagccaaacgaccatgtcatatctggtagagtgctccgtagatgcatattaactgagccatggattcgtcagcttcagcttggtttgttataagatttaagctgccttttggaaaatgacttttccataaagccaactaagggtagctttggcgagagtactcttttatcgtcacatgcagattcaatttattttcaatttttaaattcatattatattgtgttacccttgagcgttcgctcgggggctatttcaatctaacaatctgttctgagtattgattttaggaaagtcagatatcagaacagttaagtcagattttagggctttgttgcagactctacaactactcgattatccaagaatggttggtggattacagataaagcgattgtgtatctgccgaaacaaaattccttatgttcaatccaaattctcgattacgataaaacaaggaatttagtcgcatactccgcattttctcggtcgtctgagaatgattaaatgagcacaacaactgttattccaaggtattcgatcgagatcatcaactcgttcatttgcattgaagtcggggctactgtcagggttatagataacacatacccaatagtaatcgactaagctcggcggggcctaccatataccaagtcttatatggaatcatacctcgtatatataaaaggagttctggataaggaatgacaagtacagttctacgtggaaacaataaggactactcagattgtttctatattggtctccctagttctacttggacaaggggacatatatgggtataaatacaagacccctaggaagagagggggaaaaatagtcagaatagacacgaatacatgccaccaaacatcaatatcaaagattaacctagacaaacccaatctggcgcctacataggccaacaagagggatctagcgctatctttgatctcaccgagtatgtattgaaggaggnggactacccggtcgtcgattaggtgttggtgtttcaagccggcaagtcgacgacacacttagataggttatctcaaatattgtacttgtgtgattttgatgaataagagttacaccggcttcggccaacatgagtagggctataacntgattctgatgtataaggggcctgaacctgtataaaaatccttgtctctggctcttttacctcaatctcgtatatactctggtaccaacgatccccataccatgcaaataccgtagtcgtgatctaaaacgtcgacaatactatatctatttatttctaatttacaattataaatgatgtggtggcagcagtgatgcacgcccgcaagagacgaatcgtttgcaagaaaaaggaccctagccgaaagaagctcaaaaaaacaaaaaggaaaaaagaaaatcaaaaggtcgcccacaatctttaatccctccccgtccccactctccaccaacccaccactcctcgttccaatctcgaatccttcgagcaagcagcctccggttcgctacctccacctctgcctctgccatgccttcgccttcttctttcctcctcatctcatcctccgcctcgagcgcaccctctctcctgctcgttgtgccgttgctcgactcacacgcgccgctcggccgcatgcaccgcatcatgctcaatgccacgaccacatcacgccagccacccactgtgcatctcgccttatccccgcgccggcgctaggcgaatcgcaatgatgacggcaaggaggacgagaaggcggcagcaatgtccatggtgatagtggatctggtagagtggccatggcgacggtggatctggaggaggacgcagctagcaagacagaggctggcgatgggtggattggtggagggcaccaagcaatgcgaaggctggcgacgaccacatcttttgtggatcttgttgtaggtggcggcagaggaaggcgcaggcggcaatggtgtgaccacgacatcaagtggtccaacactgttcatctttaattggggctagctgccatcggtctagtgctgggcttgaaggagatcaagtttaaggtggatcctttactgattttatttgggtgaaatctggttcttgtttttgccttatggttgtatcgaactatcaaagtctgattttggtaagtgcttccatgagattagattattgtcaagattttgttgttatgggttaccggctataacttggtttttctagtctccgattggaagaatcggacattgatgacacaaatgcgcatacaaaacggattacaaacgaaattttttggtgacgaacggaaaattactagtcttttaagtaattaagataagatataggtatagacgaggacaggacaaagtgttacaacggacaaaatgtagacatactgcacatgatatataggctcatatttgttctgtttgggaatttcagaattcagattgagcacaataagctcatcttctattcggcttggtggcatggcctagtaccacataggtacaagggtatttgcgtaacaaaaatccggtacctagttatcgtatctgcaatagtactcccttcttcgcaaattgattatcatataataaaatccaaaatttatcaaattgattatcatataaccgtatagacatggatttcatcgaaatataattaatgtcgtaggagataatgtgcgcatgctaagagtgtaattggcatggtgttttacttgaatgagggcatggtgtcatgattgatgcgatttaaattacttttgctcttggtgcataaatatatatgataatcaatttggaatggagggagtagctcttttatattaatttgagcgttcagataatatcacgagtgaaatatattttttaattcagtggaatacaggtgaggtggtgtttataaatgcatcggctatgatcttgtacgccctttccgatggatggacagcatcaaagaatacatatttatcagcatcgtcgcatgccaacgcatcgtccaaggcacatagaattcctgtctccacaaatcccgtgccacaacatccttgcattgagttcccaaaacctgatttgatcacaagaaaaaaatataattcggagtggattagataatttaaatttttaggatcatacgtttaatcatggagaataggattacataacttatatgctcccttcaatcataaatatttgacttttaaaataagattttatcaaacatttaaaactttgatcataattaatttctcaaaacttagttttaaaataacaaattaaaatggcatgcatagattttcttttaagattactatcataagaccctaaatttatttaatacaaaatatatagtcaaaatttccaaattttgatcaacgatctcatggttggtttctggctaagtaaggatacataaaattgttttgcgtaggaccattagattttagtcttagcgaattaaataaagccaatgctaaaaaacattgataaaagtacattaaataatttaacattaagtttaaaattttaacttttgcttgtggcttataaaccaacaagcaaacagtgaggttaaatattatgacaaatgtcaaatatttataaccaaatttcattgacacgaagaacgggttacatgcctaggcacacttgagtatcttgtgtacaacccatagagacacccggagacacaatgccacagggttaggtactactgaacgatcactcgagaccgatagagaacctgtcatcgtgaacacacaccagtttgacttagactcggtggatagctaggacaacctctaacgccatagagacgagagagacaacgagtaattaggggatatattggaggatgaatagacataggatgccagaagaaaggagggatatgtagatgacagaggtatagataatagactgattttgacgattgattgttggttgatcgagcttggctcctattttatatatataggagggatggtgttgcacctaaaggatcttctccacatccgattgggcttatgaaggtgttacggaagtgttaagactcgggaaacttagatacaatctcgaagtaggtttaatatatccaaaaggttctgaatacaattaacaatctcgaactaggttcaatactgggtactgaactactgaccaaaatttaatatgaagcgaagtgcattactgggtactgaccatattcccatggcttggcaatgatggcagagaggatgctgtactgatcaacatactctacttgtgcccctggcagctcccagttgagcctcccaataagcctcttgagccttgcgttgaagctcagagccaccatgttgtacatctcgttgcaatccccaggcctgtccgggttgatcgtcctctccaccggcaggcaccccagcggtggcagcccggcgagcttcacccggcggccgccgagcccgtgcacggcgcgcaccgccccggcggcggcgccggcgaggtaggcctcgtagcgcggcagggtgaagcggttgcccctgatggggaagacgaggtagttgtgcaggaagtcgctggtgccgacgctcaaaatgtagagcgcctggcttatgatgtggtgtgccgctgcctcgcctttggcccacctcagcttctccttgtactgcctgagtggtctatctgctgactcagggtcattgctgactgcaaattagtaaaacaaatgacaagtactgcattaggttatggtcttgtcataatgagtgcatgcatgcatgcatgggtttgttagttagtccaagttatggttcaattaattctcgtgtactcccaccgttccataaacaacaaacttatttcctggaggagtattagtatttggttctacacagggccacctaactgcagttcgatcagtctactgcctgacactgctaagtatttcctccattgtattttctaggctgttaattgggcaagaattaagataagataatatcatatctcttctctactagtataaaagtttaacatgtttttgtcaaaaaaagattctcaaggccagtctaaaatctattactgttcacttatcaaaaatctctactcttcgcttgttctactcttcgcttgttccaagagaagaaaaaagaaaaggtattacaggtaccggatagaggacagcgagcgagctgacatccggccaggcctacatgggccacgatctagataatgttttctttttaccagaaaggtaacgtgtaatgaccaactataatctctactattataaaaattgaagatatttttatcggtattttggtatgtcattcgtatatgagtcagcttttaagttcgtttgcttttagcaatacatatccgtatttgagtcggttgttaatttcgttggctcttagtaatacagaaggaaacatataagaaatccgtttaaaaaaaacttgcatgctaacttgagacgatcaacctcaactgcagtttatgatttctaaaaaatatatacatatatcaaagcgaatttccacatcttaattaaactatataacaataataagattaaaatagacttcacccgttacaacgttcggtcattttttttctaagtcattaatcaaattttaaattttgaatcggttagattttcttcatatacttctgattggttgaaagtatacaaatttgccattggaatcagtgccacagaaatacgtggcaccaatcttgattcctaaaaatatttatactttagaatggtgggagtattaatttgtgcactaaacaaggttcccaggttcagtttcttgcttttggataggccatgaagcatagttacttaattgtctcgagacttttgcagtattcttctaattaatatttcatattccctttatttgtcgcaaattaaaataactaagtggcagtggattttgcggttatcagttttctcaacttattacaagtataatgtggcaaatttgtcaacaactgatatggttttttctatcgtacgccaggtataagatatggttttttccttattcaatgcacagttcacgatttagtacaaacataaatttatttaataaagcttctgatttcaaataatttttttctctaaactatgaagacagaattattttttacatttactttgtacatttcaaaataatttacaacttttaaattgtccttgattattcctattacatatactaccaaatattattttcactgtcaattaaaaaacatattttatgcactatatttactgaatcatagaaatttttaacgttttattgaatttttttaaaaaaaacgttaatcgactgatggtaaccgcgagctgtaattagtataaagcagacggtactattaaacttctaaaaaaatatactttatttactactagtttgttttctcgataattgaatttaatcattgacgttaaggacaatttaaatcttggtgggtagaattataatgcatttactaataattatcatcgcgtcatcggggatagatctaggaagtaattgaatgaacaaaatagataaaagaaatatacacatagaagaaaatacaaccaaactccaacaacatttaaaaaaaaaggcaaaattgtttaaggagcaaatccccccagttgagacgttgcgttgttctttactcgatctgctcaagagggaaggagaggtatataagggcgaggtcaaatgtgtcgttcttatttagaattggcacctatgtctgatagcttaaaatggtgtcacttttaaaatgggttctccaatgattatttcgatttggtaaaaggtgagcccactcgaagaagtcgtttgttaataaaaactggttgtgccggtttctattaacaaccgtcacatagatgccggttatctccaatggtgtcccgcggcggcacgcgagaaaaacaatgtttctagaattttctacacatacagtgtcaccctttttttattgtaatagtgaacaacacttccctgttattaattagtttgttggctgatcaatgtttatacattttttttttggaaaaaaaaaagactttcaccctgaaagagctggaaagtataaaaggctagtatatattataccccgtactatatactcactaggatttgtgcagtgatgttgtctaggcccgttccggcggaggcgaagctgacgcccgacgcgagctggtggatgctgtggctggggtcaaggtacggcggcacggcgggcggcagccccagcgcctcggagacgaagtcggcggcgagccggccgttggagaaccggccggtggccacgccgccggcgaagtcccgcccgtacggcgggtagttgcccctcgccatggtctggatgaagttgttgttgcccgtgtccgccgtggagtcgccgaacacgatcaccgccgggacgcccccgccgccgccggcaacatggcatagcaggacgtgcgcgatcaccaccaccaccaccacggctttcatgccatgtcgtcgcgacgacatcttaattagtactcccaaattaatttttctctattttcgttctgggattcgtcactggctacgtgcaagtatttatagtgtcgtcgccgcgagcgacaagggcacgcgaacgatgagccgggcttgttgttcatccgtctccgaggcgtttgcttgctctacatgcccctagctgcaaaattttggtaagttctagtacagattactttttatctaatccgatttcatgatgcccagaagattgcatgcatgcatattgatcaatcttctgtgttaggttaattaattatgtggccgagcatgagcatgcatggtagccagaacagtgaccatagacggtagtagtacgtagtagtgggtagaccatctgatgatgctacagcaaccgatttttagttattggtattgatccactgatttcggtggatcattcaatgtgcgagctagcgaatcagatcgtctacgcttaattagacgtacttcatcagcgccgcgttgtaacttaaaggtcgagctgatctttcattactaggtcctgctataagttaatttagcaaatgtgcacttcttttgagttttgacgctagacaggctcttgtcgtcaataacttcatttacggtcgttgtttcaccttcatgttcttcaattgcaggtggagcaaggaatgtgaatggaggctggtaaatgccaggacaaaagctagcatacaaaccttgcccagtttcattttacaaggaagaattataatgtttacagctgccacacaaaagctgactatccttacaaacatacaggcgcgtggcaaagtttcaacacaaattgtagatcctcggaaaacttcgttcagctctttgcaccgtgtatgatcgcccggacaaagtcttcacatgtagtgtggccaccggagaacacatctggcaacgcacccatgacatcgaaggcctcctgcaagtcctcagatgaggtcatgtcttcgagccatgagagcacgtctttggagaatcctagcatctccttcatgttccccagcttttctttcatcataatctcccaagcttcgaggttaccaccacttgatccgtccttctcaccgaccttttgcgtgccagacgatttgcctttcttgaaaaattgctgcagctgctcaatcaaaccagtgtacaccagcatcggctggacaatggcaaagagcctcttgctgtcgtttgaatcggcggatgaaccttcatctgatcggactgcagaggaagacgtgtcggcagaaagttgagggtggatcgtccatgcttgtgttgcatgtaagcatggtagatgcccctctgcaggaaagcggggcggtgctgcagccaactctcataggactcagacagcagagaattgaccatcatgaactgtacagtctcctccgaggaacctgaacccccacgagctccagatagagctgaaagtcgaacaggagattctggagttgaaggcgaagaggacaagtacgaggtaacagccttggccatgacatgacgctgctggttggcacttccatctacaagatgagaagccatttggatcatgaaaggaagaaaccgcgagttgctctccctacccccacctttgcagtcagtgctgaaagaagcgcctgttgcaaacctggccaacatctagtgaaaacaaatgaagtttgattagttttgtatgtgcaagaggaatgtacaatgattacctatgaaggaaaatgccataacaacaaaatgaaattgacaggtccgatttgctgctctcaagttacctcgtcacaccaaataaacaagaattgaatgccatcaagtatcaaccagttttgcctccatacaaggcaatggcatttaggctaaaattggaatcatatcagagaataatatgccctacagcatgcattctatacaaagcataaaaggaagaccataaattacagatatttcagcttttgttgtcagtaatgaagcaaaacatgtcactttgatgacaaatttatctttgattttcacgaagacattagagttattttgttagccaggcataaagaattttagagttttgctgttgtcataaatatgttccagatggcatcccccacagttctcagcaaaaaataaaataaagcaaaagctccaacgaaacataagaaactagaaaatgcactttgtagggatgtaataatggcagaatgaatgaaatggaattccatacaatgtatacacgaggaaataagacgaagtcactgccacgtaccagaacaatgtcatatgttaacaagcgaaggcgacttccatctgctcgtcccagagaattcaattggtcccaatactggtcgagacatcgtgtgtactgcccaggaggaacagatggccccctcaagggaaagatacaattacacagtgtctcattatttctcagggtagcaccatcccattcctttttaggattcttcagtgcagcatcagctcttttagcctcctgatgacattggtagtgtatgatgttgaagtggctaacagtagtgtaaacacagtccccacggccactgcctgaactagtggcacccaagttcacccgtttactaaatgcatagactcctaacatgtcagtcggcctcaaagtatacccttctctacaaaccatgcatgctaacccatcctcttcttcttccacatcatccaagccttcaattataggctgagacacaacaatacgtctacctccatcagaagcaaattcttgtcgcattcctagcccctggtatacaaaaagaaggtagcaaaacatattaatttgtgcacatgcagaacaggagatcaaacacttatacaagagtacaagactctgcaaataatgaatgaaaccataatggcaacagttacctggagtagcatttctcttttcttgagagcacggcgtcgcatttcatcccttgtagcatgtcggagctcttgaatcttctctgccaagaagccatcaccattattttctttgttggcaagggtatccaaaagattttctgctcttgcaccaatttcattttcaccaggcactccttctaaagcatgcagcaatggcagaatatcttcttcatcgacacacttttgtgtaggcagatcacccttggcgagccccttcaacattgagaggatgagtggaatggaaggcagttttaacccaactgtccattctgcactagtcctaaagctagcctgccctgcagaagcaaagctttccctcagatgacctacagctgcttttgtaatgcccttctctagaataatctccttcagcctttcaccgcaagaacttgtcttgagtgactctgagactcgaacaaagttttcaacagcagacctctgcattgatgcgtttttgcttaaagtttcatcttttggattttcctcgtgttgtttctgcaactggtcaaactcactccagttcataaggtagggctcaaaatgcaaaacaagggcctccatggctgctggctccccatacgtcaagttaggtaagatccttgccaccatctcctcgtttctttgttgcttgtttgattttttggcaccatcaggagggcacagcctctcaagaaacatgagaacaattttctttgcctcctcaccagcaccagtctcctcagtagtagttgtaaaaacactttgggcaatacttatgtcactctcattagcttccattgtaagactttctacaattaatagaataccctcagctggctccatcgcatctactgagaatgcacgtctggctgtctcaagtagcaaacccaatgcacccaggcgtaataaagcacatctattttcacgaattttgcaacaatacttcagaaggttaaggactgaacccaattcttcctggtttgatcttaactcatcttcgcgtaggctctgaagaaaaaaggattttgagggcataattagattgtcaagcctcattaacaatagaaggattagatcagaaaattcaaatatgaatcccaactaaacacaatataagcctaaattataaaatattattagtacttaattgttctcaaatttataacttagcatgatcatataagaccaactgaccacctacgtaaaataatattcaaagatataatattttttcagaaatatcttacaaattattaaaaatgtgcctgcatatataaatctgtacagattaattgatcgtaacatgttacacgggcaacaaaaaaaagaccgatatcttaacattattacctgaatcatgcttaatataatttcaaggcctccacattcccttacagcacctgctatagcaaactcaacttcaggatcttgtgattcctccctttcatcttctaactctttaatcataggttcagtagcttcaccatctaatccctgatatgaaaataaacattctctttcaacacagatagaccagaaaagaggcagaaaatcacacaaatcacccaaacactgtcagacagcctcacaatatgcttcatcaataaatatacgatgggaccctagaattcagatgca

SEQ ID NO: 32300 - DNA, 2319 bp, Oryza sativa
catggggacatcgctctgcaagattagtgccacaaatacgagatttgcagtatttatgataaatataagcatctacaaccattcttctaaatatgttagaaatgaaaaccggaagatggttgtggtcctcgcaaagcgacgtgacactaattccttatgtgagcatgaatcctgggggattttgaaaaagaaactttcatgctcatatgtggaatgttttctctcgtcctcgagagtcaatgtcttaagcttgtccgtggcctgaagattttcgttctcaagagatacatcgtgcaagaatcgggttgtttcatgatgataaacaagaacagtgttttgagggccagagggacaaggcttaggcttgatcgagggtgatgagggttgtttagtttcatgaagatgggaaataggttcagaagaaacgaacgaagatacaaacatcacctcctcgaacggctcatgcttgggatgagcctttgttttgctggaataatttagggtgtttccataatcttcataaagaccaaccctgaattggaatggaatttccgaaggatgaatttcttcttcttctggctccagcaactggaataaggattcggcagttgagttgggttctgactccacgtgcaaaggatcctcatagataatctcgacctccgggatagcttcgcttcggccgaaagaatcgttctctaagatcaaatctaagagctctcttccttcggcagtcgtcttgtgcccgaacgatcctccggcggaaatatcgagatttgcggcagagtccttgtctaagccgtaccgaaaatgttggaacaacacatggtggggtaaagacaagtctgggccagattgagttaacaatgagaatctggcccaggctacaccgagagagtccttctcattccgtcggaaagagaggatgtctaatcgaaaattaattacacgggttaatggaaataaagcatggcagaatttgcgcttgagctcctcccattcaccgtggaatttcttgacagacatagtgtaccattacttcgcttcatctctaagagaaaaaggaaataacttccactttagagtttcatgtgtcatgcctacgatggatagacatgaacacactagctcaaagccccaaagatggatgtatgggttttcactaataccaccagagaagggttgctctcggaccatggctataaagtcaggactgatttcgtagccatcagaaaggattggttttgaagaacaggacggctcacaaagctcagcccaaggagcagaaagggtttgaattgtgggttgctccatcaaggaaaaaaataaaagaagaagaaataaaaataaagatacgaggatgacctagactcggataaattagcaaccgttccaaggcaacggtgccagaaatgcttgttggtatttcttgcgaccacagataaatccgcaagcgcacagaatactgctgtagcacttcaccttcgggtgaccccaaaaggatatcgaactcagggaacgtgtgtaatctacctaaggctaagactagcaaaggacaacaactagtggtaggtgggctagagaggactttctatgtgttttaattatctaagctaagcaaatgtaatttcctatctattgcttcgggcatcgacccctgctggtctgccagcgtggttccggctatagcactatgatgcatccgaacgtggaggattactgggatggaattcagggctgtcaccacctgctgcctacctccgacaaatccgtgggatacacaataaacaaaggtaatctctaacctagacaccgtgtctatgttattaattactactctaatacttgtacaggaacttccttctctatccagagtcctagtactagagcacttagtacgaatactaaacaatgaacccgcaaaaatggaaatatatcttactcagactaagtaattaaataacataagagaggaacacgaatgcttactttatagaagaagttctccgaacccgaagcagagtgtaccaacagctccggtactcctccagaattcctcctaggaagctacactcgtcgaggtagaagtcggatgagcgccaaacttctgagcactcctccagagcttcccctcactctctaccttattctaatgtacaaaagatacaatagagcctcttgtaattcagctcaaagttgtgtgcgttggaatgagagtgagctcctccttttataggctccaaatgatggttaggggcatgggaaatgaccaaaacacgctgcaactgcctctggtaaggaatccaagccgtccacgtg

SEQ ID NO: 32301 - DNA, 3937 bp, Oryza sativa
atgtgttttctcctcaaattacctgcatacacatctttcaccaacactagtggaaatgattagtaataatccataccactgagttggataccatattttatttcattatatgtaggtattgacggtcagatattatgatttaaggaccgtcaacagtgtccttcttgttcaagtgatcaaccacggaatcatcatcatgacccataaagcacacatgatcttcggcaatggaagatgaacaaattgatgatgtgaattcttcaattaaacattgatgttcattcactttttccttcaaaaggttagtttcacaagtactataggaagtagagcatccatccatatcatcctcatgcacatatctagtgctaggtgataagcatgagtcaacaacactatcaaatatagcaatttaattattgattgttgttggagtccaatgggagagttggaagatcatcaaccttactcaccaatttattaccttgctcatagttgtatgttggtgggatggatgatgaggtgagaccttcttggttggaggagataatcacttgggacttgtcatgatgaggcaatgaagtagagcaatccccaaatgatgcttccacaagagtatcctctccatcacatttggacttgtcatatctttcctttagtgttatccaaatgagatgagcatcttcaagtggcatgatggttttgaacacatcatcactcaaagcactaaacaaaacattagtagcttgagcattgagatgtgtgcatttctcttcctcctcaaatgatagatcattatcattaggagggagaaatactcacatctacaactcactctgtatgaggacccatggccctaaacacattaagcgcacgagtactccaagatatgtaatttgaaccatctagcaaaagaggttctaggaacatttcatttcttgttgacatcttctcttagggcggtgaagtccaaaatgaaagaccttgctctgataccaattgaaaggaccttgatgtcgcctaaagggggggggggtgaatagacgttcctaaaaattattacaacttcatagcatattggaatgatgagaacttttgattcaaaacggaacttccggtatgggattcgaagttccggtctcaaccgaaaagttaggcggataacggaataaaacactagctataaacttgtacctcaaacaaagaaaatgtatatgaattaaaaggtgacaaataaggtatctaaggaagatataaagttaccaactaaatcaattaagcatgcaagtagatcgggtaaaaacaacctcaagcataatgtgagagaatgcaagaatgggcaaatcaagagaggagacgcgtgatttgtttcccaaagtttggatccacggatcctacgtctctgttgaggagccacaagggccgggcctatttcaaccctttcctcacgaggttgcacaaatgcattcctcggtttcactcttgatttctttccttgcagaggcgaaatcgaagccttcacagactttctgtggcacaccacaaccttgggtgctcaccggcaacgcctagccgtctaggagaccttagtccccaagagtaacaaacacaatcgaagatttgcctgctatgaacttgagtgctcaaagtatggagtgaaactcactagctctcaacttctcaatctctcaatccaactctctccccttctcaaatccctttcacaaagaggcaacacaaaggtaggaaaatggggatggttatttggttttgaatgtgtctaatactccccaagaacagcaggcacttaaaggaggggtggaggagtttatatacccgagcctcacaaaaactagccgttggagaccaagactgtaattttcggaacttccgaaaatttacagaagcaaatatcacgcaaccattttcggaacttccgataatttttttggaacttccaataagcacagagtaaaatgaccataagtttttgctcgggagtccttttttatgatcttggactatgtggaaagctcacttagaggactatccaactcaaccaaaaacaaggcctaaaatcactcaaatgataggttaaagtttgggtttctctcaaggtagcactatgataggtcattttgagcaccgagacatacacaaacacatcgacattgcatctgtcttgatagtacgccattcctatactcaaatttatatagtaagagaattatactaataggataggaataccttctttccatcttcctttcattgtcttaagggacgccaacgccaaaaccattcaccatatattcttcaaacgattgatgtggttacttgtagcttcaaatggtctcacacggtccattatgacaaagccgccactcgtccttcaccactagatttggttcttcggcgccaagccccttgcttgccctttacccccgcatggtccattacgaccgagcatcacttgcctttcaccgtctttcatagtagacacttcgtatctatcgacgagtgatactcgcggaccgtatgagtagagtattggggtacgttggaatgatggtctacgtagtatgacattaagcaaacgaaagacaaagattatattggttcaggccccttatcaggtaatagccctagtccagtttatatgggattgatgatgatgagaacatattacaatgagagtagtcgaaacagatgataccgacaagatcgtagtcgagggattcgacaagatctcctggcgacttggctccgtgtactccgacttcgtaaactttggtgcgtgtgttggtgatggaattggatttcctgaacccctcccagggggtcccttttataccgtggatcatcttgacccccaagaaaggtttgaggatataggacctagtacagtataacagaaactctatcccttccgagtaggactttggaaaatcacgtgactcgtagagatattttccataatttgaaaaagattccacgcgatatttacgggaacaatccatatacgtgaaggtataccttatcggtatattccataagtcgtaggataggaggtatgccttatccttaaccctgaaagtagcccccgactccaactcaaatgaatttatgttgtcatccatgacttctctcaccagcggcttgtctgtcgttcttggtgtgggaccgagaagacgagaagctattgacaacactaacggaagtccgactgcttaaacactagcggaagcaaaagggctggcccataacaggccttttgctcctccctcaccgagaagtccattttgcctccctcctttcaattaatttcaaaatattaaaacttcgaatcggaatttatcatactaaatgaacttatgtgaaaaaagttgtcaaaaacaaagttgtataacttattgagatctaccaattttattttggttatttctccatctgagtttaattgacctatgtaaaatttgaatttcaaattatgacaacttcaaacaatattttcaaatactaaacgatttcaactaaaaaagtcataaacaacaaagttgtataaatcatcaatatctacaacttttgttttggtcatttttctagatgactttgtttcaataatttgaatttgaatttcaaattatgataacttcaaacaacattttcaaatactaaatgatttcaactgaaaatgtcatcaataacaaagttgtataactcatcaatatctataacttttattttggtcatttcttcatccgataaagtgatagtaatattgttcataaaatttacatatgtcttatatggttttgaagtatttaaatcgcgacgaaattgctataacgtcacaggttttgggccggtttatgacgaaatcgataaattgtcatggtattatgggccttgtatccatagttgcatatccgtgacg

SEQ ID NO: 32302 - DNA, 2462 bp, Oryza sativa
acgatttcaattgaaaaagtcgtcaataacaaaattatataaatcatcaatatgtacaacttttgttttgctcattttgctatatgactgtttcaataatttgcatttgaatttcaaattatgacaagttcaaacaacattttcaaatactaaatgatttcaaatgaaaaagtcatcaacaacaaagttatataaatcatcaatatctacaacttttattttggtcattttgctatatgactctgtttcaataattggaatttgaatttcaaattctaacaacttcaaacaatattttcaaatactaaatgatttcaactgaaaaagtcatcaacaacaaagttatataaatcatcaatatctacaacttttgttttggtcattttggtatatgagtctgtttcaataatttgaatttgaatttgaaattatgacaatttcaaacaacattttcaaatactaaatgatttcaactgaaaaggtcatcaacaacaaagttgcataaatcatcaatatctacaacttttgttttggtcgttttggtatataactctgtttcaataatttgaatttgaatttcaaattatgacaactgcaaacaatattttcaaatactaaatgatttcaactgaaaaagtcatcaacatcaaagttgtataactcatcaatatctataacttttattttggtcatttcttcatccgataaagtgatagtaatattgttcataaaatttacatatgtcttatatggttttgaagtatttaaatcgcgacgaaattgctataacgtcacaggttttgggccggtttatgacgaaatcgataaattgtcatggtattatgggccttgtatccatagttgcatatccgtgacgatctctgaaaacatcacgaaaatttcatcaaatttcgtcacatattaaatagattcttgtagtgccctttgcctcacgatatcgattaagctcaaggctagatatgtgccatcctctaatagctcaatcattcacttgaacttgtgatagattatataacttgtgattgactcctcaatcacctttggcatggccatgcactttcataatctataacatcgaggggcccagagatatctctccataagaggggtaaatctcatcttgattattcgtatcgcactacggagtagcgtttagtagtccctaagtaagctactacacatgttgggaaccatgataatctcaggtctaagaattcaataccaacacatatggctcttgcagtgtctcatgttgggtctatccaacaacatgttctcccaacatgtgtccacattattaatttggtatctctataccatgatccatgagacatgatcatcaattaatacatgtgctgatcatttaaacatatttgttgcacatatgatatttgatcagggatcctttagaaatagcaacatacaacataaagagtctcatgaaagaatcacatattcattaaccaataatgagttatctatttcaaggaacaatgtcggataaatatgtaaacatagtatgtgatacaatcatctctatgattacctctagggcataccactaacacatagaagacaaaagataaagttctacacgtttaggatttggattcgggcctcctgacagcaccaacttcaaacggacctagctgctgatatagaaggaatttcggggcccatgagtactgtcagatggttttgaaaaacttatggagtctactttcagatggttttggtcccacatcaaaattcctaccgagctgtcgggaatctgcaaaacaagccacataccttatccagtccgaatctgatttgggttttgggccttgtaattgtgtcgtgggcttaacccaagcgggtgtgcaccctaaggcaaccctacgatgtccctaatcatatttattcagtagccaccatcgtttagagggggttttgcttagattaatctgtcaagaacagtttcgccgctagatcggtttgtggaaccccaaattcgagtgcttaatcattcatatgcaattgtgttgcaatctatcttgttcttgcttgtgttcttgaattcgcatatagggattagccttctcgacaaggtcaaccgggtttcggcatggttgataaccagagaaaatatggtgctgcgattatggggcttaagagcgtgtttgttcagaagccggatcgagttgtgtcgctactccaccaaatcgattgttaatcaatacctatcaaaagatcgggacctatttcctcattatttggggtggaagtgtaacatacccgaaattttaggacttaaaaatttcttgtcaaaatagttagaggttaacttctccaatttttagagccaaaaatttccgttttaatttaggtgatgaccaatttaaaccattgcatgattataatttgagaacaaaataaaatcttttcattcccaacattag

SEQ ID NO: 32303 - DNA, 9129 bp, Oryza sativa
aatcaaattctacagattcatcattcatcatcatacagtctctgattaagtgaaataaaagtaattacttactttgcatcaaaagcctctaaaactattatctttaaaatgactagttttagataagctaaactttagaaattcatgtagaacccaatttagcttcaatttgaataaaattaagttatgtaggatcactaacacatgtatttccatgttatgaaataatattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatttccatccactaaaattagaagaacttagctcatataacaatttctaggttaatataatatattgctagtttagattaaagcatctctactttataaaatatgaaccatagtagtaaagaccataaacatgtgagataaaaatgttttagttaaccaaattattccttttattcaacttaaacaggaagtagcatgttctgaacctataactcaagagtcatgcacatataaaacactatatgcctaaaacacgttgtaacttgtaaaatctataagaaaatcattataattccaaaaattgtgaaaccaaatgtgttagtcttagaaaaacacatctccacaccccctgtgaagtctaatctaataaaaatcactttacaaaagtatttcataacactacctaagactatactattgtaaaccgataaaacttctaaaattcataactcccaaatggaataaaataaaataggaattatttcacctaaattcattttagatcatttccaacccactgtgcataaatcatgcattttagagcattttggattttcagctctttcggtgtttaattgcatgtcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacctatttgctgcatattccaccttgaataattgatcctcttgctgtttgaacccctagaaatggttagagtacactctttgtgctcaaatgggtttatatatgctctatgtgcaattacttgcttagccatgcttagaaatatgcaaatgctcattccatctataattaaaatgtggttttgatacttgaacctttgctggaataaaatgaatatgatgggtatttgcgaattaaaatgtgtaaaatgtgattttatacttgggcggcaagtggtgtgcatatggtgttagttgcataccgataggggaagtgtttgcccaagtccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtggattcccgttgtgtccgccaccacggcgttaagtttaaggcgtgggcccgccacttaacggttctagacatatttccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagggttctttaaactaatcaattagccgtgctcacggtcatgagcgctttggtgatgtgtcatgagtatagactatgttttaaaaatgtgatcatgtgatattggtttgaaattgataaatgtgttgagttgtgtgtgtgtgaggtgatatattatgacttgttgtcaaaggatgacaacaggagattgattataatggaattatgatgaattaaatattgaaacttaaaatttgttttgttaattgaagcatcaactcttttacaaaagaattgcgaaacaaaacttgctttatgctgaaaatgaactacatattgccttcctttgaatatatgccttacatgtagtatggtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtatacccctagtcggtgtgcttgtgtttgggtagtcaagcttccgctgttctctaataagtctatttggccggtcggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacagcatggtatcagagcaaataccgactataggagccccttaagttggttgcttagaattgtttcttaaaaattattttgagtgctatgctctcagttacaaattatttgcaaaaatcatgttcaatcttatatctcatccctctttagagattattttactttatgtctcatgttttgatttttaaaactcttatcttgctctataggaccgaaacattttagaaatactactcttgttgaattttatttgaaatcacttaataatcacagcaaaacagtaacatagtgttttgaaaagttttgaaatccatttgcaaactactcctatgtattagcacggatttctaaaatatcgggttaaacatagcccctagaaaatgggttttgagaatgagtcgataaaacttaaaacttgctagaaaatattggaattccatctccctatgttatctctgaaccaaaaatgaatttggtgggattttgtactttcctctcccgatatttcaaaattttatcggtatgacctaaagcgtgcagttgggtatagaatagaatttgctgtgcttaaccctctagattgtttgcttagatggaccacccaaaattcatctagcctctggaccaccctaacataatatgactaaaatggtgataaaatttatacaacctaaaacttgattaaagtttctttttgtgccggttgttctttttctggaatcttgagtcagtctgcttgttaattttgtctagactaaaccgtaggtgataaacatgagaatttttacatgcatcatgtagactaacccagtaagcttcatgaattttggcataatttttagacccctgcatcatagtgaaacaatctagatagttagcataatcatattctggaaattggtagtagctgcattcatcttttcatgtagcccaaaccataattgattaaatatgcatctttttacagtagttttcatacataacctgtaggctccacgaattttggttgaattttttttgagtcattgcatcatggcataaaaattcatataatactgtatagttctgtccggaaatctgtaggttgtcagtttcacaaatttgtgtagcctaaactacaaatgataaagtcatgattccttcagggtagctcctaatctaacccatctatctctctgatttttgtcaaaatttttgtatctttagagctagacctaaaaatttgattaagacagtaaagtgatgaatcccagcacctagcactcatgtcagattaacccctatcctttgaagattattagaaaaccctagtgcaaaaaaaaaattattttaatttaagggggatagtaagccatattcgtatcaaaactaaagataaaatttttaaccttgtataattcttcttagacctaaaatgcaaatcccattctagtaagccctgtaccgttaatatgaccagaattaatgattagaggtctatataaccataggttgttaaaaaaatgtgtgtcgaccttaataataacagtaaggaaaacctttaatttgtaagtgttaattttagaggtttttggctaatccgtgttctaaattttattcttatagatgcctaccatgtacacaccgtactgctattgccgtgggttcacctggaactcaactcagcatgtgctatggcttatgcttcagtacgcccgattcacctatccacctgagtatcatatcctcaagaaacctattggaacatcccaaaccgcagtcatggttcgtgtaagcattcggggtagaactccattagagaaagaccttcaatatactggttatgggtgggatattaagtccgctttgcaaaactgtgcttatgttgctatcatccgccttcgctatgagctacctgagatagaagaattttactgctacgttccatccttaactgagggagctcaacacactacctacccagggttagctgaaataggtgtaggactacataccccatacctccaacttgcaaactttgtgcgctcactagatatgctttatcgctcaacctttgctgagctgcaacgcgtccgcaccggggtagccactttagaaagaagcattatgccaaggtatcgccaaggacattatacaccggagttcatgtttggtgaggatgccatgcttgcaccagcagaagatataccaccacctgttggaatgtatattgaaagaaacccaccttcgcgcgtcgatgtcaggactgcttatcctccacttggaactactggaccgtatggaccgccagagtatgttcaatggtatggtcgagtcttcaagctaaggatgagagattaatcaatagtcctatctaacctctactgccacggtagtatgacttaaggacaagcttaaggaatagtctaggtatgtggtggcccattttggaagaaaatcatggtatgtaatatatgtaatatggctgccatgtactccatttatgtaagaacttgttggatggatgtaatagtaactaagaactcgtttgtccttaatttagaaacctctgtgcttgctgtccagaactttggaaaatctgtaaacataagttcatctaagttagaaatctggttataagctcctgttaatatgaaccaacatttatcttgttggaactaacttctctagtgtcaatttaactaactatctaagcttccataaacccacaactgagtagaacttgccactcacccgcgaaataaaagtttccaaatgttttatggtagcaagtctgtcatacaacttaaaagaaattattatctgctgtcaatgtcaatcctctggagatagtcataacttaagccaaccctacccaaatctcggggacgagatttattttaagggggatagactgtaacatacccgaaattttaggacttaaaaatttcttgtcaaaatagttagaggttaacttctccaatttttagagccaaaaatttccgttttaatttaggtgatgaccaacttaaaccattgcatgattataatttgagaacaaaataaaatcttttcattcccaacattagactagaaatgtcatcaagcatacatgtacataatgcatgcctaggctcgagttctttgtgcatttggagttttggtcttgcattccataataggtcccatgagcataatctaaaagaattatttcactaaacaaacctatagttaatcttgggtgataacatgtggacttaatattaaactcaaatatcatcttctcagtctaaaagaagtttaatgtaatccctataataatattagatgcaattatgaagtgggaacacatatacaaacaaaggtcatcctaattctctaaaatattttgtgcaagataaaatcatggaaaaatttatgtggacagtgattagcacaaacatatcctctgtaattttggtaacatgttaacactcaagttgaaatctcaaattaatcggtcgaagcagacaactaaaagaaatcaaattaaatttaatcggctaaaaccatatttcatccaaaagtacatttaactgcacataagtgagcatgggaaataatttattcaaatactagattagttatcatgaataaatgtaatttttctagatttttcctcctctgtttaagcctcctaaaaattcaatctagctttctaatagcccatctttgtttaatttctgtgagcagtccacccattatttttgagtgcaaccaaagaaaatggaatctaggtgtaatcatctaccaccagtaaaatctacactaattcttctgatctacacattaagttatgaagctacaaagttagaggagaaaataattccgaaaaaaaaatgatctaaaaatcaagtttacccagaatcttacccaaccctctcaccctagcctagtttgccacgacctggacccacctgacagcctcttaagcttgccttgactcagtccatcacttcctccactgttccagccgagagaggaagagattgagcgagccgacgcgtggccgcaacgtgtcgtcgatctcggtttcccttttctcgctctctactcctcccagacgcgtcgccattctccattcatcactctggagctgaagaagccgagggaggaggttctctgcctctccatcgccccaaaccttgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcgaccacgccgacaacgtcctggagcacgcaccggagcgccgccgcttcaaccatcgtcgtcgtccggccattctcatccacctcagagaaagccgctgcgccattgtcatcgcctcaacctcctcttcaaaacacctcaagaaccccagccggaaacatcaagaacacggagaacacatccttttcttcaccggcgccaatctaggatcgcctccgccgtcatcgtcgattaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagaccacatgcatgcatccttttcgttcgtaatcgacttccatgcgcacatgcactttcaccccaaaaccaccgccgctcacactcgccatcggcgctactccgatgtcctctaaccaagaaaactagaggaatggaatcgcgagagctttgtcttcattttatcttttgacctcaacctcaaatgagccaccgtttgccgccggcgagctccagatcgagctcagccatggctagctctgctctgcctagagcagagggatgacttctgtgaattagattaagtgcagggatccgtttacaattgtagaaacacactgacatatgggcctaggactgcgggttgattcctagaaaactcaagggcctttgtgcatattggtccctcacagccatgtggacccatcctttaaaatctgaagaaaaattaggaaaatgcccaaacaattatatgtttagcagaaagatgcacaaagttgtaaaatctatataaaatcaaatatagctcattttgaagtgattccagtttctgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaaatcaaattctacagattcatcattcatcatcatacagtctctgattaagtgaaataaaagtaattacttactttgcatcaaaagcctctaaaactattatctttaaaatgactagttttagataagctaaactttagaaattcatgtagaacccaatttagcttcaatttgaataaaattaagttatgtaggatcactaacacatgtatttccatgttatgaaataatattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagtgttgtttaagtaatacataaacatgtataagtatatatatacactttaggtctaattaaacctaaataaaa

SEQ ID NO: 32304 - DNA, 35881 bp, Oryza sativa
ggtggacgagatcggctagtggcaaggtggtgaccggtcatggcaggagagatagctagagctcgaggtgcttggttgtgtgtggggaaggaagaggaaaccttgccggctatttataggcgacaagaggcggttgccgatggcagttcgcagaggagaagggcgacttggccatggtggcagcgacttggaaaaggggagcacggtgctggcctcgtccattcattggctggccagggcggcgtgcacacacggcggctacagtggagttgggcggcggaaaaggagattcacggcacgacgacgacttgccgtggtcggcaagatggcggcggcggcaggaggaccacgggcgatggcgccatgccgtgggcagcggcgcgcccataggagagagagaaggaaggaggcggcttcggctgggccggctcagctaggctatgcgccaactgggccgtggcccgagaagaaaaaaagtggagggagggagagaaaaggaatgggctgaatagagggaaatttggcctggatgaatagtaactcttgagaattttgcatagataaatttgaattgaattcaaaggagatgaaatccaaaggaaacaaaaatatttgtggacttttggattttgacaaataatataaaatatagtttttaaagtactaaagaggtttgaaatatttttaaaataaaactaaagatatttatttgagatataaatttgaaaaggatgcaaaataaaaatgctccaattttaatagaattcaataagaatcaaatgtaaaacttgtcacgaaaaattttctctaataatttgaaatttaaattgaagtactcaaataggaaggaaagaaactacaaatggcaaggtttctaattttggataaattttgggaaggtggcagaaatagatggagggaaataaataggactgtagccccaaaatatgtggtatggatttttggtaaaatatttgtgggctaaagaaaatttggatttttgtaagaaagggattaaaataattttcttagcacaagagcaatcactctaatattgtgctaatattattcttgtgccaagaaggatattaagccaccgcaattaaacaggcggctggattaagataggagcatgaccaaagaataaatgatataatatttttggatggagtggaagtaaagatttttggagataggtctagatagaggtttgatctagaataaattccaataaaattagaattatgctggttttgcctcaaggttaaaaatggataatgagatgtaacagagagacgggccgattggggaaatattggtccaagctaaatagtaggctttgaaattttgaatggataatttcgatatacgagattccaaaggaaaagtatttgttggaggataaaactggatttggaaataaatgtagatggggaatcgtaagaatttctataggaacagaattggtgatagtatgataagcttctaaaggaaaagtgttaactctagggatattgaaaaatggtgtttcatgtactctggaaatgtttgggaaaggatccaaaggaaatatgctccagaacaaaagttagaggctagggaaaaataaatggaggggtttttataaagttcgaaagaaataaaaagagaataaaagaaggattttataaaattaaaagagagcatttaactttgcaaataaaatttaggttcaagataaaagaaaagattaaaagcaagattgctccaatggaaaagtcgagaagagcacaactaaaacttttcgcaaatttttttcttcaaaatttcagtatgttacactggattacccatagggccaagaaagtgttgggtgtcgacatgaagtacatgaatcaagatttggcttctaaggtgttgaaacaacaaaagccgaaagagcgggaaaccctaaggcctaagaaagaactgtacacgaaagatactggcagaaaaggaatttacctcaggaatgtcagaggtggtcgccattgttaagagtttgagctgacgaagcaaaggggctcgccgccgggagtttgggtcgctagaggaatcactggagataatagagcttgtgcagcaggggaggttgtgaaggacttagccggagaaagaaaatttgaaacagtgggcatgtgcttataagcttaacagtcaaagcagaaaccctagattttcacgggttcgacgaaagaaaattctgcctcattatataatacagcggaattggggggcatgtgttaacaacataattttgcatcagactcggagaggaaggagcaaggttgaagcagatttggtacgagattggagctggacttggagtcgggctgcgcattggctagataccgtatcggctgaaaacaaagtgtgagctgatcaagcttgatggagccgattgccgatacaactgatatggtatgacttgggctcggtgtgggcctatattggaataaccatcattactaattagagatagagctcggataaggcaattgtatctattaattaggatatttgagtcggtttgttagagatttggcaagagacgtcgtatatggtcttgtttgtatcttgtttttagaaaggttcgagtcgtgtccataatggaatagtttgtactcggggtataaatatgaaccccatagcattgtaatacgggagacaatccaatacaacttcgcgcatcgccaccctttttactcttcttcgttttcgacgagttcttcgcaagaggtaacccgtctcaatggcatgcgctatcggggctaacatgtcgctttagacgtgttaggctcgatatcgcgagtcattgctatcatatgtcttagttaatatattcttagcttctcaattttgctctatcggttattgctcgctttagggtttatgctggtttcggctaaattgtcttgctagatttagctaaggcatctaccatccttaaaagtgtttaattgcttgattgtctagactgcatgcttcttttcatactttcaaatgcatcatccctagtcgtgcttagaacaatgcaaactagcctgcaattagacataagaaggatagtattggggtttcagccgatcttacctaatatgcatgcttctttattcgtttcatgtatattcgccacttatacatacaggtcattttatataagcatatcaagctttagtcactatcaaccagatccttacactatcatgcttgatcattgtttgacatgtttatatagatcaatttatttatataggtttgtactagagtattagctagtacattatctttcatgctcgaaatactgtcacatcggctacttttatgatattgtcttaaaccaatttatcaaacttgatagacagtattacaactgattaggcatatttaggatttaatattctttgatatactcagcccatagccgatttggtctaactccattggctgagaccaccaacgatacgctattggccgactaattctgcttttgtctttctcactgattgcaggatcaaatcaattggcgcgtccttgacacactcgaggctagccttggacctgcactggagttaagtagatctcccaggccgccgtgttttcacatcaacaccaagtgaagcctagtagcttagctccagttggcatgttgctggcgagcgagagagagagagagagattgttaggcgtatagttggtttccagttaatacaagatcacgcctcaattcctaccaaactcttggctcgactgtgaaattccaaatcggggattggaatccacttcgttgaagaggaattccgtgaaaaggaaacttgcctcaatcggttagctgagttcggagcaggatttgaggggtgtgagagcgagatccagttcttagtaaatgggcggaatggatttggaggggaaatttgactcgctcctaaagacgatcgcagagaatgagaaaaagagggaagcgtcggagggtcgcacgcgagctgatcttgtcgagctcaagtcagcggtggaggggcgtcttccccaagtcgattagtaggtggaggatctgaattcggcactcgggattctgagttctaaggtcgagcagctggtaaacaactttccacgtgcggtacaaggtgagaaggaactcaattgggccatcaaggtaggcctgacaagaatgaaattgaaaaataggtgactgaaatgttgaacattggggtaattcaacatagccaaagccctttctcttctcctgcattgctagataagaaaaaagatgggacctggagacagtgcattgactacaggcagctgaattcaatcactgttaaaaataaatatccagttcccataattgaatagttgttggatgagttatctggttcacattggttctccaaattggacttaagagctggttatcacgaaattaggatggctaaaggggaagaacacaaaacagctttccaaacacattctgggcattatgagtacaaggtgatgtcctttggactaacaggtgtcacgcccagaaattcgctaactcgaatttcaagcggaatgtgtattaaaatctctgtcaaggactagccagagtacacaaacgacacatcgatacacagatccacgccttacaaaaataataaataagtcttacaaacgtagcggaataaaattaataattgaaactctgaacgaagatcttctcgagaaaaacatagcttcttccaaatccacaggcatcctcaacatccggatcaagcctaatcctcgaaataatcatcatccgaataattctatgtctctggggcaccgtactcaacaagtcataccaatgggaaggtatgatgcaaggtaataacaaaggattggcaataggatatttgcataaaacaacatttataaatcataatttgaatgtagtaaaacaataaatattactaagcaatattaagcatcactgcccaacgctaaacaacgttgcaacaggcccaaccaaaccacctgaactacaccagttcataaaatcatactattaagaatgagattaatcacggcgagctggttgaccgcccaataaccgcgggcacggctattcgaatatttttattctgatcagaggtgtacaactttacccacaagacacagcctcacaacacgttaccatgcgccgacatgccaccacaacataccgaaaagagactgatagaacccttcgcataaccctccctaaccaagaatacccacctcaggttttgcccctactcctcaataggcagcaggcagccccttctcgtgcctaggtaaatccggaagcagcagagaccgaagctcggtccgtcctgcaccatctcttctacccttgccatggtatgttgactaggttaagctatactctagattcagcctggagcccatgatggcatgtggtaagtacgtttatatcttccaatagttcccgagaactggtacttaattgtcacgggaacgatttgcaaaaccatgcacccacaacccaccattatagcatattttaatttaattaaatccacaccatggcagtacattatcatcataaaattaaggactaagttatagtgaatcccattgtgagctaattaatctaagcatggctaagcattcctaaaccaatcaactaatcacttatgtcccaagttatcaatagcacaaggtaacaataggttgagtacgataggcatccatcccacatgacattataaaataatgcaattttaatagaaaagcagggatttgtaaaataggttcaatatgatcaatgctgtatgtatgacttgccttgctcttgagctgtaggaacctcagcgaccacttcgtaataaacgggagcatcggaactaccagattctatacgacaaacaaagaacacaacaatacatgcaataagtctactgaaacagcaaaagaaaccaattttaatgaattctagacattacaacgaattcacaacaacttgaatgggttaaaacggagctcggatgaattacatatgaattttagaatatgagttgtgtaattactattaaccaaaaatccttagtcaattattaaacattaatgcccgaaggcgaaatagatcaatggaaaatgaactccggtaagcaagcctcacgggtcaacgactcaacgagtcaacctaccatggcacgggaccactcaaacggtcaaccgaaccggcaaacagaaccagcggctcagaacgattgcagggtttcgaacgactcggtacgaccaaacgaacgaggttttaggttatacttcgtacgaacgaacggttagcagctagctagcgaaaacggcacagccggtaaacccggctgacaggacatggcttgcggctgtggctaggtacgacgatcggtaagcccgtaacgacttaggtggacggttgtgactcggcaaggtggcggcgcacaacctacggcttggcaaagcggctaccaagtggtggcagcgtctcggctgagctagcaccgcagcacagctgcgacggcagcgcggtagcagcggcagcggcgcggcgacaaaccaaccataaccaagggacaggaaggagtcctcaccgggagacaacgacaaccggcggggagagacggcggcgcggcgaaccggcgacgctggaacaacgacgacgatcgagattagatgggtaaacggaggagataggatggttatgatgacaaccataccggcggggaaaaggagggctcaccggcaacgcgacgacgacgacggcggcgacgggcgatggcgggaaggcggcgctagcggctagggttagggtttggcggcatcctggggagacgagaggtggtggctgagttttgacggggaaaaggaaaaccaaggaggggtgccaagtattaagtaggtggaggtggtactggattagggtagggctggtggcggtacacggcaaaggaggggaggggaggggcgcacgcagaaggggaggggggcggcgcgcacggcaagagggggggttcggaaaagaaaagaaaaactagggaaaggcggtgccatttaaagaaaggaaaggaaacggcagccagaaaaggaatgcgacaaggactcggcctgcgggaacaaaacgaagccggaacgacaaaggagtcagcagatacaacgaaccgtggacggagagtgaaccaggaacggttcgcgaccaaaggagggacaggaaagaattattactttaaatcctaacattttaaattaacagggttatttactctgctctgaaaattccgctgataggcttgttaatggtttaaagcaaagagaattcaaaaacaaattctccctgacaaatccgattattagacccgttgttaattagggttttctcctggttaaacatagcattttctattgataatttattaatggattaaaactatggaaaggggaaactccgggtgtgacaacacgggccccagcaacattcctgagtgccatgaatgcaacattagctccagttctaagaaaaattgctgtggtcttctttgatgatatattaatttaaagtccagatctgataacacacctggaacatttgaggagaattctgcaattactggctgacaacaattggaatgttaagctgagcaaatgctcttttgcacagcaagaggtttcctatttggggcacataattggaccaaaaggagtatccgcagattccaaaaaatacaagatgtggctaattgggcaattcctaccactgtcaagaaactaaggaaacctttggactgatcagtaaacctctcactcaacttttaaggaagggcatcccatataaatggattgcagaaaccaatcaggcttttcagtgctagctctgcctgatttctctaaacagttcattctggaaactgatacaagtgagttaggcattggggttgtcctctcacaagataaacaccctatagcttttctcagtaaggcattgggacccaggactcaagggctgtcgacatatgagaaagaatacatggctattatgttggcagtagaacaatggagacaatatttacagcatggagagtttatcattttaactgaccatcacagtctcaaacatttgactgaacagaggttacatactcagtggcaacagaaagcttatactaaactgatggggctgcagtatcatatatgttacagaaagggagtaactaactctgcagcagatgctttgtccaggaaggaccatgccaattctgcagaactgtgtactgtctcataatgtgtaccttcttggatgcaagagattgttcacagctatgatcaagatccctatgcaacaaagctgatagcagaactagccatcacaccaacagctaggcaacatttctcttcagtacaaggcattctcagatacaaggggagaatttgggtgggacaatactgaattgcaagagaaattaatcgatgcattgcatgctacccccattggtggacattcaggatttcctgtcacttataggagagccaaaagcatgtttgcttggactgctatgaagaaaatgattcaggccaagctgcagacctgccaaacctgtttgcaagccaagccagacagagctaaatatccaggcctcttgcagccactaccagttccaacaggtgcttggcaaaccatctctttagacttcattgaagggttgcccaagtccagtcactataattgcatccttgtagtggttgattagttccctaaacatgcccacttcataccattatcacatatttttactgctagcagtgttgcactggagtttttgaagcatgtttacaaattacatgggttacccaggataataatttcagatcgagataaaatcttcaccagccaattctgggagcaacttttcatcaggtttggcacaaaattgcatatgagcacagcatatcacccccagtctgatggccacatagagagagtcaaccagtttcttgagatctatttaaagtgttctgttcatgccacccctgcaaaatggtcctcctggctgtatttggcaaaattttgatataacagttcttatcattctactttgggcaaaaccccctttgaagtaatctatggctacagcccgagtcattttggcatcagcttgaatgattgtcccatcccatatgtcagtcaatggcttcagcaaaggaaattgatgcaacaacttctgcagcagcacttgaatcgtgcccagcagcagatgaaacacttggcagataagaaaagaagttacagccatatgtgcagtcattagtggtcgtcagagctaatcacaagttatcctttcgacattttggcccctttcaagttcttgcaaaaattggcactgtggcctatggcttgcaattaccagcttctgctcggatccatcctatatttcatgtttcccaactgaagggcgccaagggtttttctcatccggttcagactgagttgccgactgacttcactcggtttcagattccccagcaattccttaattacagagtgactaaaaaacataattctgctactattcaattactaacccattggtcagggggtgcagtggaggacgcaacctgggaggacatgcaggatatacactacaggtttccacaggcacaggcttgggggcaagccggttttcaagattgagggcttgtcaggcctacctcgatgctgccaagggactccaagagcaagaagcctgacgtccgtgtacaagatggagaaatccacaaggaagcggaggtagctgatcgggagcgcgacgccaagatgatggaaggagatgctgatgaagcagagaagaatggtggcgctgagaagagggtgccggattccttggcccaaaaaccagaaggcccaactcacgtttcgtcggcgagcaatggaccaagtgaagcccagtagcttagctccagctggcatgttgctagcgagagagagagagagagagaaactgcgtgatcttgctataatatactccgtataacagagtagcgagaaacacggcggtgatgaactaatacgcggaggcgtagccggcgcagcttgatcctgttggatcgagagattgcaaggcgtatcgttggttcccagttaatacaagagaaaaatcgttagtgttcctaacatagcagtaacctgacgatttaccactcgatatgtgccaccaagctcgcctccctggcacagagtttccctcacgcagtcacgcatgcatcttcgataatcgagacggctcatatacctgagaaattggtgacgctggctcgtagacgccgccggtcgccggagttcgtctcagattcacggggaggaagtctgcagcaaatgtggagaggggagcatcttgatttactgaggcagttggtgggaaaaataatactccctccgtttcaaaatgtttgacaccgttgactttttaacatatgtttgaccgttcgtcttattaaaaaaaattatgaaatatgtaaaactatatgtgtacataaaagtatatttaataatgaatcaagttatatgaaaagaataaataattacttaaattttatgaataagatgaatggtcaaacattttgaccatggcccatacattttgaccatggcccatatacttaaattttatgaataaaaagtcaacggtgtcaaacattttgaaacggagggagtatatgctaggggagcatccgtggcccatgggttaacgggtctggtgaagcagcccgtaaccaaatgtgcctctaccaggcccgattgcgcgcacagatcttgaagcagaatctactgccaacaaaatcgactgatgcaggtgaccgtaaaatagcaaagctgaaacaaatttgcgtccaattgaaggatgtttgtgtctttgtatagcactgtatggaaaataaaatggttgaattaagtagcattcacggcaaattatctgttgtacacctaccacttgcatcagagtgtgttctactacaaactgaagctacagctggtgttgtggtcagaataacataaactaaaataaaacactggctaatgtgctagtgtattcagattttggttttctgaatatccaaccaacccctgtaacaaagcaaacaccttcctaataccctacacccaaaaaaatccagaaaacaatagatcaagagtttatcagattgcaggaatctgaacaggacatgtaaatatctattccagatccaccttccttcatattctgcacaagaaattcagataaaaatttttagaacattgatgttcagatctttctagttccagatttcatatcagtataggtaatggccctttcccaaatcaccaagaaagacttctccagaaaattatatcacttttctggactcgatttagtcaaatttacttatcactataaaacagaattgttatctattactagttaccatctaccaaaattaggacaccccgtagctagaattttccttcaacctgacacatatagcatttttagaacacaagatacatataaatcttttccggaataggaacaagttagtatagcaaatccaaatcaacatgatccatcaaatactatacatacactaggtcaataagtgaagcatggtaatttctgacattgcttaaaaaatatgtggattggaatttaaacaaaactaatatttattttcatgagaacatgcatgttttcatatttcagatttctaaacatgctcagtgctaacaaataaattatcatctttaacaaatgtaaaaaaactatagtataagactaaaataagaacttcaaatgccagcctgaccaaataatatagatgaaatatgtctgaattaagactttgtagtacctaaccaaaggaagatcagccagacaaaaactaattcatattttagaaggttacaaaactaatagaactattttaggaggttacaaaactaattaagttgaacatattagtgaacattttagaatatatgagctaacagtgtggtgacaaaactaagtacttttagcttacaaaacaaaacaaagcaaaataaacaaaaggataaaataatgcagctcctaaatattacacacaaaacgaacaaaagtgtgcttttagtactcaaaagacaagaagtttgcagctagactatgactaggccagcaagcaaccgtcgagctaacctacaaagcaaccatcgggcaaaataccaaaactacaaatgggacacacaaccttctcgttgcaactttaaaaaaaacacaaaaatgttgcataactacatcaattaaatttggtgaccaaaacaaagagaatagtgaaaggagaaaattacaaacaatgcattctaataaaacagggtactattagtaggcttgctaacaaattacacaaaactaagtataattagtaggttaatcagtaggaggtactgtccatttacacaaaacaaagtacaattggtagcaaacaaaactgtcttattagtatcttcattgctaacaaaattgacaaaactaggtacacttcaccaactacctaaaaagccataaattagaattgacgaccattctttagaacttcgtttctatattatgattagtacaaaaggaaaaatataagataaaaattcagagaagatgtcaggacctataaaatttagagaagctgaaatgtggggtatatattctgcaaaccatgagatgcaagccgtgcaagcaattgcagattgcaagaaggcaaatcataaaaaaaatatataatcatataaagatacaaagacaaaactagttaagtagtgtttgtaggagagacaaatatatccatgtaaatttacaaaattaaatgctattaatctccattgaacaaaactgaactgaagtgaattcaagtgaaatgctattatgctaaacaaccaaaactgaagattatttattattatgttaaaaattgaacaaaagtaagccatcttcagaagtaaacaaaacatacagaactagctttatctgtatgatctagcatacatatgcatgaaaaatcatcaagagagccaaggactacggagaagcagagggactatgtattcttgccgcgctacatgctgtgtggaatcaaacaacaataatacaatcttttttctgacagttacccaaaaataaacaaatcagtgaacaaattttatacactatcgagtagtggttgccccatggatcattccctcaatttgatcctctaaacctagagagactaatcctttctcctctatcttaataacattgggtgacctccttcggtcatcccggcaaaaagagagactaatccccatggctaatcctctaaaaccaaccaggctaatctccaaaggtaaaattgcaaaacaaattaggtagtgcttttgctctaacaaaagaaatgtgagatcaagctctaatcacacaacctccctatttgcaaaacaaaatggatataaaccactttcgtgcagtggctagctgaatctaaggtagacattcctcccccattcgaataatatttgctcaaatcaataagaagcagaatcatatataattattttaaacttgtaaaatggaattatatgattttttttaaaacaactttcatacatgattttttttgcaaaaaagcacgcagctgctgcctaaaagcgtgctgatgctgctgaacagcgagcagtagcgatgtttgaaacagccaaacgatcctttgtcccctgcttacctacggagaaatatattttgcaacacagttgctcgatgatttaaccatttttcatattaggtgtaaatggatccacaaaatgcctctagttggtactgcactacaaggagttctgaagtgtgacattcaagttcatagcgacgcaagaaataaatacatgaaagtaaacatttagcactttgtaaaccactaattcagaacactcatccctggttcttcctcttcctgctagctcctacaaatgctcattcctggttattcctcttcctgcaatatattgcggattctcatacaaattagaaatgatcagagcagtaccacagatggttatggtatcaatgataaaatggatttgtacaaaacatgagttggatacgctatgcaaatctacaaaatcaattcacccatatcttgagttattttgataatgttggtgcttaccaagcactacaggaaacagatattacgattatgatgcagtatgaatatgtatcaattatgcggatacatagattgaaatagctacataattaaaacatgtgaaccaatgatcacttcagtatttccaaatacttgtactggtagtgatatggtagtgatcacttttaactaggaattgtgccgtctatagggcttctgatttattctccatttagattgaagccaatttgaatattgaatatccattagcaagaaagggggtagcatgtgaatcagggattgagcttggctgcagtaccatatatagctatgtgtatgcttgtaagagccactataattagcccacgcactgatgctataagaataactgacatacttcaattctacatgcttaactccagtagacaatgcaaagacaccaaacaaggctggaattctcttgtggagcatcaaagtggcgtcctagtcctaacactgacaccaccaatgtagaaacaacctaaattgcttagagtaatcatttcaataatcatcatttcaacaggacataatcgcttttaccatcaaaaccaacagcatttctagaccaccgtcgccctacctagcatcaaaagcgaggcactagcttaattaaattgcagatgcacccggtaggtggacttactaccaaactaagaaaatgaatatgcagcagcaggcggaaatccgtagaaagtagtaacgcaggtaattaagatgcatgtgtataccatgttagattgaattgaagtacttggaaaactcagaggggaggaaggactggggatagcttgactttgccctgaccatgtcggcatcctcaccggaaaggtcctcctgcccattaacatatggaataactgacaacacggtcttgctggctaggtcaatggtcacaaccgacatcttcctgatcacgtgctcatagtcgcaggtgaggaagtgcatgacattcggcatctccatgctcacggtaagaaacaggagaacttcatgaggcacgagctcagggcccttgaaggaccaaatctccttggacgtgatcgcaaagtctttgctccactcaatggccccaacatccagccctaacgtcctcaaagtgtggcaggtgatggtatagccccgtcctggttctagggagcctaacaacttgctatcgagccggttgacatcagcaaacttgagggcgccagagccgtcgcactcggtgtgacagacacaccacggtacacctgggagaaatggcggcgagatctaccgttagggaagctgtccagaggaaaccggatgaaggcgattccaggccttttctgcagtacgtcgcagaagagcatgcctcggtcgtagtccacccagcagaggtagttttggaaggcgatcacagtgtcagtggtccagtagaagatgtcccagtactcttcgccgctgccgtacacgattggcagctccatgatatcccaccggccgcctccatctccatcttcacctttggaggatatggccgagcggagcacgcacagtctggctttgacattagcattgatgtttctgaggacctgcagctcggcgacggcaaactcttcgccttggcacaagatgccgacggatcgaaactccaatggataccgcaggttgccgtcgccctcaacatcagatggggggaagccgccttctggctggtaggtacatgggaggggttcccccccttttggctggtaggtacatggggggagggctttgagtagcggcgaggaaactgggtcgtcgccggacgcggtgaagatgaagtagtcctgcgggcaagccggaacagggcactcgacgatgtagcagaagcatacgagaacgaggttgcggtgggtggccacgaggtggcatgccaccatctcctccggattcgggccctgtggccactgcacgtacaggcgggagatcgccggagggtcggcgatacggaaggcgatggtaaagggggtcttgtgggatccggaaccggatgccctcagtgtagccttggtgtcgtcggggaatgacttgtcgtcgtctctgcggaagacaaatcgctccagcatcacccagttggggaaggaggcggtggcggtggcggtggcggtggggaaggaggaggaggacatcgccatggatcggtagagatcctgagatggattggggaattaggacaagaaaaacgagacctacgctgcgggctgcggggacggatcgtgggagagttaatgtacagggggctcagactttgcagggccggttggcctgctttgatatttcggcctcgaggccgctagtcttctgcttcggcctatgacggcctccttaatttttaccggaggtccctgaacttgtcaccggggaaaaagtgtaccggaggtccctgaacttgtcaccgagatacgaaaacgtcctccaaccgcaatacgagatatggggtcccctaactatacaataccggtcacccgaggtcccacggcatgatttctccccgatttgtccgatgtggcgacggttttgtccgccgtggcgctttgacctcagtcgtcgtcgctgactcaggagcccggtagttaggatataatgaaggaaatgtttggcgcggcttgcttctcccccaaacaccgaaaccctagcaggtagcgagcgggcggcggcggcgacgacttggcgagtggcggtgtggagatgtcgagctcgatgagcgacggctcgtcgtcttcccgtcagtggaagtcttctcccgtgccttaccgggttggtcctctggattaccaacccgcggtgatgtgccaatgccggtgcccggcgaaggcggcgaggtggctctcgtggagcacggacaaccctaggtgctgatactacaagtgtcaacatgctagggtaagtgagggcttttggttgatatgttgttgaggttggatttggatagtttggggtttgaatgtagggttgtggtttcaggttggggggtgtgatttctaggcatggtgtgacggcccgacgtccagtttcattagggagctattgaatgacttgcgggacatggtgaattcgttgaggaggtggaaggaattgttgcagaaggaagttgaagacagtcgggctaagggggagcgacagaggatagaaatagattatgtgagggctatggttgctgtgaagaaggaagaaattagaagcttgaaggctaggaatcaaaaattagagaaggagaaaaaaatccttgtaatttgtatgatgtcatgtatttttatgctgtttgtggtgttagttgggaaggaatgagacatgttgatgtgtctacattcctgagtcagccttttgccatgctatctccaatggagatgacaagtatgaggttaagcattacacacataggttcactgtgaacttggacaagaaggagtgctcctgtagatactggcatctttcagggttaccttgccctcatgcaatagcttgcatatatttcaagaccaattcactggatgcatacatagctgaatgctattcagtagatgcattctagaagacatatgagcattgcctactgccagttgagggcatgaacagctgccctgaagatgacagagaggctttgaaagctcctggctatgtcaaaatgcctggaagaccaaggacagagacaagaagagaggccaatgaacctgcaaaaccaacaaaggcatctaggatgggcactgtaatgagatgcaagaaatgcaaacaagttggtcacaacaaaacctcttgtaataggcaccatgcagttgcaagaggtagtaccaacacagccccacagcaagataacaacttggtgctatctgtggagattatggataccccatacccacatggcgtggatattcgattaggtatgggggtaccatatacagatagaatatatctagtaaaggactcgattgttatgttaacttgtgtatcaaggaaatacccgatagtcctgatcggttacgattataatttatctttacatgcctagtccgttaggaacatgggttgtatcttgtaattccggctcctccccctatataaggaggggtccgggagcctctagaggcataacttttctctctgatcatacgatcaataatacactcggcgaatcaatccccggacaggagtagggtattacttttcatctagaaggtatgaacctgtataaatcttgtgtcttctaacccatccacttttctagcttgattgccacccccttttaatattgccaaaatattgtttcgacactatcaaacactccatagagttttgtgtagagcaaaaaaaaggaaggcaccagccactgctacaacaagttctgttcatagttattaagaccagactggtgattgaaccgttaaggcactcggttcactggtttattagttggaccggtcaaaccgccggttaaaaacggttcaaatagatgtgagttacatgtgtttcacagcttgtggcatagcctggtggttgaggctctcgcggaaaccaggaggttttgagttcgactcacagattctgcacctttttccctattttctgtgactccacgtgacgcgtcatattactagaaatataattcccagcaatggcgcagaaatacaagcgcacggatatatgggaagatcatgtagagagaactggactaataatttatacattgcttgtgataatcatattctaagtaggggttaagataatccaagggtagagtggcacacaacctttttccctattttctatcacattactagaaatataattcccagcaatggatataccattgtagcatttcacctgagagtagaaccccctattttctatcacattactagaaatataattcccagcaatggatataccattgtagcatttcacctgagagtagaacccagggaattaccagggaaccggggctaaatatgaattaccaaggaaccggggctaaatatggaggcttacatcttcccggtcggtcacccatctcaaaattgctctaggccaagcatgcttaacctcagagttctttcgagatcggtttccggaaaagaagttgtaacttgttgatatgagtattctattaatcctattaagccctaggctggaatgtcacatcctcaccccctcaagagagatcgacgcccccatcgatcaaccctaggccaagaacgtcccctcgcccccgtcgatcaaccccaggccaggaacgtcccctcttagccacgtccatgtgtctagtgccagcgcatgtgccatgctgtgtaaccactcccgatctacaccagccatacacatgcgcccgtgaaaccgcgagagtcagctctgataccacgtcctgcctctccaaggccaggcccgcttacatctggcagcttttataggtcatagactgccctcaggcccgcttacatctggcagcttttataggtcacagactgccctcacagaccaacacaagtctttcctgcacactttgtcctcactcgtgcgcacccaggaaatggtcacccatcctgaaattgctccaggacaagcacgcttaacctcagtgttctttcgagatcgatttccggaaaagaagttgcaacttgttgatatgagtattctattaatcctattaagccctaggccgggatgtcacatcctcaccccgggatgtcacatggtgccccacgaatacgtaactgcccaggatgttgatgttcagttacgcatcaaatgatataaaagcataaacttcgattatacaatacttaagtcacttagttcataacacaacataaatacaaaccattatatatatggcttataaagccttatttctacaaacagataaactgctagactccaccacaggaactgcctgagcgtaggatgacctagaaaccatagctgtcccactctaacggatcaacaggttctccacaagcatcttcctcctcatgatctgaacccatttatgagtacaaaaggtactcagcaagacatgcttatgataataaatacaataattgcaatataaaacatgcagtatcgagagctggaaggtttaaaccctaaccttaacagttatttcatatagcctaacataataaacatttgatctaaacaacactattgaacatttaatttaaacaataataacgagcataacaatataaatgttacttataaataacttgaatagaacattaaacaataaataagttaaccatattaattaatagccatttagtttaacttgtgcccataatctggaatcacccatagacacatctccattaaccgggagcacggtgtattcgaatactcaacgactctgcagcgtctgcccagctttacccacacgatacccacaactggccgggctgaaaagtaacgaggtgtaatattgctccatatatctctcccttctgcctagtaagttaaaggatgctcgggatgttgctcggagtgatccggtccgaggtgtgtgccaacctacctccgcatccacttaccattgttcgttactcgatgggcagcccagaacttcatgggccaatagggcagttctgaactctcggggcccatcgagcccacatatataaatcatataaacatgaaccatgtcattttgcttcacacacttgaaagctaatggccagtacaccgaaaggcctgcagaagttcaatcaattggagcaatatatggggccaggttcgacaaatcgattgtgtggatgggcgaaactatgtcattcttattgacacaagggggttaattattataccaattttaaataagaaataaccataaatatatccatatatccatcacgaccataaacaggtccataaaaccaaacacatgaactctatcatgtgtaccacccgctcacatgcggtgtcaacaattcttagcatatagccataaatagttccataagcatgttttcataagcaataataatatccatattaaatcaatagcatgttaaataattaacagtttgtttaagtgtttctcaaatcttgtcctaagcttatttgactctaaggctcattaaggtatttataacaacaacagaaaatataatgcaataatagcaatataattaacttaaaagaattcgtgcagtctatcgtactccaaagggcaagtacgctactaaaataactctctatctactgggattaaattgttcaagtgagggtgcatgtcttgcaaccttcgagctcgatgtagtcgtacaaatcgtctcctcctagcgcgaagatttcacttgctccaacgtcagcgttttctatttacgcaacaatcatcaccacaataaataatagaaaaacaaagataaccaaaagaaaatattatcacaaagtgcaacaatgggtgaaaaggatttaaagaaataattttagggatttttggaattttggtgaacggcgaaccctagggctaaaattagggtcgcgacaacgggtgctcggattgcaacgaaactaacacggatggattcggaataattctaggagtttggaataggtctcggatttcgatttcgaggtcaaacggatggtcaacttgataggaaaataaaaatgatttttctgatttatttttcaatagaaaaatccggtttttcttcttcttctctcgctctgtacaggaacggccggaatcccacgacgccggcgttggagatggccggttttgggcaagggagcgccggttttgcgatctacagggtgcagcaactcagttaccgtggttggcggcggcgcaggcggcggcggtgaggctggcgacggcggccatgacagcggtggttccggcgaactccggtgagcgcggcggccatggtgagcatcagtggagcaaggggagcatggtggtggtggcggctcggccttgggcggcctggagcggcggcgcgccgtgcagccggcggcggccgaacagagcggcgatgccgggaggcgacgccggcgacactccggcgtcggattggattgggaaagaaagaggaaagggagtactcagcatggagaatccatttttacattcaatttcataggatttgcgatgtatgcgacgaatttgggagctctatcaatggcccaaatttagggttttggggatttttcctccggtaatggcgatttgattcagcgggggtaggggcgaatttgaggaggtgaaagaggtttaaattgtgcttcttttgcctccggtattgtgccttctagttaaggagcgaaggagatacggaggcgggaagctgaaggtgtcgcggcggcattcgttcgtcgttcgtcctcgtgcaagcgtgtgcgtgcgtgtggcgcgcgcggggcggcacgagctcagcgcgagcgtgcacgggattggcgcgaggcagcaggagcttgctcggcttggctcagcctggcttggcctagccgtgtagaggaagaagaaagaaaagaaaaacagagaaagggaaggagagggagaagaacagagaagaaagaaaagaaaaaaaaacagaaaaggaaaacatggggaaaattaaaatagataggattggaattgatgtggaattagatgatccgatattcggaatagatttaaatcggattcaagggaattatttgagggatgatatgcactttgcgacaaaattaaacgagaaaagaacatcgaaaataaacatggaaaataatattttaaatgaactattaactcgacggttatatttttagagaatcaaagcaaactaaatcgattttaaatagttgtcaaattttagggcttttacatgtacccgcaccaaagcatctcccagataagctagccgtatattcagtataacaagaacataatgtaaagtaggtaatcatatacttagaaaatatttcaataccataaatgtatttagaagagtattctaataaaagtacaaagcttacaaaatagaagagaaaagttgctagagccatacccaaactcttccgaaggctttcggactccgatttctactctactcctattccaccagctagatactactaaactaagcttgagagaaatgagagagctattgcttgaggtggtgtgaagtgaagagagtgagctccttatatagaggtagttatgatggttgtggaaggggaattgtccaaagtgccctccaaccgtcattgggatgcaatcctggacgtccacgccaaaacctggatccaacggcgccaggattggtttggccgaacctggtggttcggcgaacctgggctggcccaatccagcccaatttcggctggtggcctcctctattgctctactccacggaattgtgaattttggcccaattcatcatgctagttctgagttcttggcccatctattcataagtctggttctcgacatcgtccgattgatttatcatctaagttgatgccgattctcctccactttattgtcattctctgcaaaagtttagtaaacctaataatagtagaaaattattactctaacatacttatgcattgcaagcataattattactctaacatacttatgcattgcaagcatcactagttctctcctattttggtaatattgatgttcgaaactgatcgataacgaccgtcaacagcgtcccagcagtcgaactaccccggtttttccccggttcttcattaaaccgtccggttcaactagtttactgccggtttgattgctcgccgatcttttagctgaaccggaccagccggcgccctggttccgatttttcccggtcgaaccgccggtctggtccggttctaataactatggttctattagcctaacacacaacaacagttcaactaaacagaaggttagatgttttccaattgttcttactttaatttgcatttcccaattctgaacctatatgcttattcacactgtctacataatttttcaggggctacatgatcatattgttaggatgaatgctaaggcggttgcaacacagtcaggtggttccgcaacagtcaacctgtaggcaattgtgccatattcccagggttctacatcagcttcaattcagatcatatctgggaaggcatctgtttcagtctcagctcaagaaccagcaaagaagaaaacatctactgggcctgctccatccaagaaggccaagactccaggatcaattctcatgctgccaccatgggaatctgacaaactttgaatcaatctgtgtgtattgctaagtattgacatgccttagctatttatcctatctgtgatgtaatgccattcatgccatatgtcatgtaatggttagaatgctgctatgccagacttgtaaggctgatgtgtgttgtgctgctatgcctgattatttgttcttttgctgaaatatctatgaaatgcctgaactgatttggcctatgtcatattgagctgaaatttgctgagttttgttgatttggcctatgtcattgagctgaaatttgctgagtttttttcaacaaaattggcacctgctatgttggtctgaaaatattgccttacaatgatgtcagattaattggttcattctacaattttatcatatgtggcctattgcacaattgatttgctcaaatttgtatcaaactaatcatttctttattacctacccattttcataatctaccatttcagagttcaaataacacacaaaatttgattcagaccatttcatcattcagctgcacaaatcctactcaaaattgcatcaccctattccatccattataccatttgttttcaacatccaactttccacaattcatccaacaaaaaccacaaacttagcacaattccattctagattccattacacaataccaaccaagttccattccataactgacaacattacattccactgcgactaaaaagatgccagattcatttcctacccatcaacatagcaaacacaacaacaaccagtcctaaatctaccaacaacatcacacatatctcaaactttaacctactattcctatccttcaacacccctaccacagcttccttctcaccaacaaccttcctcgatgtggccaactcattcctagctaaaaccagctctgattgcacacatcttccttcttcaacagcagccgaaaaatctcccttctccctcctcagcttccacacttcgtcgcgcaaatcgttcaacacttctctaacgaaactgttcgacggaccatcaacccaagcaaaataatcgcaacatccactctgcaacagtgaaccaatttaaccctagaactcagctcaacaaaatcatggaccccttgaaccctagaacttagctcaaaaaactcacccttgcattcacacatttgaagtaccggcacccgggattgtctgggatccacgaaatccacctcgccgccttgttgctgtacctgcataccaccgctggctcatactccaaagggccaacccgatacgggatgggggaggcagatgtgcgcctagaagacgccgacgagccctcactcctcgagctcgccattcaccgccactcatcgcgctagaaacttcgccgccgtcaaccgcgccgccactgtaaccccccgcgtcgtacccctctccgccgccgccacaacctactcgtagcaacaatggggaacgaacgagcgacagagataactctagaagagcccccgctatttattcccaactaccgtcgctgagtcagcgatgttgaccaagtcaagcagccacgtcagcgaaaactgcacgcaaaacagccatgggagtcagtttgctcgggatttcaaagtttaggggtcaagatatctggttttgcggtttagggtcacgatttagattcggatcacttttgagggtcacgaattgaacttattcctactagaaaatctgtgcgcctattatcacacccactatatagcctgtttatttgtttatccatgtgcctattagtttattgcatatactttcccaccatttagtacataggattccatatttaaaatatatttttgaccttcatgaggccaaacaaaaatgatcatccccttattttctctcaacttgggtgattgtatgattttgcagatattttctctgtagtaagtcgtgccatactccttgctcaatgatcaatttaagaagacatttgcttaacattctggatttctatattatgcaccccaagtccatcatggtcattttcaataaatctatgcatagtagtttgacacaacttcagatctacatcatgctagtcttgatgactgaatgttaaattataggggtttgaaattttatatttaatttaacacagaaaaatgattcatataaatgttattaacatatccatatatttgtgagcctaaaagtacctacctttgatcgagttgtgtcaaacaagacctaagtaaactctgtcgacgggggatacccgtagaccggatatagagggtattggggtccgttggtacgaggatctacgtagtacgacatcaagcaaacagaagacaaggattatactggttcaggccccttagtacttaggtagggaaaattgaaaccatgccattataattttgcaaaatttgagatatgccatcctgacccacatgtcattgactcatgtgggtcctacatgtcattgagataccgatggcatattcaaactttgcaaaattataatggcatggttccaattcaccctagtaggtaatagccctaatccagttggtatgggattatatgatggacaccacagattacaaaggaaataacagaactcgatgataccgacgagaccgtagttgagttggtccgactagatctcccgacgacttgactcctgtaggctccggctccgtaggctgtgatgggtgtgttggtggtgagattcgatgccttaggtcctgcctagggggtcccttatataccgcgggtcagttgatctccaagtaggactcggaaatatcggacccctcacgatatggtaaaaacccagcctcatccgagtaggactcgttccaaacgtagattctgcttctatcgcgggatagatttccttaatgtattcggaaactattcgtacacgcgcgggtataccgtatcggtacccattgtatatctgaggatagagggtataccttatccataaccctgacagtagcccccgacttctgcttaaatgaactcatgtagtcgatcatgactcccaatgtcggaattgttgtcgttctcatctggttgatctcggtgtaaaaaaccatagagacaaagagccatcgacaacatcgcatgaagtccaacggtcatgagtgaatttaaattgaagtctgaaaactaccgagcgcaacgaacccaaaaatttccgacggcaatctctctcctttccttggaatacgcactgtcggcagagcgcttattgaaaggaattttgggaatccatttgaagtccgtttgccataaaactcttctgccttctagcgcccttcgtcttctctgttccccgcaaagaaaaccctagcttgcttcttccctcttgtttctcggcgatcctccggcgacgatggaccttgagaagtctacctcaaccacagggagacaggaggtatagaacctgaacccatcatgtgccacatggttgtggtcgaagattacatttcttgcgattttcttcctccgccttcggaatttcttcttctcgtcttgaatttctatggcctttctttgcttcacttgaaccctaactccatcgcattccttagcatcttttctcatctttgcgatgcctacattggggtagagcccttccttgatctattccgcttttactatgagctgcgatggatggaacccaacagggtatctggatgcgttggattccgacttcaggatcgcctgaagtcgcgttacatccccttccaatgcccctcttctcgcagcaagtggcgggcgagatggttctatcttcagatcgaaaactccgatcccgtccttgttgtccctgaagaacagccagaccaaatcccagagtggactgccaaacccgccctgactccctccctccaatcttttatcgagatcgtcgatgatctccgaaatcgggggttgtcggggtatgaagtcgctgtcgacttcgtaggtaggcggattcaaccgctgtaggcccgcgcccatccggcctttgattactctgggccagaggacacgacccgggtctctcctcgggatattttttttcttgcatgtcacatcctgatttttgtttcaggatttataaatcatttaataaattattattagaatttatattaaatgttctttaatttacaagtgaagttaaatgtgggaaataaaatttcccaaatataaagcatggatggatttaatttttattaaattctccatgattaagtcaactctctgaaatattctcggatttttcagagctcaattcctaaatgatacaaagaacagttcagtaattatttgatcattaatgatctaattataattgttaagagcttttcttgtttaaaaatccttaaattataaattgttggttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaaggaagtatttttaataaatggaattgcatttcatgaataatttaaatagaaaaaggttttaaaatcctccttttggctttgggccgaaagtcagcccaagtctctctttccttctccctctctcctccccggcccagtcggcccagtccgccgctctcctctctctctctgtcgctgacaggtgggtcccgcctgtcggagtcgtcgtcttcctccggccgccgccgcccgaaccctagcgccgcgccgccgtcgtctccttccaaattcggccgcgcctttccttctccggtgaaatctttagaggggaaatgatctccgggatctcctctaccttttctcttttggaatcgtcggctaatttcctttggaaataggcggattcgagtttgattcggattcgtgtttccccaatctttccttccgacgccggccgccgtgggccttcgccgccgcctccttgcccctataaaaggacccccggtgtctcctctacccgccgccaccctcgccttcgtctctcggccgtctgttttggataggatcgatctcggccgttcgttctcgtgaaccgccgccgtgcacccggtccaccgcaaaccctaggcgatgacgcaataattcccttttccttctcaaaaataattcattattgcgtcataattcaattaaaatccatataagtgttttaatcctatttaatctttaaaaattcataactaattctttgtaactcagtttaatgtggttcaagttgcaaaagttgtataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcccacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggtggagataagcccacgggggtcgctggggagtccatgccttgtttataagggggtgactatgatccgggaacggtgcactgtggtgggttgtgttatgcaaggggtaatgtcacagctcctttccgaggtaccgtggtggtaccgaggcacatggtgacatgttgtggggctgtgtcttgtgggtacagtggtacacctctggccagagtaaaactattcgaatagccgtgcccgcggttatgggcaggttgagcaatgtttttcgtgattagtcccacacctctcacaataattatggatgttatatctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaaagctgcttttgcaaatgagcctatattatgccatcctttggtatccttgtgcacttgcatatttgctgtgtggcttgctgagtatgtcatatgctcaccttgcaataatcaatcaacctcagttaaagaaaaaggatccagaaggagaagacatttggcttataccccagttgagctgcctgtgggagtggagccggagcttcgctagattttattttccgctgcagttttcttcttggtgaggacttagtgcctcttaagtaagtatttattgttttagttaatttgatgaatctgtatattaaattgtcagtttgtgtacctcggctgattcctggacgaggattttatgcacaaataagttcggaaattactagtgaattttcgggcgtgacattgcatttctaatcttgttccgagtgcatctgtttctcctgacttatcgagttctcattttcgattcacaggtctagacagtgacaccgtggggtgccgcgtcagtcaggtgatgatcagcgccccctcagcagggagcgacatcccgatccccctttgcgaaaagggcccagccgaacgcgccgctgcgatcaatgtgagtgtactcgatgattcctttacatctttctccttgagatcacgtcgtgacttcacattgtgcaggctctccctttacggacgtcatcgggccactagtggaccaccaggcggcggtgtcattgaagaagggcgtcgccaaggaggcgtccgacgctgctgctgctaccacgagtggcagcaatgttccgaagaaggggaggaaattctcctccgtacttgggacccgtcggaagatgccaaactctgctgtaagcttctctatcgttccctagtgcgtagtcggaacaatttgatctcataccatttcatcttactcaggactcggacgcgtctcctccgcctcaccgaaggcaaaggttggtgactatcggcgagaagtaagtaaacgttcttgagatcttgttattttccaaattccgatcacctcgcctcatggggaagagaaaaaactttgcagggcggcatgggcaaaggcggcgcaaggcgggactgatgccgcttccagcgcgtcccctacggcgacctcgacaggagtcgtggtcgctactatggaccaggaggtggcaccgagcggccctgccgtcagcctcgtgcctacccggggtccgtccaccgatgccctcacctgggggggagctccaagcagagatggagcgcatcctctaggccggtactcgcggcgtaggtcgcgagatcgaggaggctagggcggcggcggcgtcggcaaaccagcgtgccgaccagctagtgcgcgacctggcggaggcccgtgaggacctcctaaagatgagggagctggtggccggcaacgagatgcagcggcgcggactcgagcaccggatattggagctcgagggccatatgattgacatccgcggttcgctgcgaacatcgttcaccagcctgcaccaactcgccggggagtgtggtgtcacgactaccatcccggcgcaccccgatgagttctcgctgacgtcatcgcttgtggaactggctacggtgatggaggagatcccctccaagcatgcggctaggatcggcgaggagacgtccaacggcatctacaccggggcatgccatgtccttgcgtgcatgaggctggcacatcccgatctggaccttaacaaggctttggatcagggggccaccgatgacgcgcgcaaggctacgatggaagaagtcagtgacttgggggagtttgtcctccccctttttgaagagtaggatatttgttttcccttgtactccttaaccttcatgctataaaacttattgtggatccaaactgctctcctccgaacagttgtttcccttgtttccttagcatgtgattccgagtactttgttgttgttgtagagatgttgatatcgaggatgtccagcagcgcgggcagcccgacataccggtgattgttcaggcgcttacgctcaagccgttcgtgcagtgggaggaaactagtcaaagcccatccgcggaagtgaacatggcgatgacgtcgctaggtttgtatcttgcacttcttcactccttgtgttcggattgacttgattagctgtgttctcggaggagaagaatagcttgacttagtcttttcccatagtcttttccctgtcgggcagatttcgagaacatgttggctgaccgagatcgtcgaatccaatattggaggacgaaactcgaggtggccgaactcaaaaaaaccatggtggaggtgaagaaggaccaggccgtggaagctcttcgaggtcgcaaggtgtggttcaactcgtacctcaagagctgctgcgcggtgatggtgagggtttgcaaggagctatgatcccgaggagatcccaagaagtcggcggccagttatatctcgtggttgaatggagccagtgcacaacttgaagggattggccagcacatcgacgatgccttgaaggaggagtgtcgtcgggcgagccgctacgccggaggtcatgtgctggcctgcatccgagatcaccgtccgcagctgcaactcgagttccttcgtgaggggttctcgcgttcccggaggacacccgcggagatcgacggtcttgcacagtcaatggcgctgcttgccgagaaggttttccgctccatggattggtgttggccgtcctggtagtttttgtatcctgtagaaaaatatctcaaggaagcatgtaatatactttgaagtatttatgacttgtaagaaatacttgtaaaatagaaaagggatctatctaactaagttttcttactctgggtatgttgcgtatgagtgttttctcactttgcgacttcgatcagtcacttgagctatacactctccctagccccagccttgtcatcggagaatcgttctcggaggataaggctcttagatccttgacctgccttggttgaaaaaagcattgaccctagctcccagccgtgaagttggaaaactcaatttccgattacacggcttggttaatacgcacggcctgaactcttacatgaccagatcttacatggtcatttgtctctacatgatctgacaaggccttatccgctctgggcgtccccagccgaagttcccttagattcctcagaggctttgccaggacggcgtaaagggacatgaggataggttttaactctaggtgtcgtcgtggtaacggatcgtcgggaaggaacactctgacaatattctttacctgaaatcaactttattgaaatcgtgagatgccttacaaatttggagactattgatttatacataaaatttacgtaattgatcaatgttccaggaatttgctaactcgcgaccatcgtcgtctgcaatcttgaatgcacatggccacaagacttgcgtgatcgtgtatggtccttcccacttgggtgagagcttattacgccctgcttgactttgaacccatcggaggacgtaatcgccgatcgaaagtgtgagtgctctgatgcgcttctcgtggtatcggcgaagggcctgctggtagctggctgctctgacggtaactctttctcgatgttcctcgagtagattcacatcgtcacttcgctgctcctcctgttccttgtcggagtacttctgtactcgtgtgctttgatgttgtagctccgtggggagcatagcctctgagccatacacgaggaagaagggtgtctccttattggatgttgtcggtgtggtacgcacggcccatagaacagaggggagttcttcgacccacttcttatcgtgtgacatgagtctgtcgtagacgcgggtcttgatcccttgtagtactatgccgtttgccctttcgacctgtccattgctctgagggtaagaaaccgaggcaaagcaaatcttgactcccaatccaatgcagtaatccaggaagtcggcactgataaactgggagtcgttgtctgttatgatgcggtgaggcaatccatatctgcagaatatccctttgataaacttgatggcattgtcggccttgatttcccccgtgggtgtcgcttcaatccacttggtgaacttgtcgaccatgatgaataggaacttgtagccgttgtcctcatgggaatggaccgagtatgtcgagcccccagcacgagaacgaccaagcaagagggatagtctggagtgcttgcgctggtagttgtcacgcccggaatttctatccaaaattccagacgcttacatgtgtgtgaaccctcgtccaggaatcagccgaggcacacaataacaaattgataatagagtacaattattactctaattaataagcgaataaaatgtcattacagaggtagatagttcctcttaatcaataaagatctaagtagcggaaaataaaataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgttatacaacataccctgttgtataggcccaaccattctgaacaaccatcctggctgcacagttctatctccaaaccaggaatataccattccaaaccaggagctaat

SEQ ID NO: 32305 - DNA, 22679 bp, Oryza sativa
  unsure (1)..(22679): unsure at all n locations
taagttatcccaataatgtgctaatgtttctaagcatggctaagcaatcacatctaatatctagctgaaccaatatgtaaagctcaactagtcaagttataataacccaaggtatcaaggaataaagtaaccaaaaacaaaagggctataacatataataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgtgaaaacggactctccggaaacgacggaatctaaacagaaaagagcaaaatcaccaaaacagcacataaacaagcatgaacagttttattaaacggaatctcgtcctcgagattcggaagaactggcgaacagatgcggatgagctgacttcaattcatcttctcgttcccaagttgactcttcttccgagtgattactccattggactttgcaaaaacggataacccgattcctggttcttctctcatctatttccaagatacggattggtctctcaacataggtcagatcctcttggtcttttatctgttcaagattagcttcttcggtaggtacccttaaacactttttcaattgcgaaacatggaacacattatggactcctgccaaagattgaggtaactccaactgataagcaacctctcctcttctactgacgatcttataaggtcccacaaaacgcggtgccaattttcctttggtgtgaaaacgatgaactcctcgaagaggcgtgacacgaagatacacataatctccttcttcaaaactcaaatctctacggcgattatcggcataactcttatgtcgagactgagccactcgcaatctttcttgaatgatctttaccttttcttctgcttcccttaggatatccgtcccgaaaacctgacgttctcccgtttgatcccacaaaagcggagtgcggcacttccgaccatacagtgcttcgtaaggagccatctgaagactagcttgataactgttgttgtacgaaaattctgcataaggtagattcttatcccaacttccaccgaagtctaaagcacaagctctcaacatatcttccaaaatctgattcaccctttctgtttgtccgtctgtctgcggatgataagcagtactaaagttcagtttagaacccatctcttcctgaagcttcttccaaaaatttgaagtaaactgactgcctcgatcagacactatcttcttagggacgccatgcaaacacacaatccttgccatatacaattccgctaagcgactttcggaataagttgtctttaccggaatgaaatgtgccactttggtaagtctgtcgactattacccaaatagagtcatggcctgatgacgttctgggtaaaccagtgataaaatccataccgatttcttcccacttccattcaggaatcttcaaaggctgcagcaaaccggcaggtttctgatgttctgccttgactcgctgacaaacatcacatactgctacgtattctgcgatttcacgcttcatacttgcccaccaaaatctttccttgagatcctggtacatcttagtactaccagggtgaatagagtataaagtgtcgtgagcttctttcagaattgcatcttttaaatctttgttgtcggggacgcagattctctcacccaaccatacagttccgtgctcatcctccaagaaaccgatagcttttcctcttctcatattcttcttgatctcttgaatatcgggatcattaatttgggcttctctaacttgatcaattagagtgggcttcgcttctaaggctgcaacaaaacctctactgacaattcccaaatttaatctttcanattccttgcataattccaatgacaactgtcgtccttccgtagcattgcaatagcctttcctgctaagagcgtctactacaacattagcctttcccaggtgataatgaattcccatgtcataatcctttaattaattccaaccatctcctttgtctcatgttcagatccggctgagtaaagatatactttaaactcttgtgatcggtatatacctctgtacgagtaccgaaaagataatgacgccaaattttcaacgcatgaactactgcagctaactcaagatcatgagtagggtagttcttttcatgcggacgtaactgacgagatgcataggcaaccaccttcccatcttgcatcagaacacaacctaacccaaacttagatgcatcgcaatacacttgaaaacccttctttggatcaggcaaaatcaaaatgggtgctgatattaagcgacttttcaactcttgaaaactctgctcacattcttctgaccacttgtacttcacatctttctgaaacaatcgtgtcatgggcttagcaatcttggaaaaattctctataaacctccgataatatcctgcaagacctaggaaactgcgaatctctgaaactgtctttggttgtttccagttggttacggattccacattactaggatcaacggcaactcctctagctgagatgacgtgaccaaggaacttcacttcagacaaccaaaattcacacttgctaaacttagcatacagttgatgttctcgtagcttctctagtgcaaggcgaagatgttcttcatgctcttctttggttcgagagtagataagaatatcatcaataaagaccaccacgaacttgtctaggtattccataaacaccttattcatcaagttcatgaagaaagcgggggcattggtaagtccaaaagacataacagtacattcgaacaatccatacctagtggtaaaagctgtcttaggtatatcttcctctttgattctcaactggtgataccctgatcgaagatctatcttggagaaaacagtggcacctttaagctgatcaaacaaatcatcaattctgggtagcggatacttattcttgatagtcacatcgtttagggcacgatagtccacacacatcctctgggtatgatctttcttttccacaaaaataaccggagctccccatggagatgaacttggtctgatgtatcctttctgaagcaaatcatctacttgccgcttgacttctgccaactcattggctgccattctataaggtctcttatggatcggagttgttcctggtaccaaatctattctgaactctatatcccttttaggcggcataccaggcaaatcatcggggaacacatcgggatactcccggactataggaatcttttccagaattatttggttcagtcttgaccttaaaaactcagaagacaatgcatgaacagtcacaactcgaccatcattgctggtgagagttacttttctgttagcacagtctatcacacctttatgtctggctaaccagtccatccctaggatgacatcaaggtctttggattctaacaagataagattggccagaaatggtactcctttaatttctattctgacagaggggctacgttgcaaagagagtgcttgactacttggggtactaaccatcaaaggacgtctaagatcttctacttccatcccatgatttcctgcaaaactcatagataagaatgaatgtgtagcaccagaatcgtaaagcactgttgcaggaactgagttaacaaggaacgtacccaaaatcacatctggagcatcttgtgcttctgcagcagcgacatgattgacacgagcctttgatgctggtgcggtagagttgctctgggtagggacaaccttcacgcgtctgggcttcggacacttgtcagcataatgtcctgggtctccatagttgaaacacaccacgggcttgctgctttgctccctcttggcaggttgttgctgtgctggagctgcaacaggacgtggagcttgattgcggatgttgttgccagcattgttgttgaagaactaacgcttcggacgaacaacagacgaagaacctccctgtggcatggactggggtcctaaagtaagacgcggcttctgattattcccctgttgtgtcttgaattgagcaatccggcgtttcttctgctccatgcgattgtacttgtcctcctgacgaatagccttatccactaacttctggaaatcatgataatctccagtcatgagtgggtaagaaagctcatcattaagtccttccaagaacttctcctggcgctcttcatcattgcgcacatcttccggagcataacgagccaaacgattgaactcgtgcaaatactccgtaacagagcgagatccctgggtgagcgacctgaattccttcttcttgagagacaccactcccgatggtatatgcgtcttccggaaagcagcggtgaattcaagccaagtgataggttccgcagtagtcctattcaggcggaaatgatcccaccattcagaggcagggccatgcaactgatgggatgcaaatgagaccttctcctgatcagtgcattgaagcaaatccaacttcttctctatggcatgcaaccaatcaccagcttcaacaggattagcggtgctagagaaagtaggcggccttacacgaagaaattctgctaacttgttctggggaggtgcatggttatttccttggttttgctggttctggagttgctgcatcatcatgttcattagctgtgtctgttgagcaagaacttgggcaagtgtgggattctctccattgttgttgttattggggttgttggggccattcccattgctgcgagtattcaccatctggtatgggcagggcacaagaagagaaaccgggggaaactacttaggacagagaattactttaacttttattgatcttaagtgagtttcattattacaaactgaagactctcacaccactaaactcaccaacttcctaacactcaaaagcaaacaaacgcatgcacttacatcccaccactgatgtaaatcacatgcaagacacacaaccaaacttaaaacaagcaaactaacacaacgatctaagacaacggttcgacaaggctttctaggtcttccgagcatcggagttgattgaaggctcgttcggctcgtcttcatcagcttgagttgctccccactcaatcttggaatgagtgcgcttcgattcttctccttcatcatcacttacattgacgactggaggatgatagcgatactccgtgtcggccaactgatcactgtagcgatcgcggagctctcctatggcgatccttgccacctcctgacatgcatggatgtagtttcttcctccagcttcgaacatcactgaggggatatcttcactattactgttcaaagtgactttgactcggcacttctcttcgtgacgatcatgagtaatctgggcataaaaaggggcagtcccaaatcctatggcaaaggacattgtacgcaactcctggacaaaaccctcaacaccaaacaggtactcaggcttgtagcgcggcatctaaagacaagtgaaaggagggagttaagacatttatccaattaatagcacaagtttttggattaatttgaataaagttagaaaatcaaagtaaaaggtaagtaaataaagtagaccaagcttgcaagataagttgaaatagttggaaacaaggttacaatttttgtacttttgaacaataggtttcaaaagaaataaaagaaagttataaaatcgacatactaaatttattttattgcagcaagattaaataaaacaacattgtaaaacttttgctggtaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttagagggcttctatggataaccatttggcataacctagggtcaaggggctctgataccaacttgtcaggcccggaatttctatccaaaattccaaacgcttacatgtgtgtgaaccctcgtccaggaatcagccgaggcacacaataacaaattgatattagagtacaattattactctaattaataagcgaataaaatgtcattacagaggtagatagttcctctcaatcaataaagatctaagcagcggaaaataaaataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgctatacaacataccctgttgtataggcccaaccattctgaacaaccatcctggctgcacagttctatctccaaaccaggaatataccattccaaaccaggagctaatcaaattattaccaattatagcatcatttactatgatgagaagtgtgagactaatcacgaaagacattgttagacctgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaagaatagtgagtcataagttatcccaataatgtgctaatgtttctaagcatggctaagcaatcacatctaatatctagctgaaccaatatgtaaagctcaactagtcaagttataataacccaaggtatcaaggaataaagtaaccaaaaacaaaagggctataacaaagaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgtgaaaacggactctccggaaacgacggaatctaaacagaaaagagcaaaatcaccaaaacagcacataaacaagcatgaacagtacatgtggattttttaacatgtagatctcaattttagaaaaaattagagacttgaaccaactaaaacggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacgggcgacggttcacgcgaacggacggccgagatcgatccatccaaaacggacggccgagatcgatcgttctacgaccggctcacggaagagggcgacgatgacgtcagcgatgacgtcaccaccggcggcggcggctcggcggctcgggcttgcatgctcgccggcgaacggcggcgcttcggcacgaacggagagcaccaaagggtagagcgcgacgcggcgaactcaccgatgaccaaaggagcggcggaagaccaagggacggcgacggcgacgacgaagaaacggcggcggtcttcgggtcgacggcggcgatggtgctccggcgatcttcggcggcggcgaaggagcggacgagaacggcggcgacttggcgatcacgacggtggccttcccgagcgatgacgacgaccgagacggcggcggcgcacagctggagcgacggcggcgacggcggcgctaggttgcacagcgctagagctcttccggcgacaagaggcgaaggcgagagtggcggcaggtagagaagagctcgggggtccttttaaaggggctaggaggcgacggcgaaggcccatggcggctggcgacgagaaggaaggtttagggttcggaggagagagacgaatccgattcgaactcgaatcaaacacattccaaaccgatttagccgatgtttccaaaggagaaaaggtagaggagatcccaaagattgtttcccctcaatcaatttcaccggaaacgaaaaggaatggccggattttggaaaggaacggcggcggcgcgaaactagggtgggccccacctgtcagcgggcggacgcgcgcgcgcgcgacggcggactgggccgacttgggccgaggagagagagagcggttttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattatttctaaaaattccaattaaacaacaatttatatattttgaattttcagggtgtgacagtagtcttgtgtgtttgctgtgaaattgacaggcttcacaccgctgaaccatgtcgcaggcgtctttgagcgcggttggccagaaaaacccttgtcgaaaggcttttccgaccaatgtctgaccgccggcgtgtgacccgcagatcccttcatgtatatccaggaggagatgtttgccatcgtcgaacgatatgcatttgagaagtactccgtttggcgcctttttgtatagatcgttgctgatcatacagtaaatcttggcttgtcgggttatcctctcagcttctgcgtcgtcctcgggcagctcatcactactcaggaacttgatgagcggggtccaccattcttatgtggtctcgatgtcggcaatgacgtgttccgcctctgtagcccccgagatgatgtctggggaacagccgtgctatctgcgtcatttgcttctttcaccgatggttttgtcaagacgtccagaaaagtgccaagttccagtggctctcgtctggatgcgtgccgtgctaggtcgtctagttcgatgttgtgcttacggtatacgtgtcggacctcaatcccatcaaaccttttctccagcttcctgacttccgcgaggtacttggataactcggggctagagcacttgtagtctttgtgcacctggttcgcgactagttctgaatcccctttcacgattagttgcttgactcctagtgcagctgctgctcttatcccggcaagtagtccttcatactcggctgtgttgttggtcgccctgaagttgaggtggattgcatgcttgaactgatctcacaaaggtgatgtcaagatgaaccctgcccctgctccttggctgttgagtgcgccgtcgaatgccattgtccatgtttcgctgtccgtttgactgtccgacctgttctcaagcatagtccagtcagctaaaaaatcagcgaggacctgggacttaatagctgttcgtggcacaaagtggacatcaaactggcttagctcgactacccatttcgcaatgcggccaacaacgtctttgtttctcacgactctccaagagggaaggaggaaacaactgtgactctgtgggcttgaaagtagtggcgtagctttcttgatgtcatgattaccgcataaagcagcttttggatctgtgggtatcttgttttcgcgtcgtggagagctgcgctgacgtagtaaaccagtctttgcaccttcgctctctcgacaatgatgatagtactctcagaatatggcgtggcagcgatatagaggaataactcttcattaggttggggggcaacaagtacagggggatctgacaggtagcgcttgagtgcaatgaacgcatcttcggcttcctgtgtccacacaaatttgtcttgtttcttcagcagggtgaagaaaggttgtcctcgctcccccatcctagcgacgaatctgctcagtgccgccatgcatccagttagcttctggacttccttgagtcttgtgggtgacttcatgttctcgattgccttgatcttctcgggattttcttcgatccctcttccagagacgaggaatccgaggagcttgcccgatggtactccgaacgttcacttctccgggttgagcatgaggcgataccgtcggaggttgtcgaacgtttcccggaggtcatcgatcaatgagtcgcttgtttttgtcttgaaaacaatgtcatcgacgtaggcctcaacattgtgtccaagtaggtcattgagtgccccttgaaccgtgcgctggaaagtgtttcctgcggttatcagtccgaatggcatcttgacgtagcagaatacgccgaacggcgtgattaatgttgtcttctcctcgtcctcttttgccatgctgatctggtggtagccagagtaagcgtcaagaaaacttaacaactcacaaccagctgttgagtccaccaattggtctatccgaggaagaggaaagtgatccttgggacacgccttgttgaggtcggtgaaatcgacacacatcctccatttcccgttggccttgcgcaccatgactgggttggctagccactctggatgaagaacttctctgatgaaactagctttgagaagcttgtcgagctcttctcgtatggcttgtttctagtctggtgcaaatctccgcagtttttgttttactggcttggcatcgggtcgcaccatgagtttgtgctcaatcacctcgctggggactcccggcatgtcggacggctgccaagcgaacacgtctgcattgtcgcagaggaaggtgatgagcgcgagttcctatttcttatccagtgacggcccgatcttgacattcttgtcggggttggcactggagagcggaacgatcttgattgcgccgtctggcttcggcgttttgttggtttttcttactttcttgggcggctcagttgtggcgggcgggttgggagtgtgctcgaccatgtcgaggctccgcttgtcgcactgcactaccagcttcgtgtttccctgaatagtaattgttcccttcggcccaggcatcttgagcacttgatgcgcgtagtgagatgcagccatgaacttcgcgagtgcattcctcccgatgatggcgttatatgttgtgtcaaactcagcaacatcaaaggtgatctgctctgttcggaagttatttgcttggccgaaagtcacaggtagcgtgatcttgcccaacggcttggacgatgactgaggagtaattccatggaaggtttgatcagtgggcgtcaactcgcttcgtgggatccccatcgcgtccaaggtgctggcgaagagtaggtcgatggagctgccgccgtcgatgagaacccatgcgaccttgatgttccgaatagtgggctcgaccacgatcggatatcgtcctggagtgacaggagtcttggggtggtctgcctctaagaattcgatcttctgctacgccgtggaacctccgaagatgttcgaaacatgaaggtcggagtctaggttggctgagtctgagtcctgagtagccgcttctgcggcgttctcgactacacgtactcgcttgcctttctccaacgctagttgctttgtgagtgcatttttgaagacgaaacaagtctccagagagtgcttgtctgacttgtgtatgggacaccatattttcttcgtgtcatcgccttgtgggtccgggtgtttgggtgggtcagcatattctgctgtgaggacctccgtttgagccttccgtttcccactcctgcgactctttttcttgcttgactcaggcgtgtccttggctggtttattctctctccctgtcttcagtttgtcattcttgcgcctcaaggcgtcatccacgtgagcgcatcgatcgacaatctcgaataacttgcgagcagttgtgatccgtcttgtcgccagttcctgggttgtgtagcgatctcggacaccagacttaaaagcgcggattatagaagcatcggtgatcttggggatcgtatttctgcactcattaaagcgccgaataaagtccctcaatgattcacccgaattctgcgtcaacgcgtgttagtcgtcctcgatcgcgtggcgcttgtatgttccttggaagttagtgacgaactgctgccacagatctgcccatgaagaaatcgagtaggacgggaggtgaactagccatgaacgtgcagatcccttcaatgccgccgacaaataatttaccaatgcgttgtcgtctactccggcaacgtagagtactgtggaatagacctgtagaaactcctcagggtcggtgcttccgtcgtatttctctatcgctcccggtcgaaatttctcaggccatcgaacatctcgtagagaacgagtgaaagctctgcacccgccgccaggggcggtgggttgtcgacgatcatgtgctcgtcgtggatgtctgtccgatgatgaagatgacgaagatgacgaggatgatgacgagccacttggttccggggcagggttctgaggacgacgctcgggttcttgcgagcctcgtcgtcgtccatcgttgttttctcggcgtcgatctccatcgtcgtcgtcgtcgcggcgtcgacctcgacttgtatcgcccggcagccgctgctcgtgattagcatgttctcgacggttgtggcgatcatcacggtctcggtcctcgctcggacgtcctccttgctcttcgttctcgcgatgtcgcgaagagacgcgatgtcgggaacggttttcattatcttgagtgcgtcgtgcttctcggcagccattcagatggtcacggaaatcactgttgccgtgaggtggagggtagcttgacgaggcggagtccgctattcaggtaattctccgttagcatcgccgatcggcggttgttttggcggtaccctggtagcggcctcctcgaacgcgttattgagattaatcactgattcccatagtcgttccgccctgttaacgaccaaatttggtaatctgagtatcaaagataaagatcagatcgaagcggaatctaaatccaagattgtttcggaaacagagcaagaatcggctgaagtccgaatcggctgtgatcaggatcggcagagtccaagttggacagggttagccgattgagctggatccgacaatatgacgaagaatacgttgtcaggttgagttaataagcttcatgatgattgccacgcatggatagagtcctgagaaggcaattgtatctattaattaggatattttatgtaatttccttagagatatgtttgggcaaaagtctgccgcaaagacttatggtatcttagagtttgttagagataagtgtcgtgtccgatatggacatattttgtaatctcggatataaatagaccccgaaccccatgtaatcaacaacacacgttcaatacaacctcggcgcatcgccacccttttacttttgttttgtttcgacgagttcttgctttcgggttgagctgcatcagtttcgatcttcaacaagaggtaaaacttgttatggcggcttgcgttctcaggattagtgcttccatctttatgatactctaatcttgtttatgtaattcgtcgagttatcatatatcttatataatctctgacaatatcgctatctaatctccaatcggctaacgtttgttaccagaaggcagccgattaggttaaataccgacgttgacttagattatataagatatctaccactctatgaaacatccaacggcttgattgtctagatattgtccttcttttcatacttatagctgtatcagttgagtttgatcttataagtcgtgattagaatcctaatctctagcctgcttttggttgccgattagggtagcatcggggtttcagccgatcttaccttatttttatgcttgattgacatgttaaatatgccctttatgttaagatcttgtcgcatttaagtatattaggctgtttgtttggtatattctacttgccttaatatcttaatatagagtggtaccggagtattagccgatacatgctagatctatctgatcggctatgctatgaacatatatggtctcgttgttaatatatatttcgatctaagtgatttatactgtctcggcatggcgaccgatctatcccaatcacttgacttaagtatatatcgacataaggattatatattgttaatatctacagctgatcgagtagatttagttctttcttacatattaataactgccgatcgatgcacatatgacatcggctcaaagataaatgatatgtcatcggcaactagccgatcggctatcatttatagatttaaccgcggtttctttgtctttatttcttattgattgcaggatcaaatcaactggcatgctcatacatctaaagacaagcttttagacctgcactggagttaagcagatctcctaggcctcgtgtttttacatcaacacgcccactgatcgagatcagcgttcaggacaggatcaaaaggggtttccctcagtatcgcgttgagggttctgatgtgttgggctggtgtaatcaattgatcttccgtttctgcgccgcctctagatgtgctggtcccatcgatagcgtacacgtcgcgtggtgtacttgttgatgatgaggcttggtcttcgagcagatgtaggacatatggctcgaggggatcgatatcgattgccccgatgagtcgatctgaaatagtcgccgctccttgttccttgtccgcatctctagaagagattcgtgactgctggaccttaggaggtgacgtcctcatggcgctgagaaggaccttgcagcttgagaggtcgtgagtctttgccttgtgaatgggacaatagacatcacgagttggagaagtacattgaattccacgctctttgcaggcacggatttcagcttgtacgtcgaagaaaaccgaacaagcttgcaaggtgtgccttctggtcttgtggataggacaccaggtccttgtcgcctcggaagttatccttgttggctcatgcttcttatcaggaggacaagatttggccgcgttaggatccttctcaggcccagatgttgtcgatgttccgttctctgcttctgcgggaggatctttcgacatagagtcgaccggggtcgtaaccacgccgttctcgctcccggtaattgatgggccagtcgagatcggcatcgtggtgtagaccgggaagacaatttcgtcgacttgagtccacaccagcatcgttgaagttgaagctccttggttgatgccggggttgacgctatcgtcgagaaggcttgaagtcatagtagtagaaccttgagcaccaagtttccctacctggcgcgccactgtcgacgggggatacccgtagaccggatatagagggtattggggtccgttggtacgaggatctacgtaatacgacatcaagcaagtagaagacaaggattatactagttcaggccccttagtaggtaatagcccttgtcggtgacatggggctgggggtatcgtgactagaggcttgggtagccgcggtcacccacgtggcctgaccccctcgggggggtcgggcccgaggatgacatggccacccctccctctatctccccgatgggtcggaccgctcctgtttcggccccgagggatgggcgccccgaccccctgtggttttggcgccacgtgtgtgggttaggtgagcgcagcggggctcacctaaccgcatttatagtaggttggacgagtgcaccacgccgcatttaatgcggcgcagcgcacgcttatccggtccgtgaccggtcgcggtgtgtgaccggtcacagaccggtcagatcgcgggttaggtggcaacaggcggcctatcacacgcctcgccccgtcccgtcggaatgatgagagcttcctggctctcgtccctagccggagctggcgtgctaactcctggagttggtatgtcagtcccggtcagatccattccaggcttcagcgcaagtatggcaaggaagtcgctggccattaaatgaaggttgaaatggacgtccaccgggaaggcaggcgagcggggcaggaggcgtgtgctctgcttgtcagacgttacttccggctgtagactagccctcattgtaaaaagcatgtttcccttcttaggcagggaggggcccatgtggtgacccgggaccagagaaaaaggaggcccaggcctaggagaaaaaaggagggaaggagggggaatgggcgggagagcctgaactctctctcgctctccggctctctggattccttcacgcacagatccaccagaacacaggagtagggtgttacgcttctcagcggcccgaacctatctacgtcgcccgtgtcttgtgcatttcctctctcgctgacgttcttcagatcgagggcgaagaacctcacttagtgcccccggccgaaccggcaaaggggggcctgcgcggtctcccggtgaggagccccacgctccatcatctggcgcgccaggtagggggcgcgcgtgtctttctaagccctcgtcctctttcgtatgcgccaagcttctccggctcagcccaatggccgaacgggcagtggcgcacagcctctctccgaacgctagcggtgacgacgaggagcagaacccgtgccgtcgggctcgcaccccaccgtccccctctcgccgaaatcttgggcggggggaagcgctcggggaggtcgaaggatccgcgacttcgcctcccgcgggcgacgggggaggacggcgagacggggcgcgtcgccgcctcgtctacgacgatggcggcacgccccagggcgcgctccaggctgcgggcgcgctcctgcgtcacccgcccatcgtccccgatccagagactccagcccgacgttggctggatgacgtggccgacttggtcatgacggcgcagcagcgcctaagcgcctgcgggcggtcctccgccaccgaggcctctggcgcagccgccgccggctccatgtcgtcgaggcagagggcgcggcgagcggcggccgttacccgccgttcgtccgccattccctcgccaacgcctccgacccaagaagatgtgtgtggggggccggatgcccgcctcgatatcgagcgccggcgcgacgctcgtcgcgccgcccacgcaacggagggcgcttcctcgtccggagcgccacttcggtccgggcacgggggccggccccccgtgtccccggttggtggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtctactcttgggaggatttgtgccagcagttcaccacgaacttccagggcatatatccgcacccaggcgaagaagcggacttgcatgcggtacagcgaagggacgatgagtctcttcgctcgtacattcagcggttctgtcaagtccgcaacaccataccctgcattcccgcacacgcggtgatctacgctttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccctgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagtgccgtgagggcaagaccccggcggctcccgccggcaaccggcgaggtgaggccaagcagaaggccaccgccgaggacattgacgatggcgacgatgacctggggttccaggagcctgaggccaccgtcgccaccgtcgatgggggagcgtgcgctcacgcttctcgccggagcctcaaggccatgaagcgagagctcctggccgcggcccctacccatgaggcgacgcggcgggcgcggtagtcggaggttgccctcaccttcgaccacaccgaccacccgccgtgcgttgcccggggaggacagatcgcgatggtggtttcccccaccgtttgcaatgtgaagttggggcgtgtcctcatagatgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctggggaggcccacgttggtgaagttcatggcggcggtccactacgcctatctccagatgaagatgccgggccctggtggccccatcaccgtccatggcgacctcaaagtcgcgcttgcttgtatggagcagcgcgcggaccacctcgccgcggcgtccaagcccgcgggtggcgacgagaggctcgccacctccgtcccggccgccccaaggcagcggatggtcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcttggagaccggcggacatgcccggagtccccagggaggtgattgagcaccgtctcgccgtgcggtcgggcgcaaggccggtctggcagaaagtgcggcggcaggccccggaacgtcaagccttcatccgcgaggaggtagcgcgacttctggaggtcggtttcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcaggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggatggaggaggctgagcgggccttcactcagttgaaggcgtacctcagttctcccccagtcctggtcgccccggagccagatgagccgttgctactctacctggcggcaaccccgcaggtggtcagcgcggcgttggtcgtggagcgcgacgaggaaaaccctcactccgcgcatccccaccctgcgtcgactcgacccgggagagagcagggaggagaggcccccgagccgaacggcggcccaaggcccccgacggccggagctggccctccgcctgcttgtccgatggtgccaggcgcccccgacccccaggatggccccggggccactgcgggaaggccgcgcctgtcgccctctgacctcgaggtcgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtattggacgggtggtgagatgggcaatcgaactctctgaattcgatttgcgctttgaaccacgccacgcgatcaagagccaggccctcgccgactttgtggcggagtggagcccagctcccgagcccgtctccgcccccgaggccagctcgggcccctcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccagtgctctgacccgcagatggacgcttacgtgcgccaggtgcggcgtatggagcgccatttcgacgggatagagcttcggcacgtgcccagacgggataacgcggtcgccgacgaactcttaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccctagattgattgcttggatcactgagatccagggcgtacctcgcagataagactctacccgagccccccaaagggagtgaacgcgtccggcgcatctccaagcgttacgtgttggtgaaagggcccctctatcggcgcgtggctaaggaagtcctcttgaagtgcattcctcggaacaaaggggttgagcttctcgccgatgtccatgaaggcgagtggggagcccattccgcttcacgcaccttggttggcaaggcctttcgccagggtttctattggccgatggctctcaacgatgcggtcgacctggtccgacggtgcagggcgtgccagttccacgccaggcaaacccatcagccggcccaggccctgcagaccatacctctttcgtggccgtttgctgtcagggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcgcctcccccgcccaccccagaagcaatggccaagtgaagcgcgccaacgcggaaatcctcaagggcctcaaaaccaagaccttcaacgtcctcaagaagcacggcgactcgtggatcgaggagctgccagcggtgctctgggcgaaccgaaccacgccaagcagagcaaccggggaaacgcatttcttcctcgtctacggcgcggaagcggtcctcccatctgagctcaccctgaggtcccctcgggtcaccatgtattgcgaggctgatagatcagcttcgccgagacaacctcgactatt

SEQ ID NO: 32306 - DNA, 991 bp, Oryza sativa
cctgcagcccgaaggaccgcggcacagaccatcctcgtctcgcacacacaacaaactgaactgacgcagaaatttcctctttacttgattgcagattaaatcagtctatacaagaagggggcccgaaggcctcggaagaagaaggaaaagttattaagattggcgggggcctgggggctcactccgacgcgcccgggtcgccggcctcgtcgtcgctgtcgtccgcactgtcgtcaccgccctcctcgtcggagtcgagcgcgaacgcgagccgaggggccgtaccctcgaagctgtggacgatgtggtcgacggcgtcccggacctgcgcgcgcgcgccgtcctcggttccgggagggaactcttccagtgctgcccacggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggcgtacttcgcgtaccgcccgccccagaggcccgcctgccgcccggcgcggtctagacgggagacggcgtcccgaagcatgccgggccctacctcgctcgccaagcggagggcctcgacctccccggcggacgagtccagcgcgccctgcagctcagcgatggtgtgttcggcggctgcgaggcgggcggctaggtcgccgtggcccgcggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccgctagccactgcgccgcggcctcggcctcctcgagagctcgcccccgctcggtgagcgcgtcctcgcggaggcggag

SEQ ID NO: 32307 - DNA, 2828 bp, Oryza sativa
gccaggtccctacgacgggcctcgagctgtgaggcgtgccggcggtgtgccttgcggcccgcctccaccatggcctccaccgagcgccgcccctcctcgacgcgcgcccacgccgcgtcgagctccgcccgctcctcctgcagggcctccatctgggcacttaacccgtccagcaccgtgctgttcgcggcggccaaggcctgcaggaggggctccgcgctcagtggggcagcggaagacagaggggagagccgcctcggtatgggtgccgcgcggctcggcccgccgattgacgtgccggactcgggggcgtcccccgaagctggctcgtcccaagcgtcacccgaggggtcgggcccgagcggcgcgcccgcagcctcgtcgtggttggcctcggaaatcgtcatcgcctcgggcggagtcgggtcgggggtgtggcaggctgcctggcgtgcgcgcgccgcctctgcctcccggacggactccccggcccggcggagtctggcctcctcccgagcggcctcctcagcctggcgaacccggacggcctcctgggcagcctcctcagcttcccggaggcggtccgcggcttcccgccggtcagcttcccgcctccgggcctccgcggtcgccgtctcctcggcctcagaccggccggacttggaatggcgggggggcgcgacgggatctcactgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcggcggcgagatgaggttcccccggcatggcacgatcccccccatcttgcggggccgtttcttctttcgctccccctcgggctgcggcgtcggcacggcaccctccgggcgcctgctgctggcacgcaccgccccgccccctcggggaggagatgggggaggggtaccctcctgcttcctcttcccccgggcgtcggcagggcggctgccccccgggcccccgtcgcggggcccagaagcacgaccccctcccggggtagattgttcccccctgcggctcccgcccacgccatcgtggcctcggggggcccgctcccccgacgccccgaccgcctgcatgatggccagaatcttggcgcgctctggatcgcagcagagggggaggaccccttgagggatgagggatgcctccacggagctgagattcagcacccgttggaccaccatcctgaagtcctcagggtcccagtcccatttgcgcccctggtgggtcctcatgtagtcctcgggcccggtgtactcccaggcgcctcgggcgcgccgctggagcggcgcgatccggcgacgaacgtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggtgcgcttcgtcggcgagggggtgtagaaccaatcgctcttccagtcgtcccactttttgcggaggacgtagggaatgtagcggttcagcacctgcccccgcggctggaagtagcagccaccgactaccgtcggcggcgacaccggctgtacggtgaagaaccaccggaacagccggagaaatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcctggcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatccctttctcggcgtctttacacccttgccaacgctatgcccggctcctcgcttcccgtgcccactacctcgccccctcgtttctcgcgcccacgcctccactaaccccactcgcccgtttgcggcgcacgcggcaaatgtgcggccgtggcggttgagatggggcagattgtgcgcgcattaactacggttgccaaccgtgaaaagcgccatcatcatgtctccaggcgaaacgaaccggctcatcccgattcgcgcgctgctcgagtaatgtagcggtcttaaagaggccgctcattattgtcggtcggttttcccttgccgatgcgcgcgatttgcgaccgctgggtttctgtccgcctgtagggaccggccccacctgtcaccgggcctaaggagtggcgtcacgcccgagcgcttccctcgaggggggcgatcgccctggcgtaacgccgggggctactgtcggtgacatggggccggaggtatcgtgactagaggcttgggtagccgcggtcacccacttggcctgaccccctcgggggggtcgggcccgaggatgacgtggccacccctccctctgtctccccgaggggtcggaccgctcccgtttcggccccgagggctggggcgccccgaccccctgtggtt

SEQ ID NO: 32308 - DNA, 3025 bp, Oryza sativa
aaaaaggaggcccaggcctaggagaaaaaaggagggaaggagggggaatgggcgggagagcctgaactctctctcgctctccggctctctggattccttcacgcacagatccaccagaacacaggagtagggtgttacgcttctcagcggcccgaacctgtctacgtcgctcgtgtcttgtgcatttcctctctcgctgacgttcttcagatcaagggcgaagaacctcacgtagcgcccccggccgaaccggcaaaggggggcctgcgcggtctcccggtgaggagccccacgctccgtcagccctaatccagttggtatgggattatatgatggacaccacagattacaaagggaataacagaactcgatgataccgacgagaccatagtcgagttggtccgactagatctcccggcgacttgactcctgtaggctccggctccgtaggctgtgatgggtgtgttggcggtgagattcgatgccttaggtcccgcccagggggtcccttatataccgcaggtcagttgatctccaagtaggactcggagatatcggagtcctcacgatatggtaaaaacccagcctcatccaagtaggactccttccaaacgtagattctgcttctatcgcgggatagatttccttaatgtattcggaaactattcgtacacgcgcgggtataccgtatcggtacccatcgtatatccgaggatagacggtataccttatccataaccctgacaaactctgtatatatctatgattatacatggtagcaaactaaaataataaaataataaagctgcactaaaataataagtgttcttttaaaataataaagatgcacattgaaacattagaaactcatataaaaagcgttcgaattgcagaagtggtgtgtgaatataaattttcccttccgctcacagaagaatagaaaaaaaagaaaaagttattaattgaaatctctattttattataaaaattaaagatgtttttacctgtactttagtaaatcatccgtctatgagtcgatttttaagttggttcgcttttgaaaatacaaatccgtattttagttagttttcaagctcgttcgtttttggaaatacaaatgaagtcgtataagaaatcttttaaaaaaaaacttacatgctaacttgacacgatcaaactcctaattacagcttataattttctaaaaagatatatatatatatatatatcctatttctataataaattttactttacctaagctaataataaaattaaaatagctttcacccacgggcgggacattttttctaaggaaaagagaggaaaaggcaacccctttcctcgcgcgcgaccgctggctggcggcggagccgacctcacctcgccggagtttaatcccccctccattcttcctcgtcctgattgccaacgacggcggagagctcgccggtgcccgacgtaccgacggctcgatcagtccttcccatcctctgttagcctcgcgtgacgcccgcctgcggtggggggaagaacctcgccgtcgcacgcgatggcggggacgccacccgatggcggaggagataggccgtgggagtcgtaccacaccgcctacaccaacgccaaagctggtgagtgtgcatttcccctcttcccgtcgcgtaagattgttgccagtagggggtagggttttgggcattagggggtctgcatcgcgcaaatcactggtacaaataaatccaaaagattaaggtagagagaacacgaattagatggagctttacttaggaagttatattacatgtttaggtgaatatgtgatatctgtggaaacaacatggaaccccagtgtgcaaagcatggctttggtctttattctcttgttattctgccttaggaatggagggagttgacaaagagaaggtgcagaaggtaatctacgaaatgagcaagggttcaaaatattttgaaaatgaacagaggaaagaggcaattaccaaacaaaaaatcgaccatctgcgtgcacaatgtgcaaagctgactgacaatgacatatcacattttcagaaggtaaagagtatttttttttaatgctggcctttgtctgtcgggtgctactttgttaattttaatgccatatttgaatcctaatttttgcagcatgcttaattttcaggtcgccgaacataaaattttggagctggaagcttcacgggatctttcaaagatatggcttcacaccgacatggatgccttttatgctactgtcgagatattggaaaatccatccttgaagggaaaaccattggcagtgggtagcatgtctatgatagctactgccagttatgaggttagcatactaggatttatgacatcttgacatgtgtaaggaattttttaatcactaaatagtgttggtgctattgtataccattttgttttggtccctattgaaatgattactgaagaatcgctgatcatgttgtgtaaaattagctttctttaagcattgtagactggatggacctgagttggtgttgcaatttatttatttattgaaagcacaatcaacatcccctgctatatagtgtagtacgtaatcaatttacttattcaggcacggaagtttggagttcgtgcagcaatgcctggttttattggctgtaaattatgtcctgagttggtttttgtccgtccaaattttgagagatacacttattatagtgaattgacaagaaaaggtttgtacattattactgtttattgaattaccatgaaatttttttagcgtatcgtaattgtattaatttatcgcttactttgtagttttccaaaggtacgatcccaactttgttgcaacaagcctagatgaagcatatctcaatattacaaaagtctgcttcgatagaggcattactggtgaggaggtaattatcatgacttcctggtgaattacttatgactaatgaaataaatatggtttgatttgtatttgatggcttacattatttttctacaatccagt

SEQ ID NO: 32309 - DNA, 22616 bp, Oryza sativa
  unsure (1)..(22616): unsure at all n locations
cccatattcttgtctttttgctaggtttgctctgatatcaacaagcctaatggacagttcattttgccgaatgaccaagaagctgtgacaacatttgtatcaacactacctataagaaaggtactcctgtttttagtagtgaagaatggaccttgtttctagaagtattttgttgttctaatagttcttgtttccttcatatatatatattcattcgtacattgttaaaccactaaatattctaaccagtgcgcatattctttccacagtagtccttcaaaacaatagcatttgggcattccccatttatggacaccactttttacttctttaattgagatggagttttctttactactaagtgctttgcctctttggacattcatgaaaaaggtgaaggctgattttttatttgaagatctttgtatgcagataggtggtataggcaaagtaacagaacaaatgttacgtcaggttcttggtatcagtacatgccaggagatgctgcaaaaggcttctttcttatgtgctcttttttctgaatcctcagctggttcgtatgttagtaacacttgttagttccattgcaagttttcagaagctatattatacctatcccaagcagacaccacaattcaatttcttgaaccaaacaccattctgtgcctgcttaatttgatcctttggacgttctccagatttctttatttcggttggtcttggactaggcggtactgaaactcctgagcaaagactaaggaaaagtataagttgcgagcgaactttcagggcaacagatgattgttctatgcttttcgagaaattaggtaaacatccttactaagttattgttctagctatgaggcctgttgattgtagatttcaaaccttgaagctactttgaaatttcatatgctattgttactaagtaactaggttgtcttacagaagagacttgcaatcttattcgaacagaagcatttttcctattttaatggtatatttgtcaataggccaagagcatattattttgcgcaataatttgagacacgtcatgattattcgagagcttgagtagaaagtagttgtttgaaattagtcaattatgctgcaacaagctgtttacatttgatgaggaaatataatttctggtgagtggtagttttggttgggatagcaaactatgcaaggtggaacttgttaggcagctttgactgcatacctgagatctggtgttcaatcttgatagtgctggggaccactggtccgggattgaaggatcccaacgctctatgaatatgagctatttcatgtgtcaattattctacatttctacatatgagatactagaagccaagttgactggaaacaggcaactaaccagggtttggtatttcagaattctgaaatcttaaattttggataaggtacagaaaaaaaaaagagtattatcagaacatgtgtgtgtacataggaaaagaactggtgccactataactatgtgtgtttgatatgataaattcctaaagtaactgcaaaaataatatacttgtatgtaaagcatttaaatgcgttaaaagattatgtaatgattttcaggccttaccacatgctatgtgctaaatctgtaaatgtttctccatgcgtgactcacacccaccatattattatttatttgcagatagtctcgcagacaatttggccgatgatatgcaaaaagaatgcctgaagggaaggacactaacactcaaactaaagactgccgcttttgaggttttcatcttccatttgtataacattaactagtctccagtaattataggacttagatcaccaggagtttttgttcatggctcattagattgatcaaccatctaaaccaggtcaggacaagagcagtaaccacacaaaactatatcaactccaaggaagacatcctgatctacgctaggaaattgcttaaggctgaactgcctctttctttgagattgatgggtaagcatgagcttccatagtatttgatactgttattggatgatgcccaagttgatctagctgtgttgacagcgtaggcatgtgattatgccatggtgcatgcttcttttttgaccttatctggaatgtaatgaacataaaagacatggggcaggagttttctttgagcagtatatggattaatgttgtgctccttaaaattagcgaatgaattctcctcctttgatgcattaggtagagttcctgccctttttttattaaaaaaataatataaaaggcacactatgtactgatttttattttactatgttcatatttttgatgtatctggatgtattgcattttatatattttttaatatgtttgctcttgtttcccaatggagtgagtaacagtcatgccaatacaattcaacagggttgcggatgtcccaacttcgcgatgagaaggatgattcatctacccaaacccaaaagacactagatagatttttccgcacgcctgacaactcaaatgtcattggagcaaacagtccaagcatcggtaataccacaggaggggataactattgcactaatgtgatgaccaaggtcgattatttagagcatgattccatggatgatcaggcattgtttttgcatgaaaagaacttatttgttccagaaggaaggagctcagacaattataataatgatgctgcatcaagcaatccacttatgtgtgatggtgttggtggaaaagaattggatgatgactcctccagttcgaaggtatgtgcttttgtctaattattccattgacaaagggataatattgattcaacaccttttaagtgtttctttactgagtgtttccatgcttaatgaaagacagaaagctaacctttttccccttgcagggtacacatactgtaaagtttgatggccagctcaccagctctaacgcaactacttcatcgagtaaacctgatcagcttttctggataaatggctacatttgttccatttgtggatttgaactacctccaggttttgaggaggagagacaagaacattcagatttccacttggctgaaatgcttcagcaggaagaggcagtggacagcacaggccccctctcgaaagagaggtatgtatctattgccacacgctcatagatatccctatgttatttcttgatctgctttagttcagtgacgtaataaatattatttaacgagatgtaaatcctgaagtgttttactgggattattactgtgggtgagttgccttttgccatggttatttgaaaataaattagctgagatgaagaatttcatgggtatgaaccttttttttccctgtggagctgttatcatgtagacatcagatgaatttcatgggtatgaaccttttgtgtattcagcaggttagctgaaaggccatgctctagcacacccacaccaaagaagaagctcaagtcttcaaaagaaggaaaacacatacctattgatgctttctttcacaaggttaacaagaacttgtaacatactgtagctacctattcaggcactctttttaatcctacagagcgatttgcccacttgaaaaactgctgtacatgtaacttcattccatgttcttttcagactagcatgtaaattgtaaatatataactcaagaatcctgttaaattaatttcataatttattcaaatgtcatacgattctgcacgagattttttttctgacataaagaagctctaccttatagccatttcattgatagaaatgataagttacgaagttggcacgattaaggggaaaatgagaaaaggaggaggaaaggaagaaagagagagaggggggcacgggaatgtacaaaagttgaaaaaaggactgtacattagcctcgtctgattagttcagaccagaggctgattttcgttttgatttagttgttggcccggcaactcggatggtccggagaaccgatgatttattgctctgtgtttgaccacccatattgctgtctttcccaaattctgttgtccatcgacttccatagtgcgtgagcggaccgcacgttgcaaatcacatggtagcaggtcgccactcctccgtgacaataatataagtctggtctccgacatgctactttgactatctatactatataaaagtgagacgttttaaatacaaggagctgtgtatcatgacaaattgcttaatgatgactgtagtaatatcactttgtatatgatcgatctttcttctattaatacttcatgtatataatgtgacttgtctctatactaaacatattcatattctgagactgagggagtaacacatgtctaaaaataacctgtcgagctggatgatattatctgcagtctttatcatcaggcaaattttttgaccatgttggctttaggatactccatataatttatccataaaaggcaacgaaaggaaacatattgaaagcaaaatatttgacagggagaagaggaaatatcttatctgaagtctgaactggttgctatcaagcacacaagcagccaaatctctcccagtgaacgtgtttactgtgttatcctgggaaaaaacaaagaggagaaaaattctcaaaaaaaaaaaaggtgaggtgaacggtagcaatgcacagcggcgtcaatggctgctgcccgcttcggctccccgccgccgccgctgtccacggccgccggatcccgccgctgctgcccccacggggggcgtggccgggttgtatcgccgcgccggcgctgcacaggaagcccggccgcggcggcggcggcgcgctctccagctgcaggcgagcatcgcatcatgtccgtctcttccccctcactcgcagttctgttattaatttagtagtttctgctagaacttgctactgcgatccactgatcctctcctgctgctcgatttttttttttttttgtattctcgtttttaccttttttttttttttgggcactgggttctgaattctgttaatatgcgcacggattgctgcgttagaatcatagtgtgtgtgtgcgcgcgcgcgcgaataatccatatcgccgggtttctcaattgacatccttagctggctaaaaatcgccgggtttctcaattgacatccttagctggctaaaaatcatggacataggataatgcaatgataagtactaatttctgtcgtggcaattggtctgtaataacggcttttcgacaagtatttagcaactaaaattcaaccttgaattttattttcctgttagaactgtaaaattaaatcacacgtggtagtttgcttggatgtaaaatcaagtatatttatgatacatcgcatccttttttctgtaactactgtaacgttctatgagctagaaaatattgcttaacctcctgtcattgataactctgaacatgctataattaacattgtctaatttttaatgccattataaatccttttcaaaccttcatattctcaaacttgcattagtagtgttagtgcactaaaatgctaggttcttttgcttgtattcctctaagtgggtttgaactttgaaatttaagcatcaagtgtgtggcaggagaagttacaggttgctgcactgccatccaaagctacactcgagtttgaacatggtaattttgtaattattcaactgtttcatcttatatattgcagtggagtccaagtcatgcccatattttctgatttgaatgcagccttgaaagattctagtatctaagtatgttgccaaaaaatacatatactcaggtgtctcacttcgaagtgcatatattgttcctgaagatgttcaagctgcagggttccagattgatgctgatgaactagcatctattgttgaaagtcgcgacactaaaaagttgactgtgcatggccaattaaatgggatcgcagacaaattaggaacatcattaaccaatggtatagttacagacaaggacctcttgaatcaaaggcaggacatatatggagtaaataagtttgctgagaccgagattcgcagcttttgggagtttgtatgggaagcactggaagacacaacccttataattcttagtgcgtgtgctattttctctttggttgttggcataaccacagaaggatggccacaaggagcccatgatggcgttggcattgttgcaagtatcctccttgttgtttctgttaccggaacaagtaactatcagcagtccttgcaattcagggaccttgacaaggagaaaaggaaaattcttgttcaagtcacaaggaatggcttgagacaaagagtactgatagatgaccttcttcctggtgatgctgtccatcttgctgttggagatcaggttcctgcagatggcctatttatttctgggttttctgtgttggtcgatgagtctagtctaactggggagagtgaacctgtttttgtaaacgaagataacccttatcttttatcagggacgaaagtgcttgatgggtcctgcaaaatgctggttacagcagttgggatgagaacacaatggggcaaattaatggctgttcttactgatggtggggatgatgaaactccacttcaaaccagacttaatggagttgcgaatactattgggaaaattggtctattttttgctgtattgactttcattgtcctctcacaagggataattggccagaaataccttgacgggcttcttttgagttggtccggagatgatgtgctagagatattggatcattttgctgttgcagttacaattgttgttgttgctgtacctgagggattgccattggcagtcactttgagccttgcatttgcaatgaagaaaatgatgaatgacaaggcacttgttcgacagttggctgcctgtgaaaccatgggctctgccacagtcatttgcagtgacaagacaggaacactgacaacaaaccgcatgactgttgtaaaagcctgcatctgtgggaataccatacaagttaacaatccacagactccaaacatgtcttccaatttcccagaagttgctgtagaaactcttctggagtccatatttaacaacaccagtggcgaagtggtgactaaccaagatgggaagtatcaaatactaggcacccctactgagacagctttgttggagtttgcactgttgctagacggagattgcaaagaaaagcaactgggaagtaagattgttaaagtggaaccttttaattcaaccaaaaagaggatgagtaccattcttgagcttcctggtggaggatatcgtgcacattgtaaaggtgcttcagaaatagtattggctgcatgtgataagtttattgatgaaagaggttgtattgtcccccttgatgataaaacttccagtaagctcaatgatataatcaaagccttttctagtgaagcgctcagaacactttgccttgcttatagggaaatggaagaagggttttctactcaagagcaaataccgttacaaggatacacttgcatcggcattgttggtattaaagatcctgttcgtccaggtgtcaggcagtctgtggcaacttgccggtcagctggcatttcagtgagaatgattacaggagacaatattgatacagcaaaagcaattgctcgggaatgtggcatacttaccaaggatggcattgcaattgagggtgctgagtttagagagaaaagtgctgaagaactccatgatttgattccaaaaatgcaggttttttatacacctaataattttaaattttggttctgtaagtgtttatccatctggggagctctcatgtgataattctggtaactgaaggtactagcccgttcttccccacttgataagcatacacttgtgaagcacttgcgcaccgcattcaatgaagttgttgctgtgactggtgatggcactaatgatgcacctgcgctgcgtgaggcagatattggacttgccatgggcattgcagggactgaggtaataaactagtaacaccactgagtcatgagtacaagcacttaaaatctcttcatctgcaaatgtttatgtaaaaacttcactggttaactcaactggacctgaattggacatcgcatctagatatccttattaactgtattaactaaattgtgaaggatacctatgtagttaaatttctataagaaatatgctgtgagcctttcttttgtatattatcagtattctagttttctatttccaatgctatttaccatatcactggtccattggcttgtatttacttgtaatgctccatttgctgtaaaacccctttgatggcacaaaagtatatctgtaaattctattgtcgaagtcctctgaggttctcagaggatgtagctcctacattctgatgatgcacagctcatcgatatataaaatagagacaatccattatctctataaaataatagaagtcgttgccaacatgagatagctatgaaaagttgctggatgatggaagtagtgtggaactgtacctataaggctgtaataggcaatcttgatttaacttgctacatgttggtttactgctttttgtttggcaaataacatttctttttggaatttggaaatgaaatgaaaataataatctggttcgtggtttgtgcttttccattctgatcataaattcaatatcctctataatgttaatttgaccaagcgcgccagtttgtggtacaaactacaaacatccctgaggcttgtataaattgttttatgcaggtggcaaaagagagtgctgatgttgtaattctggatgacaacttctccacgattgttactgttgccaaatggggacgctctgtttatgtgaacatccaaaaatttgtgcagttccagcttactgttaatgttgttgcattactagttaacttcacttctgcatgtttcacaggtaaatcctctttataattctattaacttaatcagatctctatctcatcatttacatttctcttcatgccaggggatgctccacttacagctgtacaacttctttgggtcaacatgatcatggataccctaggggcgcttgcactagccaccgaaccacctaacaataacttgatgaagaaagcaccggtaggaaggaaagggaagttcatcacaaatgtgatgtggaggaacattgtggggcagtcgttataccaattcgctgtcatgtggtatctacaaactcaagggaaacacttgtttgggctggaaggctaccatgctgatattgtactaaatacaatcatattcaacacttttgtcttctgccaggtatgttagcacttgcaaaataccattcttttgtactggtaaatttaggagcaaaaattatctctttaatatggaagagatatatcagacaagaggatctgtgtgtgtttgtgtgtgtgtgtaactttatccttgcattgccatatctttttaatatgttccagttttcattaattgcatgctttgtaggtgttcaatgaaataagctcaagagagatggaggacatcaacgttctgaggggcatggcagggaactccattttccttggtgtcctcaccggcaccatcttcttccagttcatcctagtccagttcctgggcgatttcgctaacaccacacctctgacccagcaacagtggctcatcagcatactcttcggcttccttgggatgcccattgctgctgccatcaagttgattgctgtagaacctcatgaaaaagccgatacacgtagaacgccgtaaaccacacacaccaggataagacattcaatcaattttgtgcaccaataatccaagtatacctccactctatgatcaaagattggcagcattttgcgaagaaaatttgatgcaatggagttcctgttgggtttggccaatctaaccagccacgaaactgatgagataagagagccaattagtggttctgggaatatgtagaagtgattttttttgaggtattattttgtacacgctgatctagtattatgaaaatgtaaagccaactggcatagttgcgtagagtgtaaacagatgagattgtacataaatacaagactgacatttgatgatagcaacaacgatcatattcttaagagaatttgattcattctaaaacatcagttgcccagtgaaaacatttcaagtgtttcactacacattgttagtactaaaaatttactggtccatggtacagatcgaacttcctttcgtcaggctaagtatgaaagttggtacttctcacatttgcaagaacaatagttaattattgacaactagatactnnnnnnnnnnnnnnnnnnnnnnnncccttcaataccccattgcctaccttttacctaccacttcatagtacttattgataaggtgcactttggtcctttaccctcatcactgaattatcaattttgttgatgaagggagtagggttttttttttctcggggagaatcagcaattgccatcccaaatcagccataagtagggatggcaatcataaaggattgcatgtttatccgtgggtaaaaactctactagtattaggatttggtatgtcttcaaatttatgctccggtcaaaacttatgtctgatgggtaaataggtatggtctccacttcatctattttctcatcaaacataaccaatatgtggatcttactactcacaaatatttcaatatacacttatcaaaatctaatttctatggtgtactacgatatagtcattttacattaaactcatgtttaacttggtaaaacaatattttagttgttagttaattcatggatgaatttattaactagatgatttttctattgtttctaccatatacatatgattgaggagtaaaccgcatacccgcatgtatatgatgcctgtgggtaatgggtatgggcaaggttttatgcccatcatggtaatgggccgtgggcaaaaaaattatctcgtgggcattggtttgggtgtgcatctcccgtacctgccatgtctaattgacattcctagccaaaaggccatgataacgcaatatctagcgttataaacaacaaacagaatatagcaccaatgtgttttgtctggataaattccttccgtgccactaaaaatttacttgatcccttatttacccctcattatctccaatgacacgtggataagaaattggggcatctttgtttgccctatggcttataagccaatgccaaattatgaattgtaagacttgattttaaagttgatgttttttcaatataatatttttttcagttttggcttttaagttgctaaagatacatacacaaaagttttactcacaatacattttttgatcgttaataagccgttacggcttataatcagccgtaagtaccaattgggacccaaatgtttccggtggtaactaagagattgccttttgttttttttaatttggacgtgacggtctgacttgggccataggatgtggtctttcttcttaaatttacttaataaaaatgtgaattgtggattttgtatacaccagacaatatcatttagaggttgcatatttgatggattgatttattttcagggtgacatggctcattagcccctttctatttaaagtaatatttaattgcataatagttgtactttccataatctttataatgaagataatacttaattacctctagtgactgtggatggcattacctcttggataaaattgatggctcgtattaaagcggactactaattttccatttatattgatatatgcatttgttatttaggatgactcttatgtactcccagatgtacatactccctcttccatattggatctaataggatccaattaggacctgcttagccggtgggaaattttttttgaaattcctaattttcagccgaacagggaataaaccaagtaaaaaaaaaggagaatagctactttagtccctaaagtttctctataggatcagtttattccctaactttttaaatggtccaaagaaatcttaacctttgtcataaggcctagaatagtccttgggtccactaaaatcatcatatgaatatgccatgtcatcattcatgcaaatctatgatgaattgtccaatatacccttacgtatatcatagaaaaataaatataaggtgaattagacataaccataggaaaaaaaatacttcttttttcacccttttgaggtatatttttgctcttacatgtaccatatattttttttaacttttttcttttgttttttattttcctatgcgtaagggtgaattggacaaatcatatagattttgcatagaaatgtgacatggcatgtccacgtggcgattttggtgggaccaagaactatattagcccacatgacaaatttaaaggacttgtttggacaatataaaagattaaggactaaaataacccaggagcaaaactttatgaaccatattagctattctcccaaaaaaaaattaagttgaaaaatatccatgcatgtcggcatggaattggttgcacccctgtatgtccgaatttgaaatgtagtatttgtgcacctccctgtagcatggaaattcatgacttatatactgttttattttatgttttattttagattaggtatatacttattttttaggaaccagtatatactatatctctgtttggaagagtatatactttttatttgatgatccagtatatactaaaagctggtttgagaagtatatgctacttaatttaagactattagtatataccgttatctttagagtctattagtatctgccacttgttctagatttatagtatatactacttttctaaatttgtagtatagtatatactgattttctttttgtttaatgagcatatactgttctatcttgagaaatgcccaggggtcttccggctagctccataaggtggtgggctagacgacctgggttcaaagcctcacccctcctaattatttgatattaggtcctttcctaatattctagttttatatactgtgatatctttttttcagtatgtaaagagtcagtatatattgcattcctcattgaagatctctttgtttggtcagtatgtagctctctgcttttggtcttttgcggcttcagatacgtggagtaatttgtttgaatttcctcattccaaatggcgaccgttctacaagaaaatattaaaatattatatcagcatccgtaagaaaatatttgacgcatcaatacatgtaatacgacatagaaagacatagaaagccttaatctctgcatcctcgctgacatatcagttagtagggatcagagaggcagagactagtagtatataccatgctgacatatcagttagtagggatcagagaggcagagactagtagtatataccagtgtttctagagaacaagtataaatcacttgttctagattcatagtatataccacttatctaaatttgtagtgtatactgaattttttgttgaaggagtatatactgttccttttttttggggaatacatactattcttttctctcttttttttcagtatgttactactttttcggtataaaaaagccagtatgtgctgctatattgaaaaagtccagcatatctatggaaaattcagtatatacttctgtgtaacaaagttcagtatatacttgaccatagaaaaattcagcatatagcactccatagaaaataaaaatcagcatatacccctctattgaaaagttcagtatatttatagaaaatgcaatatatactagtctaacaaagtgatcagtacatacccctccaaagaaaaatacagtatttactactccatataaatgcagtatgtacagagcatgccgccatccagcatattgttctagcacgccgccatccagcacattgtgacgagatcgatatggtcgcagcagttggcatcgatcgttgccgcggcccctgcgtttgttgatgcatgtgaaatcaaataaaatatgatgcatcaattatgattgacacaatcacctgaccggaattactgctgcacgggcagcacggcctgtatgccagccgatggatcgatgccgtcgtgtcctggacgctggccgggaagcggcgcgatggatgacgatggcgccggaagcgcctgtttctaccagacaaatcctggtagtctcgttggatgatgatcatcagttggagggggctcgccgttgccgatgctgtaaaagctagtggtgtgggtgtctccagcgccgcttgttgccatggttgtatgatttcagggagccgatggattgtgtcgtcatcgcctccggcttgccgatgggctgcactgtggacaccaatctagtcgtcatgactcatgacgtggccgtggactggttgtcgatcgaatcgtcgccgtcgatgccgagttgccgacggatcacgctgccgaaaatcctcgatggatctagaagaaaaggagaaaacaggatggacataccagaatcaatcacctgggaattgatcaagccacccgcaggtggacgaactgcattgccgccgaggccgtatgattcgatggatcacgtcggcgtcagcgcgtcgcctccaaattgaccgatctgttatttgcagtccggtttagcagtaagtcggaaagagatatttatgctagcatcctggtatggttacggttaatgcgggatacaagtattacgaagattttttttcgtccgcaaaaactttaatgggtccgtacgtggatccgttagcaggttcgatcggtggtgtctgctgatggacggtggatgagagcaggagtacgtacacctgggtgtatagaattattttcctttgttatttttcaaataatgatatatacaatttatttttagtactcccttctttcaaattactcgtcattctagcattcaaattactggacatctggaagctaagattgcttgagcaaatggatggaagcattcctacggcatgagtcaattataattactactaggtaaactctgttgtatattaccttagtcctaaaattcagcatttttttgcctatgaatctagaaacacagttatccagttatccagattcataactaaaaatgcttatattctagtacggagcaagtaactctgaagttactgtcgtaaaagtgacgtttgggaccttgggtatataacccgacacaatggataaatgaaatcaagaagtaacaaacactatccctgtctcgtactccttggtagaacttagaatttgataaattttgttacagaatatgaaaactttgtggttttagccgttgggcatcacgcgaaatgacttttggaggaaaacactatgtaactatggttgtttgccaacagacatcacgtctattattttagtatttacatgttgatgacatgtgagagagcctacgttttacatggcgtgaccaaaatgcccctgcattgaaacaacatattgctatacctacaaggctacaactagtacaccaacgattgaacacactgcaaagtgaacatagctcaactgattaggttccttatggtgaaacaagcccacctaggttcaagacctaggcttaacatgggtgctcgtatttatatctatttattcttttggtgataggcatcgtgtccatcgacgttgagacatcatgatgacttcatcaatctcaagatatgccgacccaatccttcgaagatgttcatagaggtagcgcgtgcgatgtgcctatgtgcgttcatagagatgagtgttctaaaaaacacattaaactttaatcgcaatcatggcactttgaaacttacaaaatcatgatgtcctatagcaaaatgtgccttagaactgttttgcgacagccacagataatgaacgattgtgcaagttgagggccacagatcttctgaggtgaaaagttcaaaaaacggactaagttttaatagcatattatttcgtcctgccgatgtcaatatacagtggaaacataagtactactactgtacaaggatatcgccagtgcttcgcctacatcgcgctgcatattgtggctccaaaggcaaactgatttactaagtgaaataagacagtaactgttcaaataaacagaggaattccactcaaatagacatttccaggctagctgtatgacatattacttaccaagttagtaacttcctaaagcaacagccaacacatcttgatcttacagtagtatgtacatgatcagacgtcagagagaattgatcttatcaaagctttggcactctccagttgctgcctcgattcctcgctgtcaactagatcgtccatgacatgcttgtcaatctcaaagaagttctcacgaagtgaatcatgagcaagatgcagcttctccgatgccgaggagtcactcccaagcaacctgacacagacaaagcgtgtcaagcccaagacaacaccgtactccgctctctgcagcgccaacttgagggtggacaggaagacgccagccacagaatcaagaattttcgggctccctttcttcagaagaattaccatcatttctgctagttttctggatgactgtgagtcctcactggcctgctcgctttgatcatcatctctaggtttttcatcatcaagcagctcattcttggccaatgcaaccacccatagtggcaagcaagacccaccaaagtcacacatgttaccctcagcctgtggcccaatcaaccagcggcatccaagacccattatgacaactggtagccactgctttacgacagaaactaaactgagagcaaatttggagcctgcagcagactcaacagagggtacaagatcaagaagattattggcaagaaagaaggcttcctctgggggactctgtgactcaattgagtttgctaggaccaaatgaagcagcttggctgcatatgtgaaggaactccgtataagcatcaatatgtctttcagatcattccctttgaaagatgagctctgctcctgatgcatttttatggctgatgatgcatattttgtgaaggacaatgcaaaattgagacatcctactttattatcactgatcaacttgatggttattgtgtcaacgataaacttgagaattgaagtgccaagcatgtatacattaactgtccctctcaatgcattccctgcacaagatacataacccactcatttacaaggtatatcatgtgataatgccagatagataacatactgattttggtgactacaagttgaaagttttaaagttaattacataactactttctctagcatgctttcgaaaatcatatcaatattccgttaataaataaagtttcagatcaaagaggttttctgcatcaaaagttgtaaatatctgtgcaggtataccttcaggaactccatgatggtgtttctgccgtgcagatttcttattctgcttcaacttcaatgagtttgtggaaccagtaacagattcatttaggagtttgtcaaaacaattcagcagatggtccagtgagtgattgatggttgttgactgaaacaagagatcaaacttatgagaatggcaacatgttaattgttaaatgaaaaaaaaatgttgaacacattcacaataatctacataaccgtagcaaaaatagcttaagtgcaaccaacaaatatcggttccagttaccatcaatgtttgaccagatggctagtgtttgagttcatcaacatttctgtgacaactatacagtgaggtggaactgactgttttatcaacatttttgtgccaattatcaaagaaagtgggcatggtggaatcgtgggggttaactcacctcagaggtgctgatatcagtttggtcaatatcctgaagagcgctgtgtgtagccaaactcaaataagccaaaagaggtgtggcatttaaagagtcaaactgcaggcactgctcaatgtacacttgacaaatgaccttcagagatgaaaatgcgacgtctgaataagaagattgtagaaaggcaactctcttttcttcatctttcagtatgtcattaatctgccatgatgcacctgcaacaatatcaaagtcttcactggatgacccgtttccaatatcatgaccagactttgctggtgttttcttaagtgattttcctttcttcctctttgaagtagcaacgggacagataggaggttctatatcataaatctcagcaaaacaagacactttagattgcagaatatttgtcagtgcttcaaacatttcgtcagaccagccacttgaaaaaaccaacttatgtgctgctagcactgcttcttggcaaccttgttgcgtggaaacccctgcagcgttcatgactacattcatgcattcatcgtgcaaagcagatagatcatcaggtgatacaactggagccatactgagtagagcagaccgggctcccacagaaatttctgttttaaagagtagcttcaactttgcatttgcaaagaattctcttaaggaagctaaactagagcgctcctcagataagcttttaattagattggctgaagcaataacaagaccatcagtctgttcagagttcattcctgttggtgccagtgccagagtaatagagactttgatcagttcaacaagggatcttgggggagacccttcagataaagcaaattcacaaaaccttgctccagctgtgggtgacctctttataagtgcaatgcagcgagcacacgcttctttcagtggcaattttgttggaaaatatgaagggatgagaagctttgtgattttctgtgcgacacgggggtggtcatttgagagtgaagacagcaaagtacccaatccaacaacctgaaacaaaaggcatacatctagtttgtttgttcaaagtctcaaactgaagaaaataaagatccaaaggttacttaagttacagaatcaattatcacatgcatatgtaatgaagaagtacgtaatgtaccttattaaactggaaagatcgaagatcacgtatagccaaaagaagatcaactgcagaagatctgaccgataaagcaggatcagagaccatgtcacttaatcttggaagtagaactttcagtatttcatgactttgcggattgtcaagtaagtatatcagaccatttatggttgacacccgaacctcagtgcaagaatctttggatatgtcatcaacaattttacttaaaaattttgaaatagttagggaaggaataacttcccaaaactggttaagaatacgacagagtccttcaatcgcaaccgttcgtatttctggacaatcgtccatgagaagtttgtctagcaagaagtattgcttctctagtagaggatcattgacatcctttgtcacatccgggtcttcaagggggaacaaatctaatagaaggtgcaaagaattatggcgtacattggagtttgcaacctgccaaacagtaatgacttcagataaaaacggaaacgtttaaagcataaactgttctatatatttcttatttgttgatgcatacatgtcataacttcaggttgtgaaaccaaaaagtaaaacaaactattgagcatgcttttctaaggaagagcattcaaatcaaagcaacacataaatcatagttttcattcacaaatcacaaagaataaaattggacagcattcagaaaagattttgagctgtaacatattgacattatgtacatgatattaatatccatcgatctaatgtttgcgcgaatcaattattttatcaacatttggatggggaaagaacatagaaccacaatactgagcaatttcatttgtacagacacttaataactgactctactatgagttgtgaccacgtggaagttcaaccaaaagaaagtgataaaacaataatatcatatgttgtttagcactcatgttgataattggacaatctacttctttttgtaagccataaatttgtcaaacacaaagaccaaatagggaaagaaaagttggaaacaataaactagcgcaagtaaatcatagtccacagcgttgatgtctagagaataagggggagtagttagtgttttagtactgaatgttgaagagacaggaaagaaagacaggaaagaaagacaggaaagaaagagaatcagcgataaatgttacatgcatgctttatctctatctctatctctactacttaaaaaataagagatgtttccttcgtccgtcaaaacaaaaaaaatagcaaaaaaaatataaaaaaagtccgactcctaccgattccctctcagaaaaggaaatcgtccgtcaaaaaaaaagcgaaaaagataaaaaaaagtccgactcctaccgattctttctcaggaaggggaaaaaaatcctgactctagattcacccttaaaaacaaaaaataaaattgatgtaccggattgaaaatctgtttccaaaaacggaacctaccgattgagagcattccatttttatatgattttaatttttgggtctgtacttttgcatttgagtccatgtaatttttatatttacatttgagtccctacaatcttgaaataagatacttgagatcgtttttgattgaaaaataataaaagggaaagaacaaaggcagaaaggtgcataaaaataaaaaaagaaaaaccacacaataaaataaaataaagaaaaaacaaagaaaaacaacaacaacaacaacaaaagtctgtttatcctaagtggcgaaaaaaaaccgtagatccgattcctatagaaggcaaaataaaagtggtgaaaaaatgctagatctgattcctttaaaaactgaaaaaaaaaagtctgattcctgtaaaggcgaaaaaaaatccgaaaaaacatctaaaaaaagttcgtccgattctataagaagaaaaaatggttcgtaaaaaataaaaaatgcgcgcgagaaaaaatggaaagggcaaaactaattccgatttctaatcagtatatatctcttcgctatgtctaatctaatctaactatttaaaaagagaaaatgcacgacaaaataaaaacggttcaaataaacatgtgagaaaagtcagaaaaaagcgcaaaaaaaacacactaaaaaggttttgcatcttccataaaaaataaaaaaacacgcgagaaaaattatttccatcgtcggtaaaaaaattttaaaaaaaacatgcgaggaaaaaaaatgttagaaaaaacgcgccatttctaaaaaatggtttgaaaaaaccgcgcaagataaaaatatcgtctactaaaaaacaaatcactctgaaaaatctgtcagaaaaaacactaaattgatggacgcttgagccggataggatccatcgattttttgtcatctactacacggtttttatttcgtcatatattctcctgtattggaaaaaaacaaaaaagaacattcgaaaaaaacaagcaaaaaaagcgtgagaaaataattgttagaaaaaaaaacatgcaaaaaacacacgagaaaagaaaagaaaaaagggagaaaaatacggttttcgttgtaagtaaaaaaagcaaaaagaacatgctaggaaaaactgttagaaagaaatgcacctttctgaaaaatggtttgaaaaaatcgcgcaagaaaaaaaacattgtttataaaaaacaagtcgctcattaaaatacaaacattgtcattgacataattatgcatgaaaaacatatattatcattagaattttttcacccgttgcaacgcacgggcatttttgctagtatatttcaaaaagaaaaaaaggcttgcaggaagccaggaggtatatgccttacttttgaaacagagggaggtatttgctgaaccatttaaatagtctacctattaccagatcatgttaatgtgttattgagcttgtcgtactgtttgaccaatgtaacaaagaataatcctagtcaagcagcaccatgattgatatgtctatgtaatgctagaagaccaatactccactcttcgctcttctaccattcatcataactactaattttaatttggctgtaacttcatgtacacaagtagtgcataacaattttattctgtgatgctcaccttcgacccatccataatgaatatcgtaagcacatcatactagttactccctccattccaaatttatctacatatagtttttttgaggttattcctaaatgatctacatatttgtgttcattcattaagtctattcgttatttgtgcatcggagtaaatggacattgatgcatgcatccatgcacacaagtatttataacccacatgcaatattttgatttgctattggctaggaaatagtgggaatgatacatgcattgagtttgttgctagagtaaatatagtatgagagagttattagcttttcttggtcttggtgtacctataaaatatgtagatcaatttggaatggagagagtaatacattagcacaggagcagaaaaagatactagacagtttcatacctgcaaagaccggaacagcacgggctcggcaagctgaaagattaatttttcaactccagccaccattctctgctcgacgaacgcagacagnnnnnnnnnnnnnnnnnnnnnnnnnnnnnnnnnnnnnnnnnn

SEQ ID NO: 32310 - DNA, 4544 bp, Oryza sativa
  unsure (1)..(4544): unsure at all n locations
tgcaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatcatcttcagtagtgtagcactgaagagtgaagacatctgaacaaatgtcataagacgcaggatgcaaataacaacaaagtgcatacttaactatccatcatagacagcaagatcttaagtccttgtctgccttagttaaagacgacagacaaatcaccaggcagcacacacaccaggcaatgcagtcatacactgacaggcttcaattcaagttcatcaaatcaaaagtatataattcattacatgaatgagcatagacaaaatggcaccaatgcttcaattcaagttcaccaaaaagtataattcattacttcaactgctcataaaacattacaactgaagaatgaagatgcctgaacagtgaaccctcaccatacaagtgttccaacacatcaatcaaattgcaaataacagccttcaggcactttcatagcgtacaagtgttccatacataattcagatatccaaataacagccttacttacatgagtccaacaatttgtcacccggtttgcttaaaacgaaacaaggaaacaagatcataataacctatataacaatatgaaccataggacaaataacccccaatgtaataactcacatatctgaccacaacttaatagctataactctctagtattcacatttcgcctgtgtgctaattgtataattcagttctcatttgctttgtgcaactaaatagtataccttatttacggcctcttctttttttccccctcttttcatgtcattatcaaagagagaggagattaggagggagtgagagagtggcgatcggtgatggactgacacgtatgatcaatggccgaaggaaaaccggtcggcgggggtgatggagtggcggaagtggcaccggtggccgtaggggcagacgccgccggcgagcaccatgcggcagacctgggtcttgtaccgagggtggcggatgacggggccgaactccgcgacgccgtgggcgaactggcactggtcgccgtaggggcaagccccggtctcctcccacttgttgcacagctccgtcttgaacatgccctggttgtacacctcgaactccagcccacccatgggcggctcctccttcttcacaccaactttgtgctcgcctccctccgcgccgtcaatgcccacgaacacgcgctgctgcttgcattgtcgcatcaagaacatcgtactagttaggattgggattttggattcagcacaggagtcagtgcgctgcaagagtgggagccagacacaacacaatggaggaattgggggatttggtctcaccgagccgacgttcaccggcttcgacacgcgatgcttgccgccctggttcagcttctggtatccggtcgaacggatggagatgctcttcggaagaacagcctgcttctcggggacggcgacgggattcatcagtgcggccggcggagactgcggcggaggaggaagagctggcacggtctgctccttggggaggcggaggcggcggaggtcaccggcgagggcgatggcggagctctgccttccgccgaacttggcgatgcggcatgcgaggtcgttgttggcgacgcggagctcggcgttctcctgacggagcgcggccgcctcgtccgcggcatcggcgaggtgggagaggcagagctcgaagcggttggccatctcctggtactggagcgcgaggtgggcgaggtggaggcggtgctcggtcgctgccgctgcccccgcaccatctccgtcgtcgacgacggagtcggaggaggacgagcagtgggagaacgaggcggcgcgccgcggcggcggcggcgagagcacgcgggtagggctgaagggggagtagcagccgtagaagagatctccaccgttggtcagcaggttgggcgaggagagccgttgatctccgctgccgaacggcttcgggccaaagtccgagtagaagcggcctggatgagccggaggtagaagagcttcctgcatagcggcgatctccgcgaacaactaatccctgcaagtaaacggatcaaaatgtcaatgaaaattccaacaaaaatcacactaaattctccacacgaagcgaaccaaaataaaaaaaaagtagagatgctttccacagaatctagctctgagaacaggaaaatcgtatcatggaagcaatcaaaaatcgcattcgaagacgcgatctcatccactgtaacagtgagaacaagtaatcaactagtttctaaatcgagaaccagactgattccacaccaaaaaacgggacaaaaacgctaagaaaaaacggaaccggacgcctgatcgcgaagaaaacgctgaatccacgaacaaaaactagtttctcaccaatgcagcacgagaaacagcaagcttaaaaaataaaaaagcaaaatcgatcaaactcgcatcccaagtggagcagaacagcacgcccaacccccaactatccactgattaactaactagtggcgcaagcgcaactaaatcaccaagcggttaaccccaagtgtagattggatcaagcagcacacctctcgattagcgctcaccacccggagcctttgattttgagaaggatgatttgggggagaaggggatagggagaggaggaggagggtgtcgtggggctcgcggctctgcctctgaatctctctggcaatctgaagaatgcaagtgctctgcacctgcgcatatataggccgccattccgtgcggtggattcggtggggccggtacgcagtacacacgctccgcgaaatggaagtacgtactgtgttgtacgagaaatggatcgcgcgcggcgaactgtttcttgccgcgcgtgggcgtggcggacgacggtgtttgggatttgggaattgggcgctgtgaccgcgggtgtttttgcacccctctcatcccgctacgcgtacgcgcacaccagcgaatacacctcttaacacacgctcaaatagagatgaaggccaacagtacttgttaatatcctattgaaaacacacccatcggcttgtgtattatatttatgagtaaattttactttcagtcacttttattatcggtatgtctatctgaatcactctttaaccaatatttttgttttagatcggataatcttatctttgttgtattttggaccaccctaactttcttatatatgaacaatctcagctatacttactcttacccgtcaatgaattcccaacctattttcttgacatatgagatgtagatcaatagatggataatataaaggatgtaagagtggtccaaagtgtcacaaagttacgattattggttaaaaggtgatctaatatgaaacaccagtaataaaagatgactcaaagtaagattcactctatattttggatatatcctagtgggtgaagttctgtacccaagatttcacctcagcatcgttggtgctttccattattcctaactattttcagtacgttaatgcaatatatcattattacaaggtccatggtcaattctcaacttgaaaaaaaataaacaagcagcatgcctaacatattcttaactcgatgcttcataacaaacaaatcgtcgagggtccactctgcaaacaaataatccaggtagctgagctactagcaaaatatatcccttgcacgttagacacacgacacacaacaacggtatgctaatatgctactcctatctagtgcggttcttgatgcaagggatcattacaaagcttcgcttgcttgctttgcttttacgggtccgtccctctctcggactccgattgatcaagcgagctaaccaacgccgtctcgggaaagatagttaaccaacacatgtacagaaaaaagaattaagccgtcaccttcccttttaacgttgcttccttgatacagctttaactaacttgccccacccatctcaagccatgccatgccatgcacacgtacgaacgaactacacacatcaccaaccccgacctccagctgctaaaaaaatactggggatttttttttttttggctcctgctgcctcgcgatatgatctcccgtggccgcgacgcccaaacgaattcgtgaggctttttaggtgcgtcgtctctgctttcgtttggcggcgacggcaaccgggatcaggtcggctagcttacacacatgtgctcggcgatccaaatcaatcagattagttatggacttgtttgttggtacgtgcgggtgaagacatgcacgcacgcgatggcgagcgcactgatgtgcaggttggacctgaaattaa

SEQ ID NO: 32311 - DNA, 13489 bp, Oryza sativa
catgcacttgaaacgggtaattatgtgccggtacgatgtacggatatgtccatgaaaaacttggtggagctgaaccatcattgtagcgagcttacaggttttgttatgggcctggcctgcttacgtgggctggtcgatgtcaatcgtgggccacgaccagagccacagcgatacggcataggaaaaagtacaccgaaggtccctcaacttgttatcgaattacaaaatcgtcccccaaccgtaaaaccagatatatgacatctcttaacttacaaaaccgttcgttttacatccttcggtggttttcacccggttttattcgacgtggcgggtgagtcagcatgggacccatgtgggtcccacatgtcaggacgccacgtcatcaggctctctcttccccctcctctcccttcctctctctctctcactcatctccctaggcaggctggtcggcagaaatctttacaaaaatagaccctgcggccctccatttaggcggcaagctgacgtggcacacggcgtcgtgacgtgccgtgtgcgcattttgagcttagacccttggggctaaatgtaatttttttccatgctaaaaaaacaattgactagttctttttgcatctgggctccttgccgcccttgcgaattttgcacggaggctccttccgcccagacagagggcggcaagggggccacgtgtcgtagccccccaaaacgaccgtcctgcaccgtgtgccacgtcagctttttgctgatataacatttctgttaatattaaaaaataaatctaaaaatgaaaaaaatcagtgttcaacagctactctgaaacagagccaaatatttcctgtagtgccaaatatttcctgcatccttcgtacggcccacagctaaatatattttctccactacaaaatgttggtacctagaatgaaatttagacaacgaatctggataaacttttatccagattcgttgtcgaatctgtacataatttctatccaggttagttgttctagtatggattaaatctcattttatattacaacattttaagacgatggtaccttcagaatagacaaaatgccaggtaaaacctcaataatataaaactcgaaaatgtaaatgaagtctgctctgccttgtgaggctacgctgttcagggaagcaggaaccaagtcaagcatggactgtaacatatccatcgtggcatccaaaaagcatgaatgaacaggacaatctgcagagtgcagttatcaaagatacagggtatctcaactccccaacgttgagatgcattgcaactctgcaagttcagtaaaatttaaaagaagcttagcatgaagatttattatcacatattggcagaaaaggtgtcaactgtaaggccttagttgtatttctgcataatctgacctttaaggctgtcataaatagaacagtatctcagtgccttataattaatggagagctcataagataatcacacctcacaatccatgcacgtaaactcggttcatacaagtgaaactctcatccatcagaaatgtctaaaactattatcccatttacaagtggtcctatttattattattattattattattattattattattattattattattattattattattattattattattattattattattattattattattattattattagtagtagtagtgattgttctttcgtgtaaacaccatatagtatgaagactaggttaatgtaccacatgagtaaataccaaccttagtactgttccgtgagtctttttaccgggtttaaccgttgagagagtcgttatacccaattttttttacgattgaggcgaacgatgatcgtacagagtcaaactagactttatttaaagcttttatcgatcgtagtaggccagggcaaaatcacttctctatcattgcccagctcttgatccgcaagtacgttcggcccaattcctagcaactttgattgtttaggcccatatttcttgcaggatactggatttcgctctcggtctatcccgtcttcgtcttcacgcgcggggactcggggaggctcaaaatttgccgttgcgaagtgtccctccttgtcgccggcgccggcataggcgaacaccatatttgtcttgagacccagactgtgcctgtgacgtcgttgcgttgaggacaagaaaacaacatgggccatgtcctgatcgatcgatccagaaataagttcactttaggttccttactttgatggtgtttgaatcttctgaagatgaagattaagcgttaaacgaggtagaaataacgtttgaataattaagttttaattattataaacttgaaaaatggattaatctgatattttagaacaactttcctatagaaagtttttacacgaaacgcaccatttagcagtttgaaaagcgtgccactttgatccaaaatttaatccactatttttagtggattcgaacagggcctttatcaacgagtatgaaatttatccctaaaccaaaataccaaatataacgagtcttccaattcacaaaaccgaatcactcgaggttctagacagtattatgggcatgttcactttgatgcaaaaaaaaaaaccttaccaaattttggcattgtcaaaattttggcaagatttcttatacagttaccaaaatttggtagcaaactaaatgtagtcacttttttgataattttaccaaaatttggtaaggttgaaaatggcatcaaagtgaacaggccctatgtctggttttaattgacatggcaagctgagtctgcgtgggatccacacgggccccacatgttaattgaaacactttcttccacctctcacttctctcccctcccttcctcatcctcaccgcggatcttctcaccggcttcttcccagccacacccctcccctcctaggtggtcgtgcggccgtgtgccgctgttgccctcaaaaccattgtcccacctacgtcggtgataaaatagtagagagaaacggagagagggaggagaggatgggtcactaatgtgtagggttcgccaaatgctattttttttatttagactgaattgccctgacacgtggatctcacactgactcagcttgttacgtcagctaaaaccggatataatactacctaagacctcgggtgatccaattttacaaattgaggaacccgttatatctaatattgcggttcatggacgaatttcggatttgccgataaattaagggacctaaagtgaacttattccatcgatcgagcatgagcagcaaggaaggccctggccggctgctcctcgttgggccttgttcttcttcgaaggtctctccaatccaacccgtgtcagctccttccctcccattcgaatgcgcctgcaagtgccagctatataacacaccaccttcttcttccttccgctccatctccgccttgctcccaatccctcctcttcctcgtcctcttcctcctcctcttgcagtgcgagctctcccaccgccccatcccctatccatggcgaccaaagcggcgctccgatcgttgtggtcggccttcgacaagcaagcgtcatccatcattgacaagctcgtgtggccttggctgatgccagcggacgataccgaggagggcgcgaagaggcgcgcggaggagattactgaggagctcgcgcagctggagaagaccaggatgacgacgtgggcgcgatcggtggtggagagcttcgacacggcgcctcctccttcccctccgccgctgagcgctactacgcctcatcctcctcctccgtcgcctgcgaccagcagcagcaggacggcgacggcgacggcgacggcgacgccgacctcaccgacaccgacacctcccccgacctcggccactttgctgtggccccggcctcgcccgacgaaggaggaggagggggagggcctgcagcgacgcacggacgcggtgctcgtgaagaggctgaggagggcccgcttcgcggcgtggacgagtgcggcgctgcacaagttcgacttcgacgacgccgcccccacggtgcctcctccgccgccggccaccatgatacctcccccgacggtgacggctacgatcacgccgctgtggcctccgcctcccccgacgaagaaggaggagcatgagggcctccagcgacgcacggacgcggtggtcgtgctcgtgcggatgcagaggagggcccgcttcgcggcatggacgaatgcggcgctgcacaagttcgactttggggccgctccccccacggcgcctcctcctccgcagccgctgcctgttgggaatagtcccacattgaaagtttagggggagtggcaccaacttaaaaggggaggggtcccttacctcatgagctagcttttggggtgtagaaaggctttctcccggttgggccaacgtctaccggttttgggccaacaagtggtatcagagctcaggtgccatgtctggagatggtgtgtacacgccgccaccgccgccaccgatccgtcgcagcagcggtggcggtggcagcagcagcggcaatggagatggtgtgtacacgccgccaccgatccgtcgcggcagcggtggcggtggcagcagcagcggcaacggcggggatggcagcctaggcggccatgagctcgtcgtgcagcaagtgaaggaggcgggggtgacgttacactaccccatgctcggggagaacaactacggcgtttgggcggtgaaaatgaaaatttttatgcgtgcacaaggtgtgtgggctgccgtggagggcaacgcaaccgatgagaagatggatcaaatggctctcgccgccattgtccaaactgtgcctgaggccatggtgatggccatatccgaaaaggaaacggcgagggaggcgtgggacgcccctcaagcatatgaacatgggtgaagagcgtgtcaagaaggccctactacaaactctcaagagagtgcttcatggtatgtacatgggtaatagtgagaaaattaatgattttgctttgaaggttaccacgatcgtgaacgagattcattctctcggcacgaaagtggaggagaccaccgtcgtggagaagctcttgcattccgttcccgacaagttccaatccctcataagcaccatcgagcagtggggggatgtgtcggagatgacggtgacggagacaattagacgtttgcgggcgttcgaggagtcctccaaggggcgacgtcgtgaaaacgcaggggaggagcagctgcttattgcaggggctgagcaacggctcacacgcactgagtgggaggccattgttgctaaagagaagaagagtgatgaggcctctggcaatggtgagaagaagttccgcggcaagttcaacaaatcgaagattgagtgccgcaggtgtggcaagttcggacacttcgctgacgagtgtgatgagccgcggaagatggccaaggcagtgacgcagcttgtcatcgcggacgcggatgatgagccaacgttgctgtgaaaccggttgtggaggtggagaataaaatccaacaagattagagggtgattgttagagttaatcttgttgtttatgttttcattatattcagtcatgtatacgtagtggtctgagtccaaattagctagtgtgttgcgtggcatggtgagctgatcagccgttagtgaaagcacaaagtggtgcagcactacactggccaaggtcacctgtgacgggcccaaaccctcatctttgacgacttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttggggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccacaattttgcacagcaaattcacaccccttgaaagccacaatttcgatcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacatttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatgggcctcaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatagcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactcctcgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttacacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctaccaattccccgagttcggccaggatgttctttggttccgagcgcctttgtgaggatgtcatcttcgcgcctcttcggtgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatctttttgggcccatattgcctccttgccgatgtaccctgcggtgcccagccgatgcgggtgctcattccgctgttgcagtacgcgatgtgcctcgctggattccctaaactcttgggtggttttgagagagcagaattcctcccacaccgcttcggttatttgagggtattcatcgaacggcgtatgattgccgggcgggttgacatactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattatgaatggttatatgtccaaatggctcttaaatccacatccaagttgcaaactagctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaactattcatagacaacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctagatcctggtggcggcggcggagaggcagtggcgaagaggtcgaggcggtcggcggtggtcggggatcccggcgtcggggaggtcagggtcggggaggtcggggaagtcgatggacggacggcggagaggacgaccggcggcgagggcggcggtggagacggcggcggagatggcggtggagaggacggcggagatggcggcagagagggcagtggagatggcggcggagagggcggaggagaggttgaggcggcgacggtggagatggcggtggagaggacggcggcggtcgagagagtgagtgaggaggcggcggtggagaagaaggcggcgagggcggcgaagagggcggagatggcggcagaaagggcggcggcgagaagggcagcggagatggcgccggtgaagatggcggtggagatggatggcggcggtcgagagagtgagtgcggcggcggtggtgcaggccggcgtcgggaaggtcggcggagagggtgagcggcagagaggtcggcagtggagaggtcgaggcggtggtggggaggtcgaggcagcggtggagaggagggcgcagagggtggcggagaggtcgagagggcggcggatttggcggcggcgaggacggcggtggagaggcgaggcggcggtcgagagagtgagtgagtgagagtgggcgccggatctggatcgatctagaagatgtccaaccctaggtcaaccctagtcaaactcacctgtgacgggctccaactatgtggccgtcacaggtggcctcacctgtgacgggcgccaaccgtggagccgtcacaggtaagaccacctgtgacgggcccaacactctgggccgtcacaggtgaggtcacctgtgacggccctacagatagagcccgtcacaggtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcactggaagatgttccattatgtcaaagaaagttggaggaaagtacatctcaagatgacatagggttctcacaagttctgcctgtagttcatctagtccctcgggatcaatgatcttctggccgattgcatggaaaaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccagaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcggggggccggctgtatctctgtgtccattgaaatt

SEQ ID NO: 32312 - DNA, 5132 bp, Oryza sativa
aggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaatttctggtaaatcctatcgattgtcctccactgcactgaatctgctgggtgcctcagcatagtatcgactttccgttcttcggcatgccagtgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaactcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcaagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacctgtgacgggccgcggccagatgcctcaccggtgacggcatcccgtataacccgtcaaaggtaatggtcactactgaccaattcgtttgcccgtcacaggtatcccgtcagaggtgtgaggatctggcgtagtgcagggagttcggtagattagcgtgtcattagtgtgctaattggagtcaaagacgcagctgcatgctgatttgttcaggacgtgcatgtaggaaggatgagtgaagtctgaactacatgcgcacactgaaattagttggtgagtggagaaattagtgcgtgcatgcaggattagtggaggtgatcctgctgcatattcgtggagtctgttgtgtaactgattgaccgggttgtgtggctaaacgtggctaagtgtgtgtgtgtgcgtgtggggctatttaagccatgtaattagcctgttaatcagagtgtggtgaatacaagtgcagtagtgtgcgtgtgtgcatttgctggtgcagtgccgagacaaattctccatcgtgtgtgtgtgatcttgtgttctagctaacagtggtatcagagtgtgtgatcttgtgatcttttaagtttggggggagtggcaccaacttaaaaggggaggggtccctcacctcatgagctagcttttggggtgtagaaagactttctcccggttaggccaacgtttcccggttttgggccatcaagtggtatcagagctgggcccacaatctctctaagtgccgtgcacactcgtgtggtgtaagcccgaagcccagtggaccgcgggtgtgaggcccgtatgtgcctatgtgttgggccggtcagtggaccgcgggtgtgaggcctgtatgtgctcgtgtgtggagcccggtcagggctaaggggcaccaatgtgtgacgggggagattgttgggaatagtcccacattgaaagtttagggggagtggcaccaacttaaaaggggaggggtccctcacctcatgagctagcttttggggtgtagaaaggctttctcccggttgggccaacgtctcccggttttgggccatcactgccgagtccgagcacgtcgacagttgccgcgccgccgccaccgactactccgactccttccccgaagtcgacggcgacgccaagtcctgccaccgagatcacctctccgcctcccccgacgccaccgcttgcgacggcaaggctttctccttccaccgcgccagcgacttcctcttcgcctctcgtcgactcaccaccaccagcgggcacggatccttctcccgcgtcgactgactccgcgcagacatcgtacagagttctgggcggtgctgtcgccatcattttaggggtgtggcgatttactacatcgtcacctagcactggaccggacgggaagccgatcgaactgacgactgcgacctctgtcaatcaaagggacatcgaactggttcttactcgtcttcatgttgctatctaattttttttcttcatctgcatttgtgttccatttctgatgatttctcttttgagatagctgctgattagtatgtctgcgttttggttctcccctaagctgaagcagacaattcattactgcagtatttgcctctattcatatgttggcacttggtattcagaaaattcatgagcctagtagctctctgtgtttgtgctttaactttttgtgacgactatgcatcattttctggataaatggagctacaatttgtcttcaagctgaaagaaatctgaatcattttgttgttctagaactagcagagttgcagtacatatgttatcctgtttaactttgtttactatacgcagagactaatccctgtgtggtgtttgttctcattgggtccccggggctagttcttatgtgtttaaatgctgatgcaacaaccatacttgttgtaatttgtatcaaactccctcaagattttaatgaatttggtcggcgaaactttagtcgcccacgaaaagcaaaatgggaatattgagccctccatgcccgaatgatgatttgctggtgattgagcttgctgtgtgcctttctgatcttatcatctgagattttagttcctgcagattcataacaactttggttcctgcagattgtagtctcagaagaaatagcttgaagtctttgaactaaaatgtgtgacatgttcagacttaagaatgcacggctagcattacttctgttcagtaaatagcttgttttacatccctgaatttgcgaagcttcccaactgtgagcacagatagctatacctcttttttttttctttttttgcgggaatagagagctttattgattagggcaccaaattacaatcctgccgcagcacatgcaaaatacaagacggagcttgatcacgccaaaccgcgcaatgagctgtccgtttcgcaagctgagcaagttcatgagcaaccctattacactctctattgacatggtgcacactcacctcttgcagacgcctaacagccgcttttatttcacgaagaagaaaagtccatctagaccgttccatatcctttcctgcgatacttgttgttgccattaaacaatcggattccagtatcaccggcaagtgtatccattctgctgccaagttgattccttccgaacaagcaagaagttctgcctcttctgcctgagagcatcgtctgagatagcgccaggagcttaggagcactcttcccaggcagtctctgataaccactccgataccacatcttccatcaccctgatcaaacgcgccatccacgttgattttggcccagccttctggaggtggttgccatttggacttcgtatgtatctccttcacagagggcttggacacaccccccaaggtatttccagatttaccattaggatcggctgtggcttgtcggacgagtgacagtatttccgcataattctgcaggaaagccaccgaacctgtcacagatagctatacctctgatacctgcatggctgcatatctatctgttcctctatgattgttataccactctattcagaaatactcagtgtttagaatttagtaatttgcaactttgcaactaatatattgccccagagtcatgcgtacagttgcagaggccagagagattacctcttgaatagtcttgaccttccattatctttttttaataaaataaattcaccaaccagcgggcctcaaatgatgttttatttggagaggaagcacgaagatgaatacggtagtcatacagacagacagttggcttgacttcgtttcacttccaaataagatctctgccttggccggcgccggcgacgcggagtggtactacgcaacggcaaattttcaggctcccccaagtccgcgcgcgtattctgaagacgacggaataggccgagagagaaaatacgaggaataagttcatctgaggtcccttaattttacaccgaattcgattttcatccttatagacatagcatacaacctaacgattttgtttcccctatgaggtataaaaaga

SEQ ID NO: 32313 - DNA, 10935 bp, Oryza sativa
  unsure (1)..(10935): unsure at all n locations
tcatgatagtgtgataaaagacgatacgttttgaccagaaaagcccatgccgttgttggacgaaaatcggattcggtgtaaaattaagagaccccagatgaacttattccaaaatccaatgcacgccgttgttgggcctttggggtttatgggccttaaataactagatcaagcaacaattgcttacacatgtaatggaagaagaaaaaaacgtatgcagagaataatcagaatattgtgctacatataaagaataacaagtatggggatcctgcagcatagatctatataatttaatgtttcctttttgaagtgtttaacttggttctgaataaatgacttgttgtttgcccttgtatatttagccatctttctgagttttctctcacttgtactgactgttcctaaacttgttgattgggtcacaagatagctattgctaattaaggttacattcagacctacctctcgtcccaaaaagaaactaatcctaaccataaaactgaatatatgtgtgtccagattcgtagctaggatttgcttttttgagaaaagtacgaattaccccctgaactattaggtgagtatgaataacacccctaaacttgaagaccagacatcgctcacctcgaacttttaaaaccgaacaagaaaccccccctgaacactgttgcgagcggtttagagttttaatattacacgtggcagtccagtcagcaatactttttttaaaatagtgtgcccatttgtcagattccccacccatcttttctctctcttctccgtctccttcagaaacgcgcggccgccccgctgtcccgcacgcgggagagagggcgaagcggcggggtgcctgccgaggccggcgtcatggagacggaggcgagggcggtgcaaccggagacacggtcgacggcgaaggtgcagcggcggaggcggccatggcttgtgtcagcaccgtgacagcgacgcatcgccagctaaccaccgtgccgtcggtggggcgacgggcgttggctgccggaagtccatggggcggagagctataaaaaaaagaaaaagaaaaacttcttccttcttggtggcgtccaagctctgggccaccgtgcatggcggaggagctcaagtgctcaactgtgaatcgatttgaagcaacaaacgttccgaattccatggacacatcagatcgagatcgattattatctccacctcaaaaaactgagtaatgattttatcgaactcgggcgaccgtggtacatggcgttgtgcgtggtggtggcctgcgccttggtcctctcgttcgccgtctttgtctgcggccacagctccggcgtcgttctcccccggagaggttgtggtggtggcggtggccgcaaaagctatggtggtggggctctctatctccgccgccccaccttcgccgtcgaccgcgcggcactcgcctccggctccatgccactggccgcgccccgccacgtcaaccctctcccgcgccgccgtatttctccgcatgcacatcgcgctactcctccagagcgggccggccgccgccgccgcactcttcagaacnnnncgaggagagaaatagaggtggggattctgacaagtgggcccgctattgtttttagaaaaaaattgctgactggactgccacgtgtgctattcgaactctaaactgctcgcaacagtgctcgtggggtttcttgtccggtattaaaagttcggggtgagtgatgtctagttttcgagtttaggggtgttatcacactgatcacccaaaaggtaggggggtaatttgtacttttctcttgctttttttatgggacggagtagtatttgctactaccggtcttctgttcctaaccatgtacgtgcagttaattaaacactcaatcgtcttttggatcgtcgaaagtccttgcctgacacccccagtctaagaacacacacacctatagcatgccagtgagcataaatgtagaaatttacaatggtaacacatgtctaggattattgtctatatattaattgatcgatccaatcaagttaaacattcatttattatgcaagtttgaacattcattcatatcaaggtacatgtgtgctgcgtagtacacgatcaatcttaaccattaaaatataaactcactataatcaaacagttaagtttttttttctttttcttcaattactgtgagaatttctagcctccacagcaaatatggtgcttcctttcaaacttatcttattataatataatagatagataattaatgtaaagtaaatcaaataattattgttgactagaatgtgatgatgcatacataaaggttatgacctatcaacttgaattgacaaattacaagtccatgcatcatcatatcttacaatcttcctctactccatggtcgtgcatgggacgagttgatcttatctaggactaaatatatagtgttacatgtcacaaacgtgcctcccatgaatacaccataccaaaatgagtgtaaataacattcgtaggtattgtagcgatccaaaaagcggaagcaacaaagatatccaatctcccaaataactcttgctaatggatcggcatcctgatcccctaatcgagtcatatccttgcatgaaagttatgtacctgaaagcacataggatttaggataaataacacagcagttaattacataagaaaaaaatggcactaaagatgtcatccaaaacacaacaagcccaggccaagacaaagtagtcaagccactcaatagtttttcaagttaacttgcaacagcgatctggatatgtataaacaaattaaacttttttttccaaaaaaaaagatttaaacgaaaactaggaacgataaataattaaccagcctatgaattagtggcaaggtaacaaaattaacaaaagaaggtaacaaacactcccaaaggtgtaatggaattaatttcgcggatacctgatccacctaacacaatagtaaccgatatagcctacctaaaaaaatgaagtggcttatattagtaaaaaaaatctttttttgatcattagtaaaaaaaattctcgatgacataaattgcaacataaaatttacaaaattataaaaattccttccccctaacattttttaatctcgttagaaagaaatcaagcgacaaggagctgcaccaactgttgtgagagggaagtagaatagaagaacataaatgtaggactcggtgatggtacttgtcgctggtgaccgtgcacgaccaattgggggagagaaggttgtagcggggaacatgatggaagctctggaggaggatagggcaaggaagaggcacactttgggatgatctgcattatacagcagcggtgttggttggctggttgcccgatgaggaggaggggagaggtgtaaggatcgaacatggacaagaacaagtctaccagaggaagctaggatggtgaacggtagcaaaaaccaaacaaccaaatcttttagcagaaataaaaagaacaccaaaacttaatggactaacctgttgatcacagtgtgatcgtccttctcctgctgatccgtctgcttacaaaataaggaaacataatttgactaaagttttgaaagtgcccacaaaaaaccctctctcatctattaaactcaagtcgttaccctagataaaccctagcttttctctattcctgtagttacttgctcttgggttgagcccttgtctatttataccgaacatctcttgccgtacggatccctgtttcgtcgcgcgcgccgatctcctgtcgactacgtacacgctccggccttttgtcagctgggcttgcagccatgggccgcctccagctgctgttgccttgcttccgataaaataagttcatttaaggtcccttctctgttgctgagtttgacattcttatggatcaagaaattgggtcttgaggagaaccgtttctacaagggacccacatcaacggccgataaaagctggcaagccgcaagtctagcctttcctcgtcgtcttcccgtctccttgcccgaaatcccaaaatcccccaaccgcccacctcgccatccacgactatcaccatggatgtgtctccggcgccgccatgggcggagctcccggacgccgtcctgctcggcatcgtccgccgcatcccatgcgcgttcgaccgcgcccacgtgggagaaatctgccgctcatggcgcaggacgctgctacagatcccgccaccgcggccgctcccggggatcctcctcctgacaccccacgggcctaccctgtccttcgtcgtcgccggcgacgcctggtgcacccaccccgccttcgtccccgaggccttccgccgcgcgcgctacttcggctcgtacgacgactcgtggctcttcctcgccgttggccaagacaacggccacgcgctcttcaacctcaccgactcccaggaggaggaactgcccaactggggcaccttccaactccacgaccgcgagcttggggccgagattctcctcgtcgccgccaccctctcgtcgagtccaaatgtacacggatccgtcgccggcggcatcctcacggctgaccttccgcccgccaactccatggagcacatcgcgttctggcgcacgggttctgatgtgatgtcaaaggccatcagggcaagcggggttgggccattggaggacgtcacataccacgacgaggccttccatttcctcaccctggacgacatcattgtcgtgtgcagagcgtcgatggcagagccagggtcaccaggcaagatcgtggtcgtggatgaggtgcatgtgagtatcgagctgggcaacatcgcgccacgcgatgaactcggttatcgcgacctgcgcatcgtagccagctacctcgtggagtcccgcaatgacctgctcatggtcgagaagctagctcccaacttgctgtcgccggcatcggcgttccgggtgttccagatgatcaaggagaggttacacgacggccaggttcgttactcatgggaggagctgacgaccaagctggatggccggatgctgttcgtcggacaaggttgctccagatcatatgaggcggctaactaccccggtttggacgcaggcgtctacttcttggatgatcggagcacccgccacgaccccaagattccatttcaagaagcccgcgcacggcggtatctctgcagcgacaacgggaaatggtcaggaacacctccccagatcaagctctgcgttccggatccaggcccatcgaaccactctcctcccgtttggtttttcccttgagacgacagatttctgacaccttgttactctgtcatgcttcatctgcactgagttttctgtttctgcttgctgagttcgttggctctcctcatgttgatagttgcctgattagtctcatgtagttgtatgtgttttgtttctgctggagtagaactcctacagtgcacaaatcggcaaatcacttgcagcagatcagtgtgtagttcagttcctgtactttacatcccttccaccattctggaaccttttctgatgataaccatgagcccgtacatctttgcattttcattgataactgatgtctttttttgaacggaactgataactgatctctgaacatctgcagttgtgcatgtttgtgctcgtttttggggtggatggagttttacttagcttttcttgaaattgcaatgaatctgacttagttttctgttgcactcattctgtatgctttagctttctaaaatttatttagtctcatgagagctctctgataagtaactttttttttatagactctgataagtaactgaagaaagtgagaacattgatgttctagctgaatttcagtctgatcaatggccattgtaaactactctgatcttaattactttctccccttattgtttcttggcttggtttggccgttgtaaatgactccgaccttaattactttctcccctttcttttggtttatccactgtgaattactctgatcttaatagtaattgtacaaagatacacaaagtgtattcccggaaaagtatcagactcatcaatggccgaatgatgacttattttataatcccttttccatacattgctagtagaattttaatgtcaagcttggtcatgtgttcagagctttgtgcacatctcacctgagtgtgtataggctcaaattattttatgtttggtgcctgcagattattctgattctttcagtgttgtggagttggtagcactaatagtccttttctagcagagaaaacttgaaactaaaagatgtctggttcagtaatcgttcttacaactttctggttctattgttcttgatgaaattgtatgcagaaataactgggctggcgttacatgatctttgtgttgaaatggataattcagtgtgagaatgtgatgttaattacgtaaaaaaaaaaggaatgtgatgttaatagtgtttagacattcctgatagttgagggtttcacttgtgaaccgggtttacatgcacggattgtgaagtgtgattacgttataagctttctaaatgataaggcattgctgcatggaatattgttctatttattatattattaaaacagttttgaaagtagacatcacatttattctggatgctaaaaattatcacattaatcgaagaaaaaattcaagtaaaaatacaatttaaaaataactgaaattcaaatggtctccctacaccgccacatgagctaagcggggacaacgatcgacggtagtggcgcgacgacggctccatggcctcgtccaatgggcaggatgaattggatcatcgtgacaccggcctcccttctcaacattgccatccttgttcgcacttcctccttccccaaaggcggctgacgtggagcataggagggtggtcgtgcaagggtggcgggggtcggagtggcctgactccatctccctcatctagtcaggtgtgtgtacaagctcaccccctccaacgagttcaatgtcacccaccttgccttttccacgtcgcgtgcaaccctcattctcaccgcctcctgttcaaccttcgtgctccttttctctggggatctcctcttgtcgcttccttggatctccatctccgaggaagtcacctatactcgccgtcgttttgcttcaagtaactgtgccctccttgcctttagcgaaaagaagggtgtcatccacgtgttctgtgtcgacaagtagccatcattggacttgcccacatgctcaacgcccactccatcgagacacgggttgtccagtacccctatcgttggcggtgacaaggtccacctcttttccgctggcaatgtgcgctcctcctctattaggatgtgtccttcgagatggttgtgttcaatgtccccgcctctcaccgtgactacatccgcgccggcatggtgtcccttgccaaccacaacaacttcgtcgcaggatcctacgaccacaacatcaaattgtgggatgcccgcattgggaaaaccttgatgttgtcttctctcgtggcaaattggtggagaatgtgttgtttcggcagttcaacaggatgctagcaatcgttgggctcgtgcgaatcttggcccatcgtattgatacgagggagttaaattacaccacttttaataatttagaggtgaagatatccagtattacggttgagaggtaccttggatctttatatgagagagtcaaagtggacttactccaaaagattgtcaagatccacaagaaccagacaagagaccattgaggcccatatcggtagaaaggattttcaggcctacttctacgctcaactggatttgtttacggccatgagctactaccgaattcgacttcgctcacggcccgtcttgacggacaagatatctattcaaatttgaacgaaaggggcatgacacgtgttactgccagctcagcacggcaccgtcgttccggctataaatggccccacgcttcagcgtctcgtgcagaaagtccattactctcctccccgcatcagaacacagagagagagagagagagagagagagagagagagagagaggtaggagaagagtggaggagcgccgcgaggaggccatggcgggaggaggaggagagctccagtggatcgtgatccatggtgtccgcgatgcggtcctcagagccgccgcgatcatcggccctcgcctcgccgtcatcggcgacgttcgcgtcagcgacgcccctgcggtgctgactctgctggagaaggaggtcgtgcgccaggactgggagatcgagcgccgccaccgcctggacaggcttgccaggctcgaccacgagctcgccatcattctggaggccatcgtgccgatgctgatgcatactccgttccacatcgtcgccggccgggagctgcagcgctacgggtggtcgattcagcatctagcggcgtcgatcttcggccccgtccacgccctccacgccgccgtcggccccgtcggacgcttcctccgccgacatgctcgacatcagcaccacggcacgagggatgctgcttggctcgccggcaacatcctggaggtgcgcgatcgggtttcggccctgaggtccctggttgtgatgttcccggaggaggaccctgctgccgctgcagccgctgcgggcgacgacgaccacgacgacgacggtgcagagttcgtggaggacgatgctggttctgatgtcgagggaggaggaggagagctccagtggatcgtgatccacggtctccacgatgcggtcctcagagccgccgcgatcgtcggcccgcgcctcgtcatcatcggcgacgttcgcgtcagcgacgcccctgcggtgctggctctgctggacaaggagggggtgcgccagggctgggagatcgagcgccgccaccgcctggccaggcttgccaagctggaccacgagctcgccatcgttctggaggtcatcgtgccgatgctgatgcatacgccgttccacatcgtcgccggccgggagctgcagcgctacgggtcgtcgattcagcatctggcggcgtcgatcttcggcccagtccacgccctccacgccgccgtccgccccgtcggacgcttcctccgccgacatgctcggcatcagcaccacggcacgagggatgctgcttggctcgccggcaacatcctggaggtgcgcgatcgggtttcggccctgaggtccctggtggtgatgttcccggaggaggaccctgctgccgctgcagccgctgcgggcgacgacgaccacgacgacggtccagagttcgcagaggacgacgacgaggagtagagactagagaggatgacgacgagcattaagcaaaggttcttctaattacttctctccgatcaatttactgtcatctgcactgaccactgagttgtttttttgagtttgttggcgctcctcatgttgatagttgtctgattagtctctgtagttgtctgtgttttgtctctgccataagctgaagcacagctcgtttactgcagaaatctgtaaatcacttaccatcattgctttaaccattctggtaacccttcagatagttcatgagcctacttgatcttttttttttttttttggtattctgaactttctatgggcatctcgcttgcttaggaactaaaatgcaggttatttcgtcttagctgcctgcagattataatctttgtgttgctacgatgttaaatgaatctaggaatcctcctctctgaaatctgaagtaaaacttgtgattcaatccctgtatttggtactttctggtacccttttgttctctgtgaatctgaatgctgatggttgtgcatgatttgtgcgttgaagagttgaactgtataattcagtttctacgaactgaaaatgtggtccttaggccttagctaatacgcatccatgataaatgcaactactcattcactggagtatcccatgaactggatttacatgcatgggatgtgttctggcactgcgctcaaacgatcaagttactttgtcacccatgcttcatctgcgccttgtctgtttgtcagtttaacatcttttaacctgtgtggaatgcagattatttcatctttgattcctgcatattctagtctcagaagaaacaacttgaagtcttgaactaaaattgtatgagatgtttaagttcagacttcagaatgcataaatagttggactagcattactccactgttctattgaaatagattgatttaccatcaaattagaaatgaatcaaattaactgacttaacatggaatcattttctgcttatatagtttataagattgcttgtcaatcttgttttatatccctgaatttgcaaagaaacccaactgtgagcacagatagttgtacctttgatatatgcagatcgatttgcttctttatggattgctaatccctatctgaccactctattatcactaccaaataggtaccttttgatacctatttgagcacagaaaattgtatgtttgataaactatacattttatttctactgtaagctgaagcaggactcctttactgcataaaccacttgctgctaagaactttacttatcagcattgcctctctggggaaatttcatggttagtagctctcggtgtctcattggatgattgaagtgcggacatatgcatgtttgtgcttggactttcagttagcagtgctcatcattttcttgctaattggaattatattttaccatccagttgcaagagatctgaattagactggtgctgtaggtctttctgtacatattatattgcttgaatttgtttactgtatgcagggatgcctgagaaataactgaagaaaatgagaacattgaggtttcaaaattgaaatgcagaaccctgcatgcaggggcggatccacaatgggggcggagg

SEQ ID NO: 32314 - DNA, 7671 bp, Oryza sativa
  unsure (1)..(7671): unsure at all n locations
ccccactaccgcccccgggacaatggagacccccctaagcccccactaattttttttccatagatttataggatatggggactggagtttcaatttatgctgatgtagtttattcagtccccactactatatttttctagatccgcccctgcctgcatggctgactgatgatttgttggctattattttattttccatgtattggtacaaccttctgtcatgcttggttatgcctttctggagtaaacatttaacctgtgtagaggcagattatttcatccttggttcctgcagtttgtagtctcagaagaaataacttgaagtatttttttgcgaacgcgcaagagtcttgaactaaaatgtgtgagatgttaagttcagacttcagaatacagaattggttggattagcaactagcattaccagtctactacggcactctctcacagtgtgagctacttttctattgaaatagacagatttacctttaaagcagaaatgaatcaaattacccgacttaacgtgaactcgtttttctgccaatatggttattaataaatttattaataatatgagcacaccacagataattgtttacacctttgaatttattaataactagccgggaccccgcgcgttgccgcgggcataacaaatacttcctccgttttataatgtaagactttttagcattgctcatattcatatagatgttaatgaatctatctatctatttatctatgtgtgtgtgtaaattcattagtatctatatgaatgtgggcaatgctacaaagtcttacattatggaacggagggagtatatatattcaaaaccgtgagaagatgagaaggttcccctgattcatattaagcttcaagctctcaaaatatctccatcaaactttataccgaataacatcattgaataccatcacaaagtttttggccatagttaatttaccaaacttttaaacgattacatcatttgcaaccataagctctgtagcacacatatgcctgttacgccatttacaaccacacgcaaccgtgttgaaggctctggtcaatccaccccaaaccattttgttatcaattggctagcggataaaccaaacaaagctattttgcgtacaaattggccttctgaaaactatccatagatgaggctgaaagtttcttaactaaaggccaccaccaaaatggaacatctgttacttccatatgcactcaattgtgatggattgacaactaattgtaaaatattaacataatcttgactatcttgtaagtgatatttacatgtatagttatggtatggagtagcccatagggtaacacgctgtttaactaagctgcctttttgttttaactttgaggaaaccaaactgacctaaaatggttagattgcggcaatttgtttctagaaacggttgaaatcaatctgcaagagtataggagaatgtgcatatgtagctgtagaaatcctctatttcaaaagtagctctataaatccaatagaatagttggtaaacaaaacgtattgtacgcttgcaactaaatgattatatgtaaattagaataatactatactctagagcctgacaaagggaactattaagattgcaggaatctaaatgatgagccaataacagtgttaaggatctttctgtaaagtcaacatatgcattatgaccaatcactggataaacagcaaggatgcacacatgacattcatcctttttcaaaattaataactgagctatcccaaagaaattaaacaattgctaaaataatttgaatataatttgtgctcataattacaaatggtgctaccgcggataaatgtgttcttttcttcagatagaagaacttggaagacttgcggtagtttactcccttgctgataaacatcagttactgaaagaaaatgcagaaatgttagaacaaatttaattattaccttgatggttattatgaattgaagcctcatggtgataaactgttcatatggcctcatttgcacataacagcagagtttgtactatgcaaaatgaagaaatgccatcaacttatgtgtattcactcaaatgaaggccctcatcatcccataaatgctacaaaagcatatgcaaagccatggaacctacaaaagcaaggtgttacacatgcagttcaacaaatatatcactcactgaagaccatgaacctgacagtccatacataggccttgtaatgtaagcaatcatggcatcatactacagcaagcggttgcgatcaagttgaattgtgtgccttctgtactaaacatcaagattatctatgaaatagtaaattatcttctagcttgaatcaacacttcattcttctcatttgtatcgccatgaagccaattaggaacactgaagcaggtagcaaaaaaaacaatcttatgtacaccaaagcagtaactaattattcctatgcatgcacaaatagaacatgtgcaatcggacaagtagcacaatgattttttataggtttacccttcatggtgcattgttttgtggcatcctgcactaaccataggtatatggtcacatcgtacaattacatagggaaaaaaatcaggccaatatctctttgtgcatgctattttgctgtgtgtaaaaaaatgaaaatatgtgctataaccacattgctgttaaacaaatggaatcccagcaatatatataaaactatcatgcatccctgaaacaatggggaatcatgtattatgaaagaaataggataaccttattgttgtttgcattttaggccgattgtacaggtagcaaacatatcagaagaaatatttatggattagtaggaatcatacctatatagagagcaaagcaaaggtaatctgagtagtaaaatacctactgcagaaaagaacagttatgcagatcaacaatacgaggaaaacaaaatgaacctaataagtattagtgcatacagagtggtagaggatggcagtaccaattggagaggtgtggaggagccgacaagcagcagtcacaggaagcgaggagatggccatggacgagatgtttggtggcagtgctgaccattggctccacgagaagacgacggcggatgttggctccacagggggtggcgcagaacagtggctccaagggaagggagcggcacagctggctcgacgatgacgaagcgacacggggtcgccggcaagtaaggcgagaagacgacaatgttggctggctggctcggcgacatggaggctgtagtgctcgctgcttgctccgcgagaagacggcggcgccggtcggcggcgaggatttttggggcggaggtggcgaggattttgggatggggattggggatttgggagtagcatgggtggggaaaggtggggaatggggaatgggagagagaatctttcggagccacaacgtgctgatggacggccggatggaatcaagatggcgagatcgcacggtgcatgcatacgctggtactgttaccctgtagcaaaggctagctgtgctgtggttcaccggaagtgggttacgaaaactaaggatttaatatgatatgacgtgagcactgaaatagacaggcttgtttacacctctgcctatatgtctatatatgatgctcgagccagccacaagaatgtcaattaagaatgtatagtaacaagcttactagatagacactgaaactaaagagataaatctgaagctaacttatccaaactaatcctgcgccatcttagttcctgtggtgtttgcctgttttttcttttcccggcgacggcgctgatactgaaggccccacatgatgagacacagcataattagcatgatatacgctgtaaaccttttgcatggcacctactgcagggctccagaacagttaacttaactgtagttgggactatcttttcaatgtacctcctaatagctgagagcgctctaggggcttccatgagaatatcctcctctatgtgattacaaaatggagaagtttttaggtaacacctacaatcaccatgaatggtgtccaatgtaagagactcgagtgacaccacgttcttcagaatataacaagttagctcaaccaagctctttgcagagcagaaaccagagatcttcacagtcttgaggctgtcatggcggttttcaggaatttgcctcaaacccgaggattttgcaaaaaccgattcatgctccatgcttcgctgctgcccctgaagatggaaaggagaacacgattgagataaatggacccagagtgaacagctatgttagcaggacagagttaatggacagtgccttacatcaagataaaagtttccaacgaaagagaagcgtcaaggaaagaaaccagagaaaaataatcataggacggggaaagtgtcgatactgctatcaaactaatgctcaggtgcttgaggtagaggaatttggtaggcagcactggtgtatttaccgcctgtataacaaatatgacacgtctaanatcatacacaggtatgactaatgtaatacgcatatatatgtaatactagtctataacacctaaagcttctggatatatatatacatacctcangtcctgaacgtatgttaagagtttcaagatttggcataatggaaagcaactcaacacgagcataatgcacaacattcgcacggcccatggcctacttcttcattttcagtgtttctccagtgagagctttgccccgactcctctacagaaaaaactggagagatttggagttttattctctaatattctcaggttagagcatccagaaacaaaaaaactggagagatttggagctttgttctctaatactttcaggctgcacatccaataacagtaaggttgctgagcttctgcagggagcaaggtatcttcaagcaaactatctccgtgcaactagaaatgcgcaactgctccaacgcaggagaattggaaagaagacactgcaattcttcccccctgatactcaccgaacgcagacgcaggcttgtaaggctttgcaaggggccgagttcagcagtgggacgaagggcacaccaatcgagtctgaggtacctaattgaattttgaatcccatcagataaaagtgagcatgggaaattgtactctctcttggttttacacaacacaagggtcagctcttcaatccctggcttaacaaccacctgaagccaactgtcaagatagcgactggcatcaaaccccacgacgccaaggtattcaagcctgaatattttcacgccaatgcctgagtggttcctcataatatggtcaactttgcggctgaaattccctccacaagcactcgcattcaagccaattgtatccttatttaaaatgagattgggatgacttctccaggactgtaaaaaggttctagacaaacaagcagcacgggcagcatcacgcattggcattagggaatgtatatgatgccagatgtcctgcgtacacaagcatgggatggaagatcaacattgcagtcgtaaatccaaatggttacttccattagagaacgaaaaacggtagaacatcatggcatgcagcgttacgtagaaagatggtgcagtgaaatgtaaacatggcatatagagaatttttgctaccagtgtcattagtgggttttccaaggagaagaaataaagttgctaatggctagcacgaattaactaccatgaaaaatacttttgacttggattaaaagaatacttttacttgctgtagcaaatctagccatttgttctggattaaggtagcaacatagcaaaaccaatactcttgtacgaaatgtgaagcaggtggaaagaaaaaatatttttccaatttttcttaatgctaataagtgcagcatagcactaaagcaccccagttatgccaatttatgaacatggtactaaatatgtaaagcatcgcacttaggtaaaattctgaagagatttgttagtaatactgccagcctttgcagagagaaaagtggtaactagaacgaagagaatctgctagttcagtacgagtgtaggactgtggccacattgcagtactaaaatactatatctgacttctgtttatataaacaatactgtaatattcaggtattcaagtatagtcccaagaattagccctatcagatcactcatggtaatatcatgcttggaatctaagcctgcatcatcagaatttcatacagcagtacctcaggaaggcatgggtatggggtagaacgtctcattgttttgacagctcgagaatcaccatgctgacaaggtgatccctttcttttacaccacctaatcagttcatctgcgacacaaaaaaaaagaggataaggatggctatggttgcaggttgctcatacatgaatgcagaaaaaaggaagaaacgaaggcccaatctcttgagttcagagtaagagtaaggtggcttactctgggctctgatttggcggcggcgccgcttctggttgcgtttcgcaggcatgtggaactagtaggtcgacgacgactcttcttcgtcagatctcaccgagaaatcacttccgtttcccctccttcagatcactatttctctcctatctactactatctgtttttgtacttgaattttgacctcaatttcggaaaattcgactaggcataaaaaggattgcgatggccctggtacgagcaagaggaacctggactctttttattcccttccttttcctatcaggacttcttgaattgctccaaattgcgccctcctatagaaaatcgttaagataatgggagtcctttttcctatcaggacttcttgaattgctccaaattgcgtcctcctatggaaaatcgttagagaatgggagtataaaatttagccatattgtaacatttgcgctgcaaacttgtcgtttagataagcagaacaatactatctctcgatataacaactcccgaaactaaaaatctcctgcaacggcaataaatctgcaagcccggttgagttgcagagaagaatgagtgaaatcggactcaccggactagagatgcagcttctggggaggcggatgacggcggcggcggcggcggcgggaggaggagattgaagagcagcgtgtgataaggacgcgtgatgtgaccggctgcggcgagaagtcagccaaactagagaccgggcgacgaacagcagcggcgtagggcacgtcggcgacgcgaacctggcggtggcggcggtggtgcagcgatggaaggaaaggaggggctagaaagagaaaaaaaaatatccaaaacattaagagtaaattacagttcatgccacgttttatattatcaaagttttattttgattacctttaaactattttttttattttagaccatgtaactttttttattatttatgtctaccctctgttccggtgaagatatgatatgtataaagacgggaaagtgtattgaaaccaatttattgattggtgctggaaaagttgtttgggtagtttaatccgaaaaaatggtaaagttacttggttcaaaataaaaggattagttgaaagatgactcaaaagtgaaaatttaactataaaggatagtccaaactgcaatttactaaaaaaaacttagtttacaagatctcaatggtgctttaactgacaaacta

SEQ ID NO: 32315 - DNA, 4799 bp, Oryza sativa
tattcagttaaggaaagagaaattagaagagaaaaataattttggaaatatgggattaccattgtacccttaagtaatatatgtgggggtgcatcagtacatgttcgatatcctccttcccccagatccattcccatcccgaagtccttggcgcggcggcgccagaagcaggcggtggagcagctcttcagcgcggccgggagcaggtggcggcgcagctcctcggcgtggccaggagcaagctgcggctccaactcctcggcgaggccggaaggcggcggtgatggctcctcaacacggcgtcgcgagcagcaggaggcggcaggagtacctggcagcgacggcgatcctcagcgctatggcaggagcagcaggcgatggcagcgactcctcggagcggcaaaccattggtgatgaatcctgctcttgacgggttcatcagatcgaaaggacttgaccaacatgaagatacctgatgtggctgatactatgcacttatgcagtaagacacaggatgttaatgaacttaccattcatagacatcattcatgttcatgcaatgtggcgccattagattttcatacggattttgaatcatttcacgaaagctcagtacaaaataagggtaaaaatacaagtgttgtttaaaaagtaggggcaaatatgcaatagctagcaagggcataaaagtcttttcgtgctcgacttaaccccgttaaattgaccatccaaaccaggggcaaatctctacttcgtttcaaaaaagtaggagtaaaaacgcaaaccctaaaaagcgagggcaaaatcacaattgaacttcaaaataggggtaagaatgcaatagccccttttttttactatagttgaatcaaattcaaagtaaactcaaacttgttcaacacgaagttcaaaattatttaaaattttacataccctgcacatctcgtaccccaaatttcacatcgatcaagcacgtcctcaagacggttgcaggtaagaccgtaagagtgcctagcagcggccatgctagatcatcaaatggccgttttgcatcaccaaacggctgtttgaaacgagaccaggagatcttcagatgcatagaaacaaatgcatatatttaggaatttaggaacagaggtagtagagacagacaaatgaacatcatgaatatgcatgaatgatgattgaataatgatggtgtcaccattacagagtaattacatcctgtgtcaaaaatcaggtggtgtaaaattagacaacactgcttatctacctgttagtggcaaactaaaaaaaggtaacagctgtctcctctcttgttatgtacatcaaaatacagcatcagctgatgcaggctataagagacggctaagctcaggtttggtgactactgtactatggcttgcataagttcgtcgtatttacgatcgagtaaccagtttgttgttcttcgctaacaacagcaatgtgatcaataatgcaccccgtctttctttctttcttgccatgataaatttggctccgattcccctgcagttgttgtatgatggatgcctatcagctttgccacttctacagctggacgccggcatcctttagagcagcagtcacagaagcagaggcttcctctagggttcttgtcttcttaactgtgttgaatgcctccacgacatcaccttcctcccattcgtcaaaatcatctaccccaatgccacactctagcccagcaccaacctagtggggaaaaatgtaaatgttgaacatcacattacggggactaatatcaaaataaagtgaatgtgaatataacaaattaataatgtgaaaactttttctttttgcagtgatactcaggaaacacattgtgatattgcgggtaaataactttctcacagagtgcagtgaaataaaaatagttgatggattcatggttatcgtacgtacctcctttacagtttctttcacccgtcttaacgaatcaagtgtacccatataaacttctttccctttacgaagaacccgaacattgcagtcatgaacaactttcccagtagtaatcatgcaacccgccaccttgccactgccactactaaaaacagcacgaactttggctgaaccaattggtacttcctcctgataaagaaagacaatgaggatggacatccaaatattccagcaacttgaaatgacaagtaaatactctaaagcacaccaaactatcatggaaatggagaaataaataatactccctctgtttcagattgtaagactttctagcattactcatattcatttagaagttaataagtctagacacatatatatgcctagattcattaacatctatatgaatgtgggcaacgcaaggaagtcttatattgtgaaacggaggaagtattttagaagaaggatttcccagcatgcaaaggaatgtggtccatgtggacctatcaacaagggcatgtcccaagactcaactggttcataaaagttgaaaagcaattttctgcttacctcagcaagttcaagaagtccttccatggcattccgcaaatcatcaatcaaatcatagatcaccttgtacagacgaatttccacacttttcttcttagcatagcttttaactgatcctggagctttgacattaaaaccaaatataatcccttctgaagcaacagccagatcaacatcactgacactcacatctcccggagcttgaagtaggaacctcaaggagacattttcttgaggcagcacttggattgcttgcctaatggcctcaactgaaccctatttgatcatatgcttggcatatttagcaaatagaaaaaatgaatagttcatattcgataatgcatatagtttgcaagagcagtggatacctgaaaatcaactttaaggatgatattaagctcgtgtgtatcaattcctacttgttttccagatgaaacagatgcagcaatggatgacagagtgactttcccttccccagctttcgaagatatcctttcaattctcagtgcttcagcacgtgcgtttgccctttcacgtgcaacatcaaggttgtccacagactcaaattcatcaccagcaaggggtacattattcaagccaataacctgtcataacatatcatttcttgataaattcaggatgcttacaataatactacaaacttttgaagaacatttaatgctcaatggtactaaagtaaaaggcagcaagctatggaagaaatgtttccttttcaatccatgaattgtgatagtatatgtgtagcatccagcttccaaaattggcattagcttaatccttctatacgagcaggcccatgtatgtattgcacagtacttatactctcatccttgcttcatgaaaaaagaattaatctagaggaacacatgaacttgtgatgctcccggcagcacaatgtcctacatggcaaatgaccagaatcactcttggtgcaatgctgtatgcctccataggctcataggcactcacactccagcttccagaatctacattagcctaacccttctgtagggacaggtccatgcacatatatgtcacgtgcttcactcggtgaatagctagaagaatagagacagtagttgtgattgacaggtatgtattattattattattatctctaaacctattttactaaattttactaaaatagcttatctgtaagcctcatgtgccttctgccaatgtgccccgtgcatttcctccagtcaccacaccttggcccttctacaagtgtggtcccacatggcagatagcactgtacttacacattcttgccaaattaaatgtgtaaacctgaaggttttgtggttagaacatgtgagcttatatgctgaccacaaactaatttctccattggagactaatcccaccatactgaataacatgggccacaaaggtctccaataatgggctgaggtgtaattactcatcataatatagtccctggaagaaagcaagagaagttgatagcaacaatcaagctcaggaataccagggtgattaaagaaaacccacttgtgttttttcttgtcttctcctgtctacaaaattcaaattttagaattttcagcttctgataaaagggtgcatttttacatcatgtaaaagagctcacatataaggatgccatttaggacttgagcaggtttatatttgctagctagtcaacagcgacctctatttatccatattcatcaatgtcatgtaactaacagttctaatgcacataaacatttatagtttcagatgctttctctttatgtcaaaattgcatcagacttgtgatgagtattttgtttagagtcgtcatggccagaggggccatctcatgaggagaaccaactgtaatttcagtaactttttcatccgaaatatggtatattaggaaatgttaggaaggatcatggtaaaaggaacgaggaaaataaaggaaagggaaaacctgcacggcattggatggcccagccttatcgataagctttccaccatcatcatacattgcacggatctgaaatgataacaatgctatgttatactccaaatgacccatgtttgttagtttgtgcttctttttttcatgcaagatatattacatattctggatcaaatcataacaagtaggaattgagcaaaccaacctttccaaaagcctcaccacacacaacaatatcacccttgtttagggttccattctgtacaactagggtggcaagagatctttagctttggcaaggcatgcttcaataactgtaccctttgcattt

SEQ ID NO: 32316 - DNA, 2408 bp, Oryza sativa
ccaccccacgcctttggcataagtccaatttgggaaagcttgtgcatgacccgttcagcattaactccttccttggctatctgcttaattaggagggtactgaaacatgacaagagaattttccttttaacaactgtaatcgatgatgaaatgactaggaaatagaccttgtttatggctatcacaatagggactccagctgcctttgcatgtgcaattgcctcatttgtttgtggacgaacaccatcatccgcagagacaacaatgatacagatatcagttaccctagcaccccgagctctcattgcaccaaatgcctattgttgttgaagaattaggagttgtaatgccccacgttaatacaaccagaaagagagaacatatggtaaaatatacatatacttttgctatacctcgtgccctggagtatcaagaaaaacacaagcatgagggtttccatcaacctgtacaataacctgataggcaccaatcccttgtgttattccgccagcctcagatgccaccacctgtaactaactttatttagatctacaggtttataggaaataggtgtttccatgttttaacattagtaattattccactccctttgttcaccaaaacatgatgttttagccaatgttgcagagaacaatgcaactgttcaatgccaggaaatggactaattagcccgtcatctactcattaatctaaagccttcattcgttccaataccaacactggtcaggcaaggcacggtgaaagttcttcgaatcaagaggcagggtgccacgtggaactgtgaatgtgattgaacactttgaagagaaactatgtactatcaactcatcctagaatgtgcatcatggtaaaaaaacaaatgcacattccactagctttaattttacccagaaaatccaagatgtttctatttgagaacaaaaccaacatactaaaatgccatctaaaaaagaatgaagggagtatcatctaaaatcccaaaatcaccaacaggaggaacatgccaaggagtgtctaccttgctcttgcgtatataatccaacagggtagtctgcaaacagaaataacagtgtcatacaaacagtgcttcagaacagttaacaaactgaaaaattgatactggcttagtacctttccatgatcgacatggcccatgatagttacaatagggggtctgtcttccaacttgtccaaatcttcctcgtcaagaattccttcttctttgccatctcttccactttcactggaccactttccagtacttctacatcatattccatacaaaccatcttaaccagatctttatcaagtgtctgaacattgtcaagcatagctcctctcacagataaaaatcgcagaatttctgattcgtcaattgccaattgatatgccaattcctcaattaccattccttcttcaccaacttcaaggatctcgactctaactggctcttcaacttgtgaagcctcaagctgaagtcttgcagctctgcgttttgccttgctccatctcctccccttgcgcactgcagtatcctcatcaactaaaccatcattttttggcattcgtcggcgaggaccagctggtgtgcttgtttttttacgacgatcatccttgacttttgctggtgggcctcgtactggctttacaggttctatcagtgctgcagctacaactggatccactattggtttattggaagcaaatttatcaatcaggatgggtccctttttctcctttgatgtatcagccttgacaggccgacgaggtggtggtgctactactgaaggttttgttagtagaggaggtactggttttgttggagctggcatagaaggttttgctgtagaactagactgattcctactttcagagcgtggatgatctctgaccaccttatgtacagttgacacagggtttccctttcgccatacgctcttaagtgtttttgtcttcctcgaattcgcaccctccgctgctggcgttgccgaactatcaggcttcgacgcgccattctgcctcaagtcaccatttccaattccatttccagaggttgatgccttgagcttctcagccttctccaacacctcatccaatgactccctaaccttatccctatcctccaacgtcggcctcgacggagatggtgatgccgcatttacgctctccggtggcccattcgcccggattggcttctgcggtggcttcaaaagaagatcgctatcatcactaggcttcacactcacactccctctcgacgagaactgaacccccttctcttcatcgatcaaattggtcacaaccatgcatctacacagcctcccaggcgcatactgccaccgccggatactgcccagaccagcaaacctgatcctcgaagccaaatg

SEQ ID NO: 32317 - DNA, 13329 bp, Oryza sativa
  unsure (1)..(13329): unsure at all n locations
ttacgctgggaatctgacacgtttcactagttacgcgacacctccttccgtgcgaaacttgtaaatatttatttggcaagaaaaaaatcaacgataaaattgtaatgtaatagtccagctctataactttcctgtagagtttgtctccatataaaatcgtttcaagattttaaaagtttgtttacacgaatagatttgaagacttataacataatatatttggacatataggccttcgttaagattccaaaaaattttggccaaaaacgtcacatcaaatgtttggacacatgcatgagcattaaatgtggaaaaaaaacaaattgcacggtttgcatgtaaattactagacgaatcttttgagcctaattacgccatgatttgacaatgtgatgctacagtaaacatttggtaatgactgattaattaggcttaataaatttgtctcgcggtttataaacggaatctgtaatttgtcttgttatcagtctacgtttaatactttaaatgtgcgtccgtatacttcaaaaattttacacccaaagaactaaacacacccataagcaatcgtagacaaaaatgttatcaagtggaaagttttcttcatccaacttaggactccttggaaatgctgaactgaaaaactagaggaacagaaaaatatatataattgacaaaagaaatgcaagtatgaaatagaatatcaagagaataaaataaatacaagaatagtctttaattgaaccgctacatatgaaaagatgcatatttgttgttatgttctactgaataggaactatgaagatggattctaatagctcgagtggacgtccatctgtttattgcatgtcaactaaatgattacaataaaaaatcaaaaaaattgacaagatagattaatatgaaatatatcactccacaacacatgtaatttcaaattcagcttctataaattgttacaaaaatatcaaatttaactgtaaatatacgtacagtaatttgagttttgtttgttatgtttgttacaattttatagaagttgaattttaacttgcatgtttgtggagtgatatattacatattaatctatcttgtcaattatttttattttttcataaccatttaaatgatatgtattaagcgagtggacatctaccactatagctttgttgttttgttgttaccaccaccaccactactactattagacttttgagggcaaaattttttatctttcaaccattggatttgttccaagattcatgcaggtaaggagatgatggtttgtacgttttgagttcttacatactcccttcgtctcaaatttaaagggattttggataaatggaacacattgagtgtccaaattcatagtatgtgtttatattcatagtcttataaagtgtctaatccattcaaaatctcttatattttagagcggaggaatacaattacgtactacttcagtacactcagaatgaaaaaaacactatagttaattagttggtgtatgtttagaagttattctctcgatttcctatcgaaagttaaatagccactttaagaaaacaaatccgagtgtgaaatgactttcgggatgtaggcgccatacagtaattttcttcttaatcatacgcgactctgctttgaattcagaacgccaccacagaccacagatccgctcgtagtacgtactacgagtcaccactgatttcgatcaaaattgaaaaagaagggatgaaaccgaaacgaacaaactatgaacaaacgcaccagcacgcacgcactcacgctgtcacgcgcatccatggacacgcgacgaactccaagcatccttacgctttacgcgagcaattttactgcgcggtacttcaattcactcctctgcttgatcggccggtgacactgacgccgacgccgaccggtttatgccctggcggcggcgccgggaagctccggcgtgacgatcatgttgtagatgtgctccatcatccgccgctcgaagtcgccgccgctcccctgcaggcgcgcccgcggcacccgcctgtccagcagcccggccgccgcctccgtcgccgcgcagctccgcgaccgcgacctggacagcgcggcgccgcctccggcggccagcgccagcatcgcgtcgacgtacgcgtcccggatcctcgccatcagccgcagcggcgacagtagcaccgcgcgcgccgccgcccgggcgttccaggacgacaggcgcccgcgccggacgggggcgtccttcgtgctccgcgcgccgccagcgccgccgccgaggcgcgccacgcggaggtgccgcgacggcggcgagccgaggcgcctgtagttcctccgcgcccagtacatctggatgctgcgccgcggctgcgacacgaggctgatcgccatgcgcgcgatcctgctgctgatcgatcgagttgctgccggtgctgcactgctgctgctgcgttgaggtgtgtactgcgcaatggatgcttatatagtactaagagctaaggttaattcagattagtgactggagatgagagaatttgtggtcaatataattggatcaagcacaagctaatctgactgtgatttgggttcttccttgacggcgcattgattgggagttgtagctcgtcagcgttgaaccgttcgaactgggtgggtcgagtaaaaaaaagaagagccgccaaagttgcaccgggaagaagcagataccgtgcgtatctgtcggcgaggcatacgccattctcgtctcttgctggagggtagggtatcgttgacgattgacgagaaatgcgtcgtgacctagcaagttttggatgctgcttaactttttgggggtgtttagattgaggggtgtaaagttttaatgtgccacgtcaggtattatatagggtgtcgtatggggtgttcgagcactaatagaaaaactaattataaaatctgtcggtaaaccgtgagacgactttattaagcctaattaatccatcattagcaaatatttattgtagcaccacattgtcaaatcatggagcaattagatttaaaagattcgtcttgcaaattagtcgtaatctgtggaattagttattttttagattatatttaatacttcattcatgtactaaacgatcgatgcgatagtgcgtaaaatttttacgtgttaactaaacggagcctttaacccagtcgacgagtttctcaagctgcaaatgtacagctcatggaatcccccttgggatcgtgcactcatggaaccatctgtacaatttgagacaaacacactattttccacacggaaattcttgttctctgacacgtcgctctatttatcacagctccagctccatctttcttgaggtgaagtctaaccaaataatttcagctccgcctaaaatagaaatagtgctaggtgagacgctatcataaaataaactaaagatgtaagctggttttaggctgctactacacaagtccactccacgtccaactcccgaaactaaatttatcggttagagttctacaaaatagacccgtcatattgtgcgtgcgactgtgaggccttgtttggaagttggaacggcccggcacattcgcatatagtccgctgcaactgggccgttatttttcgttgccgaaagaggccttatggagaccttggaccgcacgattttcaaccaacgttaaacggcaggcgcttactcgcacaaaaaggaataagttcactcgaggtcccttaacttgtagccgagttcgaaattcatccctacaccacaaaaccacatacaacgcatcccccaatttaccaaatcgtgcaaatcgtgcaaaaaggtctctcggcagtattgtccccggttttgactgacgtggtgcctacgtagcgctccaattactaggttttcatcccacgtggcattgacgtggcgcttacgtggcaatttgataaaaaaaattaataaaatatatgggacccacttcagttaaaaacaaatggtggaggacccacgtgggacccatatgtcatcctccctactcctctcttctctgttatcgttttcttttctttttcattctttttcttcttttaatttagaggatggcatccggcgaccggcactcggcggagagggcggccgacgagagaggagcggcggcgcgtgccgcgccgacggagaggaggccgctcggagcgaggcgtcgcgggagaagggcagcacgcggtgagcggcggcacgcattcctcctccgctagatctccggattcgtttttgtacttgctagtcgcgtccggagaagaggagaagaaatccagtcaatcagcatcggcatgtcgtcgcttggggtggtggtggttctgaattttgattgattcgtgctttttcgttgggggttgcttgccatgggattggtgaacgaggcgagctcgtcgtggacaccatgctggtgctcaagctcaggctcaactccatcaagacgctgacgctcctcgtgccactcagcatattcgccgatgtggttgacctcggcgccgtgggcgtcattctcaggaaggacatgtccgtctggctcaccaagccaccactcgtcttcgcctgcggtggcctgagcgcgatcctgtacagcatcggcgtgtctgtgtacgctttcgagggattcggcatggtccatccgcttgaggcggaggccgccaacaagaagaagttgggcgcaccacgctcgggctatccatggggccatcccgtctccgcccccctgccccatctccgcccccctgcggaggaagagatgcgcagcgggcggcggccagcgaccgtctcggccccactcatcggccgccgcatttttccctctcgacgcgcgctcgccggccggcgaggaaggatggccgggagggagagaggaggcgccggtccatcctctcccgtcgtccgtggatagagaggagggtgggacccactgatacgtgggtcccattatttttcttgtgtgtaactgatatgtgggtctcacttttttgtttttattttaattttttatattttgcttccggtgccacatcattgccacgtagaacgaggacaaaacaaaagagccacgtaggcgctatatcagtcaaaaccaccatcgaaaccgctgaaggacttgctttgtaccggttttgatagttgagggactcgttgtatctggttttagtgttaaaggacgaaaatcggattcgttgacaagtttaaggacctcaagtgaacttattccgcacaaaaacgaaaggaaatgggcttgccctgacgaagagcttgaacagcattttagactattaaaattttgttagcattaaatcttgggtaaattttggctagtagatttggctcagctctacaaatttggtacaagtttttcctcaatccaaatgtttatcaagtactattcgtggctatcaaatattacctccctcacaaaaatagttcattcaggtgcataatcatgaatggaagacttgtctacgtgcatagctagagataatagacttatactggtgcatagtaaaaaaaatgggaatttgtttttcaaccttaaattcaaagtcgattttgggttttcttcatcgaaatttattttttaacctttgtttttagattgttaagaacatgtatatgtaagttttattcaaattactttttttctgtaaatatgaagccaaacgatggggccggaagtctttttgacggacggagcaattggtaaggccgaattagtatcaaaccaaacacaacctttagatacgtttgtggttctatgccaatttttttacaattgcaagatttgattactgatgcagtcggcaatttttttcagaacaagcaaaaatcatgcaacctttagatacgtctgtggttctctgtctgtttttcttttcagaagaaacaatcctgaatttgacaaagtacttacctttttcttcgtagaattagactaaaactaaaccaaaccaaacgaaagatttttcccatacgacagaatggctgcactcggcgagatgaacaaggtcactgtcgtactacacgaaacggcaagagcagctacatgcctgtactccactccaacctcatttgttgtacacttgtactgccgatcagttccaagcagcaaaacttgtacgtttcatctgagaattgcagtggtagtaccgtacgtctcacgcgctggccaaatcgctcgcatcgtgccatgttgccatgtcaaacaagctcaaaccgctctttaaaaatctgaacctttctgatctgaattttcggtttcgctgtcatttggagttcttgctgtgtctttctctgtctacttttcctcgaaagcaacatggtcagattaagaaactgtgcataggccaaataagcgagttatattgatcagctgcaggatttgcttatttgcaagcaaagaattaagatacatggaacatatcacaaatagaaccatatctatttttcatttcccggctactaataagtgggaagaacatttatttcttctagaacctataaataaccaatagtccaatactaccatcttcctcgacaaatgacaaggccgtagtagtcgtatagtacaaggctatgctaattttgctaaactaatttgggggtatctaattaatcttcccctttacaaatgccatgctcgatcgtgtcacgtaccattcgtatgtcgcgtttagaggaagaagcagcccatgccggagcgcggcgcaaagaacgggagcacggcgtcgggcgacgccgacgcggggggcggcgcgctctccgccgcngcngcngcngtgatgctgttgaacctccggcgagccgacggccgcggcaggttctccggcacgatgttctccagcgagttggcgcgccacggggggcactgccggcggtcgctccaccgcgccggccccgccgccgccgccgccgtcgcctccggcgcacgcgccatcacggcgccttcgccggggccgcccgccgtcccgagcaccgcgcacgccgccgccgccgcgacgcacgcccggcgcagctgctggaggtgaggcgcgccgccgcctctgctggcggcggccggagccggcgcaggcttgagctggcaggagaccaccatggttgccgacacgtctcgcagcagcagcacagcaattttgatgggaaaaaggccagttcgaagcgagatttatagcgtttttttttcctttttttttttgtttgggtgagcagaggagggtcagatcacggctgttgatctcgacgtggacgctggattttagtgctagcttagcaagcgcgcgcgtgttgctttgcttggcgtgtggaaccacctgtggcgtgtgaaaagttgcatatggcacgtcgggggcgtggggtggggcccgcgggcggtggttagatatttggcatacagtaaatagcgtaattagcagtttgcgagcttgcaactttgcaagggggaaattactcagtcacagcgacgagaggagatgcatgggaaacccgggaaattacttggctgctgctaaaatagtctgccttggacgggttccttcgtataccaaccggagcgagacatgtaccggactttctatttgcgccacgcttggcacttggactcttacggttaaacccagattcaatctaggccggaaataacatgtatattaaaaaatttataatagatataacgagagactggatttattctgagccgggaactaatttatttatgataggaataataaaacatccagattagttccacacttcttgacttattggattgatttctaatatcttattgtccctatcataagtaaattgattcccggtccagaataaattctgatctgttattgtatctacataaatttctttctttagttgtcattccggctcggattgaattcgggcgcaaccgaacaagtcctaattcgtttcaggagggtgagctgtacgagccaccaagtcgccaacaacctaggaagaactcgtatcgccattcgtcgcatgccaacttggaaatcgacgttttttttttctctctctctctgcagactacaattacctcaactcagtgtcaactctgctttcgtagatgggagttcccaacacggcggcacactggaagccaagggaaggcaattaggtaaaaacccctcgctggacacaatcacgcgcacaaactgttcgagggaattccgcgctgaaacaggcacagcttcgtcgcatgatattttaagtgagaaagctaatcaacggtgattctttgaggctagggagaccctgtttagatgagactaaaatttataagtcactatcacatcgaatatttagacactaattataaatattaaacgtaaactattaataaaactcatatataatcttgtactaattcacgagacgaatctatttaccctaattaatccatgattagcctatatgatgctatagtaaacattctctacttacggattaattaggcttaaaaaatttgtctcgcgaattagctttcatttatataattagttttgtaagtagtctatatttaatactctaaattagtgtcaaatatatagactaaatttaagtccatggaatccaaagttccaaacaccacctgaagcttcatttctggtggcaccatgatttgattctcttgccgttggattggatgccgtccaatcggtgatttgctcgtacatatttttaaccgcgtgtcaaaagtttgtaagaatatcttttttacgtgaatcattttcgtatgttagaatcactggggttcatctgcaaaggaactgaaacagatgcagagagacttggaacttggaaaaactgaaaacctctattctggatttctggtctttcaggtctcttttttttgggcctgctttgggagcccatcatcgtggaaaggctaggaatcatgggccgccaaaacaggccttaaagatcacaattcttccagtagacacctgttacggtaaaattaccagattaggcaaataagaaaatcagatgaaaggagttatcaaatagaccatcatagtcaataacagagtgctgaaaaaggaaagacagtatatattccaaaaattgacaacaaatttaatgttgatagtcggaattttaaatatatgaccgttattggcttttaaatatatatgctattgtgagccaaagacataaatctaaaaaaaaaagtgagccaaagacaacatagagagatcaagacacatctgtttattgacttttaaatatatatgctattgtgagccaaagacacaagatagaaatccattcaagacacatccgtttcttgacttttaattatgtgctattgtgagccaagccaaagacataaatcctcaaaaaaaaaaagtgagccgaagacacaatatagagatccattcaagacacattcgtttattgactttaaatatatgctattgtgagccaaagatatacttcctccgtctcaaaataaacaaacatgttatgtaaccttttctagatacattcattgtactaggatctctatccaaattcattgtgctaggaaacgtcacatcctattctagattgatttttatgggatggagggagtaagatggagaaccatttaagacacatccgtacaatccttgtcctaatcaagaaagaaagatggtacaataggtaggtcagtatgacactagtacaaatcaagaaccaggcaacactgtcatgcatactttaggcatctctgccctctcatctaagagtgcgagcggataggctgaaatattgacctatccaattgagataccaagtattaacctatctcacatagtccaacatggactaaatcagtagaaggaaaaaaaactatttttgttgttttcggcatccaccacacaagntngnaagggaaatggaaanaaaccgggaaancccaattttttntttncaaccnttggggncctcggcaccatgtctctcattcatgactactatcgcaattcccaaaagccctcaccaacacactgtatgaccgagatcttttggtcatattgagcatccaccacagagttaggtagagtgaccttactctagtcggcatcctatctccattcatgattactcttcacaatttttcatgcgtcatgaccaacgacaccatgcgaccaaggtcttgtggttgttttcaacattgaccattgttaggctaggttggagtgaccttactccaattggtaccacatcctaaattcatggctactctcacaattcccatgcgcctcactaatggcaccatgtggctaagatcaaggccactcttaggtgttgcatgacgagtaggttcccaatttcattttagggtcaaaatgtgatccttagcaagatgcaaaattttatgaattttgagcgatatttgtgaaatccaatttatttcattttgaggaaatatggtttcttttgcaatggaatttgatgaaaatcaaacaaaattgtgaacccaacctataagtctgcaatacttattttaaaggattctttttaaagattatcgatctattttttttattattaccaagaagagattaacattcaccaatgggaattttttttggattaccagttgtagttaataagtactactgaaccggaatagcattctattataattcgaagtacatcatgttactcaaaacgcattacaactttaatccgcttcgtctaaattgatcgcattgtgctccacaccatgtctcccattcatgactactctcacaattcccacgagccctcaccaacgcattgtgtgagtgagatcttttggtcatatccagcatccaccacagagttaggtagagtgatctcactttgactagcatcctatttccattcatgattattctcataattttgcatgcatcatgaccaactacaccatgtgaagaaggtcttttggttgttttcaacattaaccagtgattaagctaggttggaatgaccttactcccattggcaccacatcttaaattcatggctactctcacaattcccgtgcacctcactgacaacaccgtgtggctaagatcaaggcccactcttatgtgttgcatgatgagtagatttcattttcattttagggttgaaatgcgatccttagcaagatgcaaaagctcatgaatttcagacgagatttgtgaaatccaatttgtttcattttgaggaaatctgaatttttggaaatggaatttgattaaaatcagataaatttgtgatctcaacgtgtaagtcccaatacactatctattttaaaggattctttttaaagattaccgatctaacatttaattcctaccaaaaggagagatcaatcaggagcgacattcacacatggggatcctctgaattaaaagcatcggtcaatgagtgtgactgcaccagtagtaatgtagaggatccatgtcctccattcacccacacgaatgaacggaaactacattttattataatttggagaacaacatgttactcagacaacatgcattacaacttaatatggttaatccaaatcgatcatattctttagactacttgcgccagggacgtgactatatgagacaatgatactagtcactggctcacggcccaaattggtgggagaaaaaacaactcactttttggttgttttcagcatccaccgtagagtaagataggctagagtgacatcactccacttggcaccacgtctaccattcatgggtactctcgtaattttgacaggtcctcgccaacgcattgcgcaaccaagatccttttgtcgtatccaacatccaccgcaggtaaggtaaagagtgatcttctatgcatgattattcccgcatttttccatctaccctcaccaatgataccatgcgaccaaggtcttttgatcgtttttagcatccaccgtagagtaagctaggctgcagtgatctctcttcgcttggcaccacttctccaatgcatggctactctcataattcccccaagttcccacaccaatggcatcgtgaggttgagatcgaagtcctaggcaacatgtgacgtcctacaggcagggtttccaatttggtgtcaaaatgcgagccttagcaagatgatgaattttgtgaatattgagtgagattcatgaaatttgggcaatttcatctaggggagctccaaatttttggcaacgaaatttgttgaaattaaatgaaatagtgaagccatcccacgagtcttggtgcaatatctttattttgatttccaaagatcaggaccttacacttaattcttaccccaaagatcgattaggagtaacattgatgaaatgggatcctttgaattactattggtgaaagtagcactcactggtatgtaggccggaaaacacatgttagtcgtggggattgctatctagagcagctgtgttttcagcacacactttcatctgaaaatgttcatccaaataacttttgtttgagaacttccattcgaaacactttcatctcacacattcatgtgaaaacttacatttggaaattaaaagtgtgtgctaagggcatataggaacacatctgcgttaaatagcagttatggtacttcaaaggatccattttcaacattcacacattgccaatgaactagaaacgacattttattattaattcgaaaaccaacatgttgctctctcagactaaatgcaatattattacaactttttaatctggttcatcaaaatcgatcacattgtttcccccacataaacttcgaaacccaaacatccctcttcttcactgcatgatttggttgagagcaccatggccaccaccactgcttccgccgccgccgccgttggtgttgctgttctgactctcctccatggcgtcggcggcgccgctagccatcatcgtcatcttcttccccgcggtcgcgcgccacgccgacgccgagtacagcctctggctatgccaggtgagcgtgaggaagccgccgttctcctggacgccgaagccggcgccggagaactcgcggagctgcatcgccgcctgccagaggccggtggcgccgagcggcagctgcgtcatccccccgcgccgcagcctctccacccaccgcggcatctgctcgtggcgctccacccggctgctcccctcgcggctcacgatgtcggcgatctccccctgcaggtacgcctcggcgagcgggttggccgccccgttgccgccgccaaggcgggtgaaaaccttgaccgaattgaacaaggaaggggaagaaaaaaaggaagtaa

SEQ ID NO: 32318 - DNA, 45063 bp, Oryza sativa
  unsure (1)..(45063): unsure at all n locations
gttggacaggtcccggccgccgctgagtagtcgcccgcttggatggcgccggcgcacgtcaccatgagattctccgaccgcagggccatcttttccagctccttccaccgcctcgccgcctcgatctgcacggcggacggcggagcacgcccggggaccacagccatgccagggactagagacgcgtacacggcagcagcaggatcggcgtggtacaccgcgccgctgacgttgcccagagcagcggcggcggcagcggcaacgtccatggcggaccagccaccgaagccgccgaactgagccatgcgcgacggcggctaggaggaagacgacgcgggcgagggtgtgaggcttgcttggcttggtttggtggaatgggtggtcgctctcgccgaggcggggtttttatagggggaggagaggagcggggagcgtggtgcagatgacgtggctcgggacacgtgtacagggaggtggtggaggggagggggtggggtggggatacacattaacgcctggatttgtgcaagatggctggatggctggctgcccctcgtgtgtgtgccatttatttgtgctgaatttccctttttctcctttctccttttgatttttggcttggtttatcttgccttgttggatgccaaaagggatggaatttttttgtttcatactactatgctatatatgttgcataagtgattcaacatgcgtgttgttttgcactggagtgaaatgtggcatctaaggaatgagaaatttgaggaggttttttgagagaaaaaattttgatgttccttaaaagaaaagagaagatgaagaggatagattaattggtttaagtgaaaatcatggaatttagttgttttattagacatgagaatgaaggtgatatgcgggcaataccgcacaagccatgcaactatgaatctgtataattaatttctaaagactaaaaaatgaatgatagtattcataatgaatttcactagcttttaaagcaggtgtaacctataccgtgcgtgcgagaaagttgaccatgcatatcgtatctataaattacaaccattacgatctacttgttgagccataggttttaagttataggcaactttaattttagaatttaactatagaataatataattgaattcttttgactagaaaaaaaatcagtattcataacggatgttttactacattgaatttcgtcggatctttcgcatcagcacatcactagcttttaaagcgggagtaacctatacagtgcgtgcgaggaagttgaccatgcatatcatccctttgaattacaaccattacgatctacttgtttgagccgcatagacaactttgaattttagaatttaactatagaataacataattgttcttttgactagaaaaaaaatcagtattcgtaacggatgttttactacattgaattttgtcgtatctttcacatcagcacatcactagcttttaaagcgggagtaacctataccgtgcgtgcgaggaagttgaccatgcatatcgtacctttgaattacaaccattacgatctacttgtttgagccacgggtttataagttatagacaactttgaattttagaatttaactatagaataacataattgaattcttttgactagaaaaaaaatcagtattcgtaacggatgttctactacattgaatttcgttgtatctttcgcattagcacatcactagcttttaaagcgggagtaacctatatcgtgcgtgtgaggaagatgaccatgaatatcatatctttagataccaataattacactctacttgtttgagccatgggtttataagttataaccagctttgaattttagagttcaactttataatcaatataaaattgatttctacaaactagaaaaaaaaactacatcgaatttcatcgtatctttggcatgagcatactagcttttaaagcgggcgtgacctacaccatgcatgtgaagaagataaccgtgatatatctttgaataccaacaactacgatctacttgtttgagcgacgggtttataagttggagccaactttgaatttagaatttaactttagaatcaatataattgattttttcaaactagaaaaacccatgtcataatggatgttatttagcattgaattctatcatatctttggcttgagcatatcagtagcttttaaaacgggctatagactatgtcgtatatcatatcttaggatacggacaattacgatatacttatttgagtcacaggtttattagttgtagccaactttgaatttagaatttaatattagaattaattttgatttttttctcgttttctaactaatgcttggcgagtgtaagagcataaggctgtgttggtgagccattagcgtataaataattaattactatgtacataggagatctttgagattttgtgaaatgtataataaatatcacattgattactatgttaaatttagaagataattaggaaaccgattttcagcaactggctacaaaccccacacatatcaaaacaattcattgtgctttgtgatttttgaactccctttgtccaaaaaggcagtttcatcctcatgattgattgttgttttcttgtttgctttacagagaaagtagtgcactgtactctctaatgcacatgataatatcgtattgtaatataatatattagtgaataataatgtagcatttttgcatattaaactttaggatgcaatgagttgcaactatacaaaaggtatagatttgcatttactaaaaatgttattaccacatagctttataattaaaaaaatattttctaatttagagggaagattatatttgcacttttctattccaaacaaatatatttgcacgattgcaaaaagaaaacatatttgcatatttccatacaaaaataaatacgagtgcattttcgtggaaatttatattgcagataacataaaaaaagatgtaatttttataattgcaaaaaatatctattcatctttcatgaaaattcgtatttccataaagacaaaatacacgtcacattactatttttttaaaatgcatctacacataaaaatgtttgtacatttacattgcacaagtgcacatttctatcttgtgcaatgaaaatgtgcagacttttttttggatatgctcaactatggcaactgcacattccattgcatagttgcgcatatccaaaaaagtttgcacattttcgttgcacaatccacacattattgatgcaccattctcatacaaagaaaatacatatgtgcactttcccatccaaaaggaaaacatctgtgcatttccatagaaaacacatatgcacattttcacccacaaaagatacatctgaatatgtccatccatattttcacacaaaatgttctgcacacttcactcaaaatggttctgcaaatttgacataaaatggtctgcacatattcactagatcattttaccttgcacatctggccaaactctgcacataacacatttcccactgcagaaacgataagcacatatacatttgttcaaaaactttaaaagaaaaactgtagggcatgaaaaagtgcaacacgttcctgaaaaaaggcagcacaagagatctactcatttcgagagaaaaaacacatactgcaccaaaaaaaaatgcagtaggcggacatgtcctacacaaaattgtatctacacaacatacgtgaattttcagtcatgaacatccacgagcatacgagagagtgtggttttagtcccacattgcttagccaagaatacaagcatacaaggccaaggcccaagggtgcaaacaaacttaaaattccagattaacagtcttgtacaaaacgctcagtcaaaaaaaaaaaagtggggaaagtaggagctgagtttttgcgttcgtagtttgttccaagcaggaaagagcccttggaccttggccagtttgggtcttgtagtaaactagtaatgacgccaagataaccatgcatatcgttcccttggagctaggaagtcaagcactcttgtagtatctttcgaagtaggaggcagggcacttttaacacctgtttagaaagctgaaattgaattgttctgtgaatttcctgcaaaagaatccttcaaatacatcctgtaaatcaatttctatgccagctataccggtgttatatgtgtgaatgtagaaagattttaaagaagcactaacacatgctattttgccaatatctctagttacatatattcactatcactaacatggaacaggcaaaattctttagccctatagttgacactgacaaccattacagcgttgttactcctatttaacaaaaaactccctccgtgtcttttttgtatgatgctggttagttctaaccaacgtcatatatttagggaaggaggtagtagcatacaaaagctacaatattctcactgtaaaactaatcttacttggatatttcttttggacattattggacgcaaagatcatctgcatgaagcaccacttaaggggactgcaaggaagaaacactaaaaatgtaagagaaacaataaaggatctccttgtgatccaacaaatagagccgaaaagacaataccttctgtgcaataagaaatgacaaaagctggagtgccagtatctgagctagattttcaacattttttgtcatgtaccaagctgaatacttgcacaaacctaatacatataactgaaaattttaactttgttgatccatgcagggttgctggggcttcttgctatatgcctatatccaaactgctagtgagtatttgtattgttagacgtggttaataactgttgttgcaaaggatttctgtagcagtgcttgcagcagatgcataataatgcatggccacatcttgtattgttatacagccctctttctataagtttttcatccatatcctatatctccacatgaacaatctccatccttaaagcagtgtaattgcttagtgtctctaacagttatctctcttcgaacaatttcagaaattgccttgaatatcacatgacaactctggcaagtgtatcggttctttgtgacagaaatagtggtaccaggtgtagtattgatcaaaccaaaagctacagctaatctttcactgtgaccgcacaagatgtcgtcctcggatacttctttatcttctaaggactcaacaggagcaaaaccacatgctttcattcgctcatatatgccatgtagaacaacatttatttcttttatctgtggatgtgattcatcatctgtaagaaatgcgtgagttactcccttaacctcaacccagctacatccattatcttgctccaatcccttctctcgcatggtttttctcactctaaccacttgagcccatttgccagcatcagtatataaatcacacagaagaacatgatatgcaacatcattaggttccaactcaaggataacttttgcagcaagctcgccaagttcaacatgtcggtggatccggcatccattcaacaaggctccccacactgcagcatcaggtttgataggcattcgatttatgaggttgtaagcttctgttaatttcccaacacgactcaatagatctaccatacatgcatagtgcttgagatttggaactattgaaaatttctcagtcatcatgtgaaaaagctcccagccttgaataaccattccagccctactacaagcacacaataaagcaacaaatgtaacttcatccggatgctctcccatttctaccatttggttaaagagtgataaagcaaattattnnccttcccccaaaaaganccnccccccaatttgggaaaggcctttaannnnaaaccagaaagcattatattccaagagacaacatccttttcactatgcacgctgaattgtgcccaagcatagcttgtctggccacatttcacatacaagtctagaagagcattgggtacataaccttcagatccaataccacaccttaaaacatatgcatggatttccttaccagatctcaaagccccagtagcagcacaagcacttagagcagctataaatgtaacagaattgggttttacatgtcctagcatataccggaaatagtacaaagcctcaaaactcctgtggttaaagcaaaatccagcaatcattgaactccatgataccacatccttctcagccatgaacttaaatacttcaatagccttatcaatgtgcttggatttagcatacatttcaaggagcgcattagcaacgacaacatacctgatgaatcccttgttctgagcaagctcatgcaatttgatgcctacatctaacctccccaagcaggcacaagcagcaagggcacttgcaattgtaacatcatcaggacttacattatgcaattccatcagtgcataaacttcaagggctttatctgggaaaccatttttctcataccccgatatcattgcagtccatgacatggcatctttagtttccattcttgagaatattttacctgcatcccccatcctcccgagactggtgtacatctgaatcaacgagttacagaatgcaacatcaatggcgaaacctctctttacagcaaacccatgcatttcttttgcaaaacccacttcagacaacattccagatgcaacagtcacactggttattgtcatgagattcggttgtacctcattctccagcatggtgagaaacaactccaaccctgcctcacactcatgattctcaaaatgcccagctatcatcgcattccatgatatgcagtctgtcacggccattccatcaaacaccttcctcgccgccacaatatccccacattttgcatacatggtcaccagagcattcaatacatcgacctcgtctccaaaaccaaatcgaagcacatgagcatgcacctccctccccatcctccagtcagggatgcccccgcaggtacgcagcacgcaggggaacgtgtagacatccggcctcatccctgcccacagcatcctgtagtacaggtccagcgcctcctcgaggaagcccaccttgccgtacccgcctaccatgacgttccaggagaagacgtccctctcaggcattttggcgaacaccctccacgcgtgccatatctccccgaacctgacgagcatgctgagcatagcgttcccgaggcggagcccgaagctcgggtgctcggcgtcggcgcgcgcgcacgcccgcatcccggcgtcgaccgcgcggcgccactcgcagagccggaacagcgcgacgtatgcgccctcgtcgggcggctccggggaggactcgaggagccagagcgcctgcgccagctggccatggctacaaagcgcccgcagcgcggcgctccggtcagagtaggtggcctccgcggaggcggcggcacgcggcggcggcggcgccgctgcggagccgactccgcggggacgcttccgcggcgggaggtggccgtgcgccggcgtgagcgggagcggctgcggcgcgcggtgggaggcgaggaggtggaggaggggagggttcgggtgggttctagctggcggtggcggcatcgcgggaggcggccacgagcatggcggtgagagacgcgggggtttaggagaggtttggcgcctcggtggccacctgatccgggagcgcgaatggatagagctcgcctcgcctcgacgcggttgggaagtgaggagagcaacgaaattaaccgtcctagtacgtaaatgggcctcaattgggctggagattaaggcccaggtagaatttttttagtgaattgcactttggacatttttattgataaagtttcagtttggacaatcttataccaaatatttttactttggaccacataattttatactccatccgtttctaaatatttgacacgattaaattttagcatatgtttgaccgttcgtcttattataaacttttgcaaaatatgtaaaactatattatacatataagtatatttaacaatgaatcaaatatttaacaataaatcaaatgatagaataaatattaataattacttaattttttgaataagacaaacggtcaaacatatttaaaaaaatcaacggcgtcaaatatttagaaacaggggaagcatttgttatgtaatggaccactttaactatattcgctagatatatttagcgtctcctttcataaatatatgacatgcatatacatatgaaagttcgccgacataagtggtaaagatgtggtttgagatgatccgttgtgtaacaaataaaaaagctatctagtacaaagtaaaatgattaaaaaaataatccgaaataaaactttggctcaaggaaagttaactctcttttttggacgcgagaggaaaattcaggattttctacgcgtcagttcagttcagcggcgtgaaattttccgggcctgaataaaccggagacagaaacgaagcagcggaaagagacggaaatcggagtaatggcagccatggcgtcgtccgctcccacggccgcgaaacccgtcgctctactgccagccccaatctgccgctgcggcggcggaggtctcagatcgacgctcctggccctgatgccgccggcggcggcggcggcttcccggttccgagtctccgcctccgcctcggacgtgcccgatttcctctcctccgactggtcggtatcccctttccatcttgtgctttcatgttttttccttcctagtttgcttgtacgttgcaagttgcgacgtttattcatgtggacaatcgaaccaacttgcgactatattggggaaaaaatgggtagcgtagtcaggcaggcagttcaaatggactatccggaattccggatgcggtatggtctcacacacatttggagaattcctttgcccagttgctcactcttccagtactttagtatctgtgcgactgtgccttaagaatggaacaaagcgggtggaagcaatggaaggtacaaatgcgttgaattgacgcggctatctgcttatcatttacgatgagggcaatttacggatcattttgtagatttaagttataagtggaaaggaaggaatgacagacatttgctgtgggtgataagtgtgagccgcaaatatttaactcatgccatgttcgtcgagaacttgttcttcagacgattctgttaccctgaatatccatcccttctttttggcatttgtatagaacagaatattctaccattgtgctagcaggttaagtacccgctgtcaaagtgggaatttcttgaactggtatttggagaggtaccaatgaagtgaattaggcaataagggaccattcaaaaatgaaggacccattagatgattcaaccaaaaaaattcatcacaccatgaactgcaacttattcagtgcctcaactgttaagtctgttaaaagctttgttggtttgttttcatgtattctcaggtgtgcatgtagcatccagttttacctaaggactgcgtgaatcagagagaagcatgtctgcagaaatttacagttggtagatacttagtgcattgtgcaaagctagctttacctatcagatatatctgtaggcagaaagcttatgttcatccttacatttacttccctgaaaataattgttgatggcatgggccttatcttctgtattccttgtaagtgctacgtgtgtcatcttctatatctagagagtataaacttcaatagctgctcactttgtatctaatcaaggtctacataattcaaatttggggacttgaggcctttgctaagttcctgtgcaatgatatagaacaccgcatttgttatcacaggagtttgacatgccataccaagatgtgaatgtgcaaaaggcaagccagtgttacacatgttgtgtatatgatatttaaggctgacattggatatgttgaacatgaatatcagttaacccttctattgatgtttttactgtgctggtaggatcttactcttgttctctgaataattcctcatttttctgcttcaggctcgaaacacggaagaaaaaccctttcggccccaggttgaatgtaatgctcaaactggaaactgtgaaatagtctgatgttgatgtcctgagcttatagattttgcatggttccatctttcagtttaatgcagaagaagcagtagaataccaacttgaggcattaaaatacaatgatcagccacgccaagattatgggatagaagtcatgtacagggtaataggctaatagctgcttgcaaattgctcatttttgcttagatgtggtaaaggtttgacacaacttcataagtctgaatctatatggccttatcagtttgcaggctttgatccttttgagagatcaacttattttgggcgacaatttgatctaggacaggtagaccagaagtattttccttctgacatatatggttgttcatgcttcatagctgtcttgctgattgccactagtgctactccagtttgaacgtttccggcggatatttcaccattcaacttatagggttttgcttgcccacaaagaaagaactatattgagcagtttatgggttgaagaggttggtcttaacccccttaatatttctgtctatcgtacaatgagacaaattatcttgatcttgaatctgatcgtgctaacagaacctatataagcaaagagtgtgggttcgaggatcacgtccggaggaagaagctatatttcagtttacaatggttcaggtacctatcaacacatccttctgtcacctctgttccagctactttgttttttaacccattgttgttgtagagggttggtggctcatgggatgggtactggttaactgagagcttaatcaatgatgatggagatgcactctcaggtggtcttgcttactgaccgatatgtgtcttacactcaagcttctagcgtattgatgtactgatgaatctagaaaattatatagccgtgcaattatgcacggttggtccagaaataggttttctttttttttaaaaaaaaaagattgtccagttatatgtcacggaaagagtagcaatagtacatgtgctgtggtagaattgactgcgacactcccattctgggagcattcaatatgtcaatggtcaaacacgccgctattgtacataagtttggcggctgtatggttgtttatgaaataccgtcatctggaaagctttcagcgatagctcaatgtggatgttcaggtcaggaaacggcattgtcagaagaaacaaagtcctatatacacacatctatgtttttattttgtgtacgctatgattgtctattgctccatccaatcagaagttgaattgttaactgctcaggtacctgatttccgagtatatcttcgatgtttcctgattgacttgtgagtttatcctctatgtttcctgcttttaggattacatggctcatgactgcaggtgacgaggtaagcaagtaaacacaagttgtcttattgcgcttatatttttgaccgatcttctgtttttacatgtttggtcagggttgtggcgtcctttccgatcagaatgtgtaaccttcaagtacttgaaaacatgaaagaagaaccggaaggtggattgaatatgttgtttcacactcaccagaaaagggcaggtaacttgttgggaatatttttttaggtgaccatcatcgtcaggtcaataacttgcttgcaagatgaaagtaacatgatatcgatatctatatattttcgcacaacctgatgatgaggcaaagaaatttgtggatacgggtaaagttccattgcttttgtgcttgaactagtaattaatctgacatttcatagtcgagcactgctccacgtattaaaagtttcttacaaaactcgtgtgccctatttttttagcttattcatgaattattgaaatgggatatttgttcaatgtttttaaaatatgtattctcaaaaaaaaaaactttctattacattattgtaatacttagaccacttgtttttagctgtttgttcactttatttcttaaaatatttaacttgctcatatattcaagagatagtccgcccatcaacatttgatcgatcaaacggggcattagtacaaaattcataaccatttgatctaacttaggtggaggttgtagggaatttagatttactaacataatgtaaaacatttgtaaaagcttttcaagaaaaacttttgtagcgtatatgcttgcttttgaactaaactaagagctttttaataaaactttttgtacgtatagacttgccgtcgaactaaactgacgagtaattaataaaagaccacaaggacatagagttgggtgtgttagatacgggtaaagctccatttgcttttgtgtttgatgcagggcgtccgtgagccgtgtggtgtaccgccgaaccggtgatgccatgcatccatacacgtctacactctacacccattaaccatacatggcgtacaacgtcccaccagctcgtggccgctgccacgttgaacccatagcaacctctcgcgtgaaatatcacgttggaaacaaaaaaaaacgttgttaagtctaaggtctccgtcgtttggcttatttcctaataagacaaaatggtttattaaaaaataaaaatgaatttgtacgtaaaatttttataaatatgttcttggtgacttagaagctaatgttaaaaaagaaactatgttaaaaatatctcaaaattaagcttgaaaatttaaattttggctttttcttttgctgattagtccaaccgatgggagctaactccgtgtgaccatgttgcctacgatttccctgaaagcgaggacggaagtgggctcgaaatagccaaccccgggacagacaaatggatcgatcgatctatcgagcagcccactacaggagcttcccgtccacgtgcgcggaacgcacgctaccgctcccaagtccgaaacctccggtgcctcgcccgtttccccccatgaattccccggccgcgcgaatcgccgagcccccgtcacgcacgcgacgcgcgcgagcgagcgtacagccgccacctccatccacgtcgcggtcgctcgatctctcccccccaagcaaaaagcccaacaaccgcccccgcgcgccgatggagacgagccgccgtcccgcccgtccgcgccttgcgtttctgaggccgttcaggcggaacgcatgagcaaggcgttcccccacggccggttgcttatcgcacagggcctttctgctacgccggcgcccgaccggctcggcgttttcgcggtgcgcgcgcgcgtggctggcatgcattatccgatacggatcgactcgatcgaccgaccagctggtgcgtacctcgattcggacacgggtgagttacgttacgtagaatcgtagatgatgttgtaatgtctgcgtttgtgtacttgtgctgtagtacaggtcgcaatcggactcctgttccgattaggaatattggtgatcggtgcatgcatctcttatccctctcgtctatataactcagtcaggggacaaacgagttcgtccaagtgcaagtaaccccacgttctttgtgcttgtgaccgcagtcgtggtttgcaatctttgtgttcggtgaggtttgtttgctgcatgccatggccgagcagcagcagcagcaagcgccgctgctgcagaggccagccgctgcaccgccgtcgtcgagccggctgccggacttcaagcaatcggtgaagctcaagtacgtgaagctggggtaccactacctcatcacccacggcgcgtacctcctgctcgccccgctcccgggcctcgtggcggcgcacctctccaccttcacgctgggcgacctcgccgacctgtggcaaaacctccagtacaacctcgtctccgtgctcctctgctccacgctgctggtgctcgtctccaccgcctacttcctcacgcgcccgcgccccgtctacctcgtcgacttcgcgtgctacaagcccgacgacgagcgcaagtgcagccgcgcgcgcttcatgaactgcaccgagcggctcggcacgttcacgccggagaacgtcgagttccagcgcaagatcatcgagcgctcgggcctcggcgaggacacgtacctccccgaggcggtgctcaacatcccgcccaacccctccatggccaacgcgaggaaggaggccgagatggtcatgtacggcgcgctcgacgagctgctcgccaagaccggcgtgaaccccaaggacatcggcatcctggtcgtcaactgcagcctcttcaacccgacgccgtcgctgtccgccatggtggtgaaccactacaagctgaggggcaacgtcgtcagctacaacctcggcggcatggggtgcagcgccggcctcatctccatcgacctcgccaaggacctcctgcaggtgtaccccaacacgtacgccgtggtgatcagcatggagaacatcacgctcaactggtacttcggcaacgaccgctccatgctcgtgtccaactgcctcttccgcatgggcggcgcggcgatcctcctctccaaccgcggctccgcgaggcggcgctccaagtaccagctggtgcacaccgtgcgcacgcaccgcggcgccgacgaccggtgcttcggctgcgtgacgcagcgggaggacgctgacgggaagaccggcgtgtcgctgtccaaggacctgatggcggtggccggcgaggcgctcaagaccaacatcaccacgctgggcccgctggtgctccccatgtcggagcagctcctcttcttcgcgacgctcgtcacccgcaaggtgctgaagcggaaggtgaagccgtacatcccggacttcaagctggcgttcgagcacttctgcatccacgccggcggccgcgccgtgctggacgagctggagaagaacctgcagctgtcggactggcacatggagccgtcgcggatgacgctgcacaggttcgggaacacgtcgagcagctcgctgtggtacgagctcgcctacgccgaggccaaggggcggatcaagaagggggacaggacgtggcagatcgccttcggctccggcttcaagtgcaacagcgccgtgtggagggcgctccggtcggtgaacccggccaaggagaacaacttcaccaacccgtggatcgacgagatccaccgcttcccggtgcccgtccccaaggtgtcggccatatgatccaaccacacgcgttggctgtttgcactgaaacattattactagcagtagcttagtagtagtagtagaaatgaactaggatctattcgttattgcttgtgtattgatctgatcatatctggttcgctgttcttatgtgaagttgctctgtcggtctggcatgtaagaaggtctgatcataagttcacttcaaaagttaatttacatcttcataaaatggcaagtaaattggctgtcaacctggaaaacaacaatgaaacagaaatgtacaatttaggctctcttttttttcacttaacgaggaatgcacaacttctcaattgccctgtgacgaggaaaaaaaagttaaaataggttgtcataaaacggcctttttaaaagggccaacagtttcagcacccattgggctgtcaacaaacaccgaactggggctgtacagtaaaggccgaaacttccaagtggagagcatctcggcccattaggcccatatcccacagagccaacggcaacttccgaatccgacggccgaaaatctcgcgtgcgacgaaagctagaccgatccgatccacacctgccgaccaagatccaacggccacaattcctgcgtccatccaaagctaataaaccccgcaaccttcgagaaaaaaattgatgccaccgcagctataaaaccctccgcctccgcaaaatacccaattccatttcgaattctagggttttgttggcccccattcctcccccaccccggtgtcctcccctccgccgctcgggtcgccgcctttttcccctatggtgagtacgatctcgatttcgccgcgccgtgtgggtttggatctcggggttcctgtgtttgatccgcgacgttttttggcttttttttccaggcgctgccgaatcaggggaccgtggattaccccagcttcaagctggtcatcgtcggcgatggcgggactggtgagttcccaatctcgattcggatcctattccgttctgaaacggcatgttatgatatgtttgatgcgtctactcggtgtggtttctactagatctgatgggctaagatttgtaccggtggctgaaatccgatggatttttttttatttcgccattagactgggatttgggtattggatgtttccattttatgattcagcttatcccagggatgggttattgctctatttttatatgacgtctaaaattttgctactcctatcttgatgattaggatcttgagagttattttaggatattgaaatcggcataaatatgatgctatacaggtcgtatttagtcagatgtatttattatcttattttagaatggaccatcgtgctatgctgttattctaggattcgcctgggactgaataaatttgaggaaaaagtaaaatagtatataaataccttcgcatcagtaaactattgcgctttttgatcagttgagattggtcaaaacattagttgcagtctgattagtttaggccggcaatatgcctgaatggcttcatttccgtaagaaaagtttacttattgccttctatatcattgttattggatggattttgatggtatgccatgtttgattgcaggtaaaactacatttgtgaagaggcatctcactggagagtttgaaaagaaatatgagcgtatgtactatgactcttatttttgttgttcctgtattctttgctaaattagttattgaactgttatgcaaatttgtcacttcagcaaccattggtgtcgaagttcaccctctagattttaccaccaactgtggtaagatccgcttctactgctgggacactgctggacaagagaagtttggtggacttagggatggatactagtaagtgctagagaagtgcttaagccaattatcatagcttcccttaatatttttccatgcatatggatgtctccttgtgcttgcctgattgttctgtccttaacttctgttgtgcagtatccatggtcaatgtgcgataattatgtttgatgtcacttcaaggctgacttacaagaatgttccaacatggcatagggacttgtgcaggtttatttctgaagacacgataaactttacctaatatattatatggaagagaactcttatgattaggtatcaactcttgcagggtgtgtgaaaacatccccattgtcctgtgtggtaacaaggttgatgtgaagaacaggcaggttaaagccaagcaggtcacattccacaggaagaagaatctccagtactatgaaatttctgccaagagcaactacaactttgagaagcccttcctttatcttgcaaggaagcttgctgggtaataattccctccttattgttttccttttcatgctttcttcttacattgtttgtgtttattatgcaacatattttaatctgtgttaatgcttttggtgtatgtagtgacccgaacctgcatttcgttgaagctgttgctcttaaacctccggaagttcccattgacctggcaatgcagcaacagtaagtgtttatgctttgtccaattcattttcagatagtgttgatgaaatacctagtttctgcaaacatttcaggaactaattttaatactcatgcaggcatgaggctgagcttgcggctgcagcagcacaacctctccagatgacgatgacgatctgatcgagtagagaggatcatgagtctatcatgcttcagcctgagtctcttcataagagtctgaattaggccaatgcatgctagtgttagcttgtctgtggaatgtggacgtttcctgcgtgcctgatgggttgaaaacttttgatgtgtggtgttacatgttgctgccatgaatttgttggctcttttttaacactgctgtgttacttctatggttatgcttaaactatttgtatcatcgagctggtatttatttatccggtgttgcacaatattcttcttcactgccctaactgcgagtgctgaccgcccaagattatgtaatgttcgcatcgcattaagttttgtatatctgtgatgaaagctaggctcaactgttcttgagaacaggggtggtgactggtgggtgtccggtgtccctgtatcggtaaacaaggacacatttgactgctggtcctcgttgtcgttggtggcgatatactgatatagtgagtatgatggcagtatagtagtacagctcctctaccaacttactcactataccgtatgctcaactaaaatacaccatttcattcgacctggtaaagctgaactgaaaatgagtaagctcttccagttaccaacttaccatatgctcgatagaaaatgtagcatcatcttactgcaactctaaaaaattaaaatccaaagggagaacgaaccgggcgtgaagttatgattaagagctttgatggggaacgaacctggaggcacatggacaggaaatcaggattaagtgatcacttaattaatcccaattccaaacgtttccgacattgattaaatcatcaaacagcattaatcgacctcatttcaaactttgccaacattgctcaaacaacataggagtacaccgtattagtcctggcagaaaaagaacagcaaaccaaagagagatcgtcatcgatgatgaatacgagtacaataaagtagcaacgtttctggaacactccagaagtcactctctctcgaagaaaagatactgcaccgaaatcaccttccgaaaggcacaagccaaatccatcgttggtgcaggcggcaggtccagccagtgtagtgcgcgtcactacgaactctagtgcgcaagtggcctcggccagataaccacacagtcacagcaacagaaaaaaaaaatcgcctcggcgcggcgggcggagacgtcgatacccccgacgaatcctctctctctctctctctctctagatcccatccaccccttccacctctcctctattaaatccgccgctctcactcccacccaccgccgcgacacacacacgcacacctgagccgaagcacgcacgaatccaacgccgagatgaggccgtcgctgctgagatacgccgcgcaggcgctccgccgccgcgactactcctccgccgccgcggccgctgagcggaaggtggccatcctcggggcggcgggcgggatcggccagccgctcgcgctcctcatgaagctcaacccgctcgtctcgtccctctccctctacgatatcgccggaacccccggcgtcgccgccgatgtctcccacatcaactcgccggcgctggtacgtctccacccacccgcttgcatccctctcctggctggatctagccgtgtgacgatgctgggttttggattctgctcctccgcaggtgaaaggcttcgtcggggaggagcagctcggggaggcgttggagggttcggacgtcgtaatcatcccggccggtgtgccgaggaagcccggcatgaccagggacgacctcttcaacatcaacgccggcattgttaagggcctctgcactgccatctccaattactgccccacgtaggccccctaacttttgatttacactgtagagtttagatatgcagtgaggttcatggatctggttgtgaagcatgctgattgcgctggtcacggcttggggattgcacttcattgcccatcgtgtagatctagcgtttatttgtggtctcggatcgtacactgacataaaactgatgatggagactaaaatagctggttgcccccaaaattcagtgagaatttaatagtgacaaggacttgatgggaatagaaatggacgttttgcccaaattcattgagatttaatactataggaaggtgaggtgctagttgcctgcctcaatgttgtgtggtgtcgctcgaggctgcctcaatgttgtgtggtgtctcactcgaggaggctcgctctcaccaggccttgttttgctccatttaatcgcataccgccgagaacgaatgggatgttagattgtgttctgtgcatgtctactccaatatatcagctgaccattatgaagtttattgtgctcactatatatgaatacaattgttaatcttttgattgtatgctttttaggctcttgtcaatatgatcagcaaccctgtcaactcgactgtccccatcgcagcggaggtgttcaagaaggctggtacttacgatgagaagaaactgtttggtgtgaccacgcttgatgttgtgcgcgctaaaactttctatgctggaaaggctaatgtgccagttactggtatgaccttgatcttttactcataattttaggggacattgacattaaatatagctgtggattttatgataaaattttatctccgcttttctaatctttgtgattgctgtgatcttctgcagaagtgaatgtccctgtggttggtggccatgctggtattactatcctgccactgttctcgcaggtatcatagcttacgatcttgttttttgcaatttccttccgtggttacccactttgagctcaatatacatatacagagtgtaaatactcgatgatgatgatgatagaacctcatagaataggtgttggaatcctgcatgttttaagcttgctgtataaacatgcattttttattcaatgaagaggttgtgctttgtggattggagtcaatacagaatggttatcttcatttgacaatcacgaaaacaatatgcaattgatgtcatggaattttttcaaaaaatcaaagtgcatttatggcgtgtggcctacctcctaacggagtaattttttgtgtgatgtaggcaacccctgcaagtaatgcattgtcgcatgaggacattaaggctctgaccaagaggacacaagatggtgggacggaagttgttgaagcaaaggctggaaagggttctgcaacattgtctatggcgtaagtcttcatatcaaccttaaccaactatatccttagtttactagttagtctgtcaatattagtatgctactatgcctatttgtgatattcttgataaaacatcaggaaaaagttctcataatttgcaaccaaccgatcccttggatgttcttgccatcctttagatatgcatgcctcaaagtacattgcctctaggttcaacatattggcttcagagtacatatatgcttggttctgtccattggatgttagctggttatatattttcctttaaaagtcctgtccacttgcttccagactgttgcggagttgttttttctattctttatagatcctactccatctatgagatgttagttggtatatatttgcctattgcactattgcccgctggctttaaaaaaaaacagtagcaacatatcagcaaaattcagttctaacttcttgctgttcccatgcccatttgattttcattgcagcaaagctttactgtcataattggatatatttaggttgcaatgctgccaataatagatggaaaccaaaatttttctatcccatgattatacatttttataaacagttggcatatctgagcttgttttcagttcttgtatgcaatgcaattgtacaaactaatttatccaaatgaatttccccttcagccttataactctctgttattgctttcatgtgagcacacatgcattcaaattttggaaacatatttgtgctcatttggctcattgtgctggagtactatctggaactggaatgaataggccacttggatccatgtagataaactgtgattttatggctttgcaagtttgtatacttcgccctgacatacttctccttttccctagatatgctggtgcggtatttgcagatgcgtgcttgaaggggcttaatggagttcctgatgttgtagagtgctcttttgtgcaatcaacagtaacagagctgccattcttcgcctcaaaggtgtttttcttgcttctttatggcattgttatgttgctaccagatttctatcgctagatcttcacagctcttgctttttctttcttttcccacactattatttccgtaaacaggttatggatgcaacatacaatgtgttatagacagttctactatatgtcttctcacatttattgactgaagtattgaactattgcagcttgtgttcatttgttaatagcagctgttctatggtcatagtttgaagatttgaatggaatagtttgtagtagcaatatatatgtttaccaccagggactaagcttttacaatatttgttgtgttccgctgccttttcagttagttgcaagttgcaacagatcatctcttatctttggttggatcaaaatagcttttaagacacctttttatttaaatgtgctgttctatcgttgtactgttgtcttggctgtggtttgaacactgtttcgttacttgtatccttcaggtaaggcttggcaagaacggagtggaggaagtacttgggctgggccagctttccgagtttgagaaggagggtctggagaacctgaagggtgagctcaagtcttcgattgagaagggcatcaagtttgctcacgcgaactaggcaacctatgcagattctaacaattcaaatgtgaactagagggggggtccctcgaatttttggtttgactgttgttctgccccgatctgctggggcaccgagatgttgtgctccagaataaaatcttgcggcttgatgccaacctgaactcaaaacttgtacctgaaacagcgactccggtgctatttttcaccttgtacctgaaactgcgtacagtgaacccaaatcatgacccgagtgtcggtcttcagtttgttgggcgattagaacacttgtgttggacgtcgcactgcaaacactaaacacagcagtggatgggattgcatgactgacctgactttgctgttctagcagaaatcgaagtttgttaaggttctcttggaagtgtaggctgtcgagtcgttaaagacgcgctagtgtggagcatcaggcacttggctgtagttcccaactctctctctctctctctcttccctctccccttttgtttttcacgcacatgttttttaaaacgatatatttttttcgaaagcttatatatgaatgttgctttaaaaaattatattaatccatttaaaaaaatagttaatatttaattaatcacacgctaatggaccgttcggttttccgtgggagtcgcacagtaccatcaggcgagcacagtgctcttcagcgcatgatctcggcgagtttccgtggcgcacaactgcaaaacagcacaagaccaccacttccttgtctcgttcaccgttacaaggttgcaggcttgcatctcccgtagagacctgaaggacagtgctacaaatcgagcggtccgctgctgtgtgtatggcacgcatcaagaattgtgatgcacgttgtcaacaagcagctttatgcagctgtactttgtcatcctagtaccagtattgatgttcaagagcactcacggctcacgggtatttgatccttcatcgctgctactagtacatactacatgactgtatgcatatgctcaatgcttccactcaaaagaaaaaacaaaaaatgcatatgctcaatgcaactaaatgatatcaaacggatcagtttcccataacatgcacagtactcctacaaaatcttggtttgccagtgcttgaacaaataacccattcaaacagtctatcttcttttaaatagaccgctaacggcacatttattttccctagaactcataaattcgccattcattttttttctactgcttatcagtgtaactcaaaccgatcagagccaaatagcacgcttggacacttgataatcatggcttatccgataatcacgaagaaattggattcaagagatggataattagctatccatggtcaaaatttctcaagagcagaagcacatccgcaaaaggtactgctgaggatctgcgtccgacaggttgggttccaggtgtgaacaatggatgtttctatatacttcctccatttcacaatgtaagtcattctatcatttctacattctatatagattcattaacattaatataaatgtggaaaatgctagaataacttacattgtgaaacggacggagtaattcatttcaaaccttgttacaaacagcatactcaccttagaatgtttagaggaaagatcattatattaataatgacccggctttttgaagaaagcccagaacagagtcttgatacagaaaagtaaaggacacatgcgaacacctcacttgctttctggaaacagactccaggcaagctaccaaatgacaaggcgctaaactcctacagcaaaatatccaacaactacttaacaggttacataaaacaccctagtcataagagacacatttaaaagatcttcaggtaattgaatatcaggtttccaggacctcatcctccatcgcatatcctcaatccacgccttcaatacacccttcatttcctcaatttgtaaaagactccatttctgcagaaacatcaacacattatgaattaagtggaacggagaattgataacaaccccttcaaacacaaatttgttcctggctaaccaaattgcctaacagcaagcagctaaaacaacccaccagaaaccccccttttttccttttccttctttaataaaaagaaagaaatccgagaacgaaattggagacatctcccacccagctatttccctaatggcacaccataaaaatcttgctaaaggacatctaaacatagtatgttctgtgtcctcctctagaccacacattttacaattaatctcccctttccattttttctttttcaactgagcagcacaagggatcttccctttcatggccatgaataagaagtgtttgatctttaaaggaattttagctttccacaagccctgtgccctggtatctatcacccctccaaaagttaaagctttgtacaaagattttgaagagtatccgttcttctcatccagagcccatttcaattcatcccacccttctttgatttccactccctctaacaaactttttagttctacccaattatcccaggaaactccctccaaattcctcctaaaggttaggcaccactctccttcttgccaaatctcccttacagtaccaccttgttgctcatttatcttatacaaatcctcaaaatacaccctcagagacacttgtagtaaccaaacatcatcccaaaaactggttctcctcccattattcaccgctctctttgtgtatagctgacagaattttttagcaatctgcaaacctttccaaaactgagacatattccctttttgttccctaaagaaactctctcctttcaggtattttttgtgaagcagctcagtacacaaatcatgaggttccttttctaacttgaaaatccactttgccagtaaactcacattcattttccttgtttccaaaaaaacctaagcctccataatctttaggtctactcatagccccccagcttaacatatgatacttcttctttttcttctgtatcccctgccaataaaatcttcctctgactgaatccattttcttatgcaccccttccggcagtttataaaatcccatggcatacaaaggtatagaggacaagcaggagtttattaagatctctttcccaccataagaaacatagcccccaatccaagttcccagtctcttttccattttttgtcctaaaaagaaaagatctttgttcccaatcttctcagtacttataggaagacctaggtacacaatgggcatattccctctttcacagttcagaatgtcagcaaactgttgaagatccccatcctccaatcccactccaaatacttcgcttttctggtagtttattttcatccccgacatctcttcaaagcagaacaacaagaacttcagagttatgatgttttgtttgcatggtttcacaaatagaatcgtgtcgtctgcatattgcaggtgagtgatacccccttcaatcagattaggagataaacccacgagaaccccagctttcttggctgactcaagaatcagatctaatgcatcaccaactaagttaaagaggattggtgataacggatctccttgtctcagacctctatatgttctaaaaaactccccttgttctccattaatgttgattgccactttaccaccttcaacagcatttctcacccacccaataaatttttctccaaaatttttcttcctcatgacttcaaacaaaaaaggccattgcactctatcgtaggctttctcgaaatctatcttaaagataatacccctctctttcttagtgtcgagttcatgtaacacttcatgcagaattaccaccccctccaaaattgatacaacatactcaccttagggcagtagcagtgcggtgagcctgggagaggaacccaaatgtccacgtatgaaagaaactcaataaaagtggttgaagctcccctctccacagtgcacgcgcatgtaacccaaccccaatttttttcaggctggccccaccacggaatcgcttttcagttcgcatccttccccctctctctctctcccgatggttttgtgcatgctcagtcctttttgcagacatttttgcaggcttttttgatgaggaactcgttgctcaccaaggaaccgagcaaccatgcggaagaactctggcccacaccctctctcctccacgccatcaaccatcctccatggagctgtgaagtaactcgccagctcactacactgtgaagagccttatagtgatctaaggtccaatgggaaacagcataaaaacatatgcaaataccaatgtattctgcaggtcttacctcaatctaattctggaaatttctcttttacagtatcagcagttgtgactggagaaggcaatgaacgagttactgagcccagcacatactccctccgtttcgaaatgtttgacaccgttgactttttaacacatctttgaccgttcattttattcaaaaacttttgtgaaatatgtaaaattatatgcctacataaaaatatatttaacaatgaatcaaatgataggaaaagaattaataattacttaaattttttgaataagacgaacagtcaatcatgtggtaaaaagtcaacggcgtcaaacatttcaaaacggagggagtatatattgtctccagccacctacataggtcagcatgtaatatcgtagttagagagcattttgctgtttggaggaacaatatagaaaaattcaggaagtctacaacaattaaagaaaataagtagtactccaattagattacaaaaaatgttgcacatgctattccttatcctatattttagctagcatcgatgtgttccatatatatgaacagcaaactttgaaggtgtgccatttctgtactgatagtttgaattacagattcttcacttgacatatcatctccagcttctctctaagctgaaaaataaaagcttctggatattctagcaatctggcaaagttgtcacctacacaaagagaacaatgactgatggaccttagatcaccacaaacctaatcccatgttaccttgcagagggtttatcagtctagaattcactacaggataaaaaaaatcaactccccataacattacaaagagtaactgcagaggttagcgaagatccacctattcagtgaaattcagacaagcacatatcgatagaggcacgatgaacaagaccagacgaacaaataacatatgcaacgaggaaacaaaccaagaacagacaaaggcaagctgattaaagtagcataactactatttctccataataacaatgatagtgttccttatccaccaagatagtcaatagccagggtaaatacaccacagtaccaaactatccaaatctgcaaactaccacaactacaactagcattagcagcgacaagacgagacaggaggacagaggaaaagcctaagcggaggtgaacttggtgacggccttggtgccctcggagacggcgtgcttggcgagctcgccggggaggacgaggcggacggaggtctggatctcgcgggaggtgatggtgggcttcttgttgtagcgggcgagcttggcggcctcggcggcgagcttctcgaagatgtcgttgatgaaggagttcatgatggacatggccttggaggagatgccgatgtcggggtggacctgcttgagaaccttgaagatgtagatcttgtaggtctccacgctcttcttccccttctttctcccgggcctttttcccctcgccggcgccgcccttttcgcccttccccgcggggagccgtttctccgccttgggcttcttccccgccgccggggccttctccgccgcgggctcctcctccgcgggcttcttcgccgccggcttcttctccgccttgggcgccatggatggctgcttctctcttcttggatttcgctgggtgtgtgagcttgatttgtgatgtggggaagacgaaggggacgagtttattatatagtactagcaggctagaggtgggcgctgattggtggagacgcttaccacgcggatcggtgacgtggagcgacgtgggacgtccggtgctgtttcggtagacggtcgcgatgagttcccgtgcggatcggtgacgtggcaaaaatttgtaggcgggagaggggatactgtgattggttttctggcgcgggatggtgcttttctggttggtggggcctttcaatcagtttttgggctttttggcacggagcccactactatccatttaaaggcccatttatcatttaaaagcattttctaggtaatttagcaaggatttggtcaaaatttgaatttgaattgcctagatgcatttcccaagattcggattgtttcaaaatgtgtggtttttcgtatattaaaattggtgtacacatacatagcaagacagttaccatggcatcaaccgaaaaccgtgtgaatttcatcttcgacctttagaatttagaattttgaagtttttaaatctcacgacaacagctcgagtagaaaatcataggcatgtcggatgtcatcatcttctacgctgttgcttggagagcatccgctgtaaacaattttcatacagtgatactagtgccatccaagaaaattattcaagttattcctagcagaacatttcctcccacgttctttctccttgcctcttgcatgttccatgatattggtagaagtactgaggactatgtagcctgtagccagacaagtttgtcctattgcatttctttaaatgtgtacccactgaaatgtgggtccaattggtgtttctattttctcttctagtgttacgtagttgtatcgtaggcgtcacacaggatgaagaccgagttaacaagcatataggcaccagtcgagaccattcttaatattgtcgagggctcgatttacagtggttctagtagttggaagacactttcgcatcttgtttgcgattgaggaacacagatgaaacgctacctaggtagcgtttgaatctcatgaaaatgaagatgaagataaagattgagtgtttcacataaaacaagatggtaataacgtgtgattaattaagttttaattattacaaacttaaaaatggattattcttatattttagaacaactttcatatagaaagttttcgcacgaaatacaccgtttaacagtttaactgtagattttctcactagtacgaaaaggcatatataaatcaggcatagtgagagcccaatgtgcactagtcaatctgatcagtaccagacataatagtgtatcgtcaaagattaccaagacaaaaataatctttttatttttcacaagcctcgctccatggctcgggagacatattgtcttgccaagacatccggccatgcctgcccaagctcaattaatatatcacaactcaaagtgcccaactaagcagctctctcaagacctggtcattgatgcttcggaatgcttcgaaatgtgatccaggataattcttttaacctatcatctttaggaggagttgaaaggaaacagaggtgcaggaagcggtgtcatcaccgatcttggtgcgcccgcgtatatttatatggttgccaatagccggcaacatggctttacaggatcataacaaccttggctaatatctctctaactaatcctgattacaatcattatctatcagctaagataagatcgatatggccaggttgttatgcttacacatgattatatctaatactccccctcaatcacaacctacctacattgagattgtacttaaaattttcaagttgtcttgccgataacgcctttgtaaatccatcggccacttgatcacctgtaggaataaactccacttcaagtaattttcgttgcattctttcacgtacaaaatgatagtcaacctcaatatgcttagttctagcatgaaagacagggttagatgataaatatttagcaccaagattatcacaccacagtcgagccattggaggacttggcacactgagttcctctaacagagtttgtatccacatgatttctgctgtagcattagccaaggccttgtattctgattcagtactagaccttggcacagtagcttgtttctttgcattccaagaaaccaaattatcccctagaaatactgcaaaacctcctgtagatcttctatcatctatatttcctgcccagtctgcatctgaatatccactaacaagcatagactttgacttactaatctttaaaccaagtttagtacattgttttaaataccttaatattctcttcatagcagcccaatgaactatagtaggagcatgtagaaactgacataccttatttactggaaagtaaatgtctggtctagtcagagttaagtactggagtgctcctactacacttctgtaattagatgcatcattgggacctaataaatctccttcatgcaaagtgagtttctcactagttgacaaaggtgtactaacaggtttacaatcagtcataccaactcgtcttagtagatcagtaacatatttttcctgggttagaacaatgccactagatgccttgtttacctctatgccaagaaagtagtgtaagtcacctagatcctttaaggcaaaatccttttgtaggtcctttagcagagctggaactgcatcctgtctcgagctagcaacaattatgtcatcaacataaacaagcacaaaaattattagaccccctttattataaaagaatagagaagtatctgccttggatccttggaatccaaggtgttgaagcttctgacttaacttagcataccatgctctaggtgcctgttttaaaccatagagagctttgtcaagcttacacacatagtcaggatggaccttatcttcatacccaggtggttgtttcatgtatacctcttcttcaagaataccatgaaggaaggcattttgcacatctagttgtcttagagtccaacctctagacacagcaattgatagaataattctgattgtggctgccttgacaacaggactaaaggtatcctcataatctatcccatacctttgtttaaaacctttagcaactagcctagctttatatctgtcaaggctaccatcttgttttcttttaatcttatagacccatttataatctataatatttcttcccttttgaggaggaactaaatgccatgttttattatgcaataaagctgtgaactttgcatccatagcatgtttccaatttgtgtcatgcaaagcatcatgtaaatccctaggttctccggtggtagtaagacagccatacttaacagtacgatcggtataaattttctctttgcgaatacctttttgaagatgtgtgacaggacggctcgcttctccctcgggcgtagaggatctcagcgcctgctggtgttgttgcggattgggaagtgtggcttctggtgccgtggcgacggacgattggctggcaggagaagccgacgcactgatgctgctctcatgtgtcgaactgtcattcaaattggggttggcggtcatgtcacctgctgcatcgtctgctggatcagcgttggagatcgtgcctgtgtcgctgccaccggaatcagctgcatcatcacgagtgctggcgagattttcttctgtattttccacgggattttctgcagcaaccatattagcaggagcagtagggtaatagttcacatgatcattcagctgaacatccccagggttaagcatatcggcaggaagaagattaacttctttacgaagattggttccagcatttggatttagttcggcaaaaggaaaaacagactcatcaaagacaacatcacgggagatataaatgcgtccagtagatgaatctaagcaccgaaagcctttatgaagaggactgtacccaaggaaagtgcatctcttagaacggaaatgcatcttatgagagttatatggcctaagatctggccagcaggcacacccaaaggttctaagggcttgataatcaggagtttgtttaaacaaacattcaagaggagaggaataaccaagaaccttggtgggcatgcgattaatcaaataaacaccagattgataggcctcatcccagaattttagtggtagagaagcatgggctaaaagagaaagaccaacttcaacgatgtgtcgatgtttgcgttcagctgagccattttgttgatgggtgtgtggacatgaaacatggtgtgtgatgcctattttattaaagaaggtattcaatttttgatactcgcctccccagtcggtttgcatggatatgatttttctattaaacatacgctcaacaaggcactgaaactcttgaaacttctgaaaaacttcagacttatacttgagaaaatagatccacgtaaacctactgaaagcatcaataaaacttacatagtacttctttccacccccagcaacaggagcgggaccccaaacatctgaataaatcaactcaagaggattgctaaaaacgctagacgacttgggaaagggtagctgatggcttttccctttttgacaagaatcacaaactaacaatttattggactctgctgaaactggtagatcatgattatggactactttctctactatagcataggagggatgaccaaagcggcaatgtcatcgctcaagggacggtgtggtggctgctagtgcttccttgtcttgttgagtcgaaagcgatgaagatggaagcgggaacagccggccatgacagcgtcctctaagaagcatctccttcatggcctgatctttgagagaaaaatgtttagggtacagttcaaagtaggctgcattgtcaaccataagacaataggctgaaatcaagtttttactagcattgggaacatatagaatgtttttcaagtgaagggaacgtgttggggtgttaacaactgaatgacctatgtgagtgattaccatacctgcgccgtttgcagtttgcacttggtcctggcccttgtatttgtcccggatggtcaacttctcaagttccccggtgacatggtccgtagtgccggtgtctacataccaatttgaatctactccataggatgctgttgtgcctgcatatttctcatcaggaacaaaatcctcatcatacctgtaccagcaatcaatcacggtgtgcccccttttgtaacaaagttggcacttggggcgataatcaacgccattgcctccttgtcgctggttggagttgttgccgcgtcctctgccgcggctgtttcctccatggccgcgttgctgctgctgcggctgcttattgttgcggccccttcctggattgccgcggccacgccctctgttggcgagattggccgagtgttcctggcgcatcttcatgcgctgctcaaagctgagcagctgtgagtaagcctctcctaggcttacatgctcagatttggacactagggaggagatgatgggctcgaaatcttcatctaatcccgcaattatatacgagatcaggtcttcttcatcaacgggcttgccggaagtcgccagctcgtcggccaacaccctcatcttgctgacatattcagcaatgccgaggtcgcccttcttcgtgttcgtcagtgcgatcttggtgttgatggagcgcgcccttgtggccgaagagaacatcccttcaatcgtgctccagagagatgcagcactgctgcatgtagccacctgggagagaacatctctactcatagtggttagcagataacctagtacctgctgatcattggcgatccattcatcgaccgccgggttggagacctcaacctccttctcatttttcttgatgatgatggtcgccgacggcttctttgtggcgccggtgaggtagctgtcgaggcgtgctcctcggatgacggcgagaacctgaaccttccagatcaggtagtttcccttgctcaacttctccgtgaccgtgattcctccgagggaacctgaggccgaagactgggacgaacttgccattgatagattggattgaaaggagtttgtggtgctctgataccatgaaaggaaacagaggtgcaagaagcggtgtcgtcaccgatcttggtgcgcccgcgtatatttatatggttgccaatagccggcaacatggctttacaggatcataacaaccttggctaatatctctctaactaatcctgattacaatcattatctatcagctaagataagatcgatacggccaggttgttatgcttacacatgattatatctaataggagtgattcttgagattaaacatgtagttttgagctgttttcattccttctctgttagctactcgccccgaagttgtaataaggtggcgcatgagcttgccgcgtatggctgtaatctccagaccgtgtcttcctgggcaggctgccctcctagtctgtaacggctagtatccagcgattctgctggtttggtaatataaatatctcggtttctcaaaaaaaaaagagacctggtcgttgagacccatttaatatgcacgtagatcggtcaagctagggcacttgcactagtgggaacacggaatagcgcatgtttgacgtggagcggcatgtgcgacttgggttcagacatgttagttgggagcgatggagcgctagatgcggggaaggtgacatcaacacttatcccgttgaaacggaatcccgttgtctagccgttctcttacactaatatgtactattccgtccaaaaaaaagataacttctagcaatgaaccaagacacacatgtgtccaggtggggggggggggggttaatcctgatcctgtccaacgttggatgtgtggtcgttttcagtggtcagaaacagttggaatgtgctactctctctgtcttttatccttgttacccgtactggaatcaataactcctcctgaataagtaaaacccctatgataatatcaacctctgttggatgcttgattccattgatatcaatatctgttggagcattgatttcgttgatttatttatgcccatgctgcacgtacgcttgagagcgatggataggtagtaagcgattttcattcgccattgagaggaaacggacatttatttttgctgagcctgtctatatatctacaatacacaagaagagaacatgaacaagaaaatggtcagaatttcgtggccacaagcaactaaagcttgcacgcaatcaagtgacaaactcactgaccatgtacacaccaatgctggccatggccagttgcctagttgctagctgggatatgcctcgaattaccatcggtttttgcctcttcttactgaaaccagagaactgcaaagttaagttcatcaagaaagtaaatactaataaaaggggcacatgattgcaacacttgccaaccacaaaatcaaagtcaggttgctactagcatcacaacctatgagcgacgacaagaatcaaaccgatatattccttgaccgagaacagctagtagccatcgacgactctatttgcattggttatttacaaattaaaattcagtgtgtatcccctgttatgtttatccacgatgacagtggatcataaactgaaataaacacagtgcgatctggcagaggaacacgcgtaattcttagccagtgtggcaaacgagtgcacgtaggatatatcgcttgttagatagaaagaccgcgtacgcacacgcctagctaacaccggctgtgacgtttgatcggagtccagctcgtgcaaaccggagtaccggacgccagacaaagccaaaaatgcatgatcagtttaattagtacgttaatttagtagtatcatgcacatgtatgtgtggttatgtacgacagagttaaactatatttgatcgaaatcatgcatatataagagtatatgtcctgcacagtgcatgcatgcacgcagttctgtgacaaaatcttatttgggcttatatacttcgttctcaagtaactaacagtaattattttcatcttagactacttaatataagtttttcctatatacacgttttaacaatatagcataatttctagcatttgcaaatattttgctgaacgatcaaaatgtgaaaatggaagtgtccaatatcaggtttttaagtaaatttcttagaggcatgtaaatgtatatagccatataagttactccctccatccctaaatatttgacgccattgacttttttaaacatgtttaactgttcgtcttattaaaaaaaattaagtaattattaattcttttcatatcatttgattcattgttaaatatacttttatgtatatatatagttttacatatttcacaaaagtttttgaatatatttaaaaaactcaacagcgtcaaatatttaagaacggagggagtaataagttatagtagttcaagttatataaggtatttcctccgtttcacaatgtaagactttctaacattgtccactttcatatagatgctaatgaatatctatataataatgtctagattcattagtatctatatgaatatagacaatgctagaaaatcttatatcgtgaaacggaggtagtatatctaaaaaaaaattataggaatacaaggccacgtcgatcagcatcgaccacatcgaaacgacctatataaatacacacgcgccaaagcagaaacgaacaaagcacaagatttagctatcctagcaagtcgccaaaaaaaaaaaaaccaacgtagctgcaagcaacaaaacaccagccgggccatgtcgtcgtcgccgatgcttggaggcatcgccgacaggtggcgcgagctccatgggcaggactcgtggaatggcctcctcgacccgctcgacctcgacctccgctcctccatcctctcctatggcgagctcgtgcaggccacctacgattccttcaaccgggagaggcgctcgccgcacgccggcgcgtgcgtgtatggccacggcgacctcctcgccgcggcgggcgcgtccgccgccggcagctacgcggtgaccaagttcgtctacgccacgtcggggctccccgtcccggaggcattcctgctgctgccgctgccgtcgctgctgccgccggcgtggtcgagggagtccaactggatggggtacgtcgccgtggcgacggacgagggcgtcgcggcgctcgggcggcgcgacatcgtcgtggcgtggcgcggcacggtggagagcctggagtgggtcaacgacttcgacttcacgccggtgcccgccgcgccggtgctgggcgccgccgccgccgcgaacccgcgcgccatcgtgcaccggggcttcctgtccgtgtacacgtccagcaacaaggactccaagtacaacaaggccagcgccagagaccaggtgaattccacttcacttttccagtgattatttgacctaagctattagcctattactaccacaagacgaaagtctcgagacaattaataacacctttaatttgcaaattaatcatccatgcatgtgtctcttttgacgttggaaaggtagagaattctatatgaccacggtaacaataaattataaatgttctttttgtgaatactgcagagaatcccactcgaatactgaatgcacctttcagtttgctccatgttaaccgatttttttatgagaaaatctaaaaaataccattaacaaacacccaaatccaataaatatcatcgacgagtgcaagttctataaaatgtcatcgtacaagcgattttgttccataaacattatcgttgttagggttctattgatcatgtgtcgttaaatgcactgttcatcttatatcacttaacggaagactagtaacgaattgaaaccttgacattggtggtatttctgaaacaaaattgtttgtacaatggcatttcatagaacctgtacttgtcgatgatatttcttgaaattaagtgattatcaatggtatttcttgaatttttgtttcttcttttttattatcattacttttgcatagttgcattaattcaagcaggaaattgggatattgatttatctttgcctggaaaattgacatattagttgaaagaagcacatttttaattatttgcgaagtattgcataggatgttaagggtggtcagctatgcaggtagatacatttaagttgtttcaaagataaggtaggtacattcaactctgaaaaatcctccataccaaaaatagggccaaaatataggttttataaaattaattaaagagaacggtatttttgttcagctattataattctacaaaggggtagaaagcaataatggaatagcgtgacagattacggatgatgtcaaattaagctcataatgagcagattacccaactatgaacaaaatattttaaaagatgctgatactcaaattttcataccttgaatattacaacacgccaatatattttgtcatgaccggaaggggtagtatgctagtttcttataataaagtgtggctagtaaattaaagctgttccanttagttaacttannttaatacanatagcattcatttacagatgcatgtgcaaattattttttgttatctctggtagcgggcttcgtcattatatttttctaagtatcatcatctagctaattaagtaggtatacacacataacgtgttaaactatgttgctataaaaaaagtttaagttatataatatcgctcgtcaatctgagcgcgccttcttgctgattaatttcttcaattattcgatctctaataatgttcattattgtacctgtcacagcgacagtcagacttgcatatatagatatgttggattagatgcaccaaacttgtgttgttgcctttgactgaattaattgtagctatcctatatttgttatgctactcgtcagatttatctaaactgttctcaaacaatgtccttatcgttagcatttgactttgaaagatttgtttttttgatactgatatttcctatctaatcacatttttctaagataatgtctaatcacataagactagtgcatgaagtcgtgcattcacgtgactatcactatatttcgattagtgacgtaatatctatttctgatattatgtcactaaaatatttattgtgaaaaatatataaaatatatgtttgtttcaagaataaatggctttatcatttctctcaaccatgcaaacatttattttttttctatatttcttatgtgtgttttctttgctctatatctctctcccacatatcaaggagacaccggaaagctctagaacaccatcttttatccaatggctaagatttattctacctgttttgtttgcttattgatttaacggctattatccattagatgatgtggcacattcttgttctgttttgggattgtcttttcaagagttaaaatggcgtaatatctaatttcactaaaaatattattgtgaaaaatatataaaatatatgtttgtttcaagaagaaatggctttatcatttctctcaaccatgcaaacatttatttttttttctttagttcttatgtgtgtcttatttgctctatatctctctcccacatatcaaggagacaacggaaagctctagaacatcatcttttatccaatgactaagatttattttacctgttttgtttgtttattgatttaacggctattattcattagatgatgtggcacattcttgttctgttttgggattgtcttttcaagagttaaaataagactttgaaagatttatttatgtgacactgatattgcctatataatcacaatttaacataatgcccaaccaaataagataatcacatatttttacataatgtctgatcacataagctaccttcaagttactacttgggagccatcgtttcttttattcgtggaataagcggaatggcaaatttacaaacgaaaagtgatttataaataaaacttttatataagtgttcttaattaatgatctaaaagcaaacgctgaaaaataaacttcgatgagaaaacctcaaaatcagctctaaatttaatgttgaaaattcaaattttggttgataaatataagcataagcgaaaagatgaggccccatgattacaccgaaaaaaaaacctctcgattaaccatgcgtcatgtccaaaaagaaaaaaagattaattctgcaagaaaatgcttgcaggttcttgaggaagtgaggaggctgatggagttgtacaaggacgaggtgacgagcatcaccgtcgtcgggcacagcctgggcgcgtcgctggcgaccctgaacgccgtcgacatcgtggccaacggcgccaactgcccgccggcgagctcgtcgtcgtcgcagccgccgtgcccggtgacggcgatcgtgttcgcgagcccgcgcgtgggcgacggcttcttcaaggcagcgttcgcgtcgttccccgacctgagggcgctccacgtcaagaacgccggcgacgtggtgcccatgtacccgccgctgggctacgtggacgtggccgtgaagctgcgcatcagcaccagccggtcgccgtacctgcggtcgccggggaccatcgagacgctgcacaacctcgagtgctacctccacggcgtcgccggcgagcagggcagcgccggcgggttcaagctggaggtcgaccgcgacgtcgcgctggcgaacaagggcgtcgacgcgctcaaggacaagtaccccgtgccgccccggtggtgggtctccaagaacaggtgcatggtcaaggacgccgatgggcactgggcgctccacgatttcgagcaaatttaagctctcgatttcgaaaaatttgcaaaatggattacgtatagaagtgctcgttaatgggcttgacacgtcgaataaatgggatttccccctcatatcacataattcatttgtaaataaaactctgtccagtcaaatgcatgtgttgatttggacattgttacagatacaaaggtattgatttggacacgttgagatgtccagtaattatttcttgatgcatatgcgagttcatgctcatgcacattgatacactccatccaatcatttactctgcactatcctcatcttcctcgcggtccatcagagtccagcggccatcggcgcctctcaccatgcccctgttcgacgggatccaccacccggccggcacggcgtgctcgtcgcgcagcgcgccgtaggacttgttcgccagcgccacgtcgcgctccacggcgagcttgaaccgcccggcctcgccgccgcgcgcgccggccacgccgtgcaggtagcactcgaggttgtgccacaccagctcgttcccgggcctcctcaggtacggcgactcgcccgtgtcgatcgccagctctgtgcccacgccgtggtacggcggcgccggcgggtacctggggacgacgtcgcgcgcgttgcggacgcggaggaggcggaggccgaggccacgcgcgccgtcgaagcggcgcttgaagccgtgcccgccgacgcgcgggctggcgaacacgaacgcggtgaccgggcagcccgccgccgctgccgcggcgcggggtgccctgttgtacccgttttcgacgatgtcgaacgcgttcagcgtcgcgaatgcggcgccgaagctgtgtcccgtcaccgtgatgctcagttcctcgtcctgggacatgctcaccagctttgccaccttggtcaacacctgcatggcaacatccatgtcgatcagtgacaatgtggtaggtgaccttgccgtgctactccggccattactacctgatctcgagcactgtccttgttgtggctggactcagagtccctggaggtgtacatggacagccaccctcgatgcaccatggcgtcggaagctttgtcccggaggaggcccttgggtggcaccatgacgaagtccatgtccttgatccactccagcgactgcaccgtgccgcgccacgcgacgacgatgtcgcggcgcccgagcgcagccttcccttcgtcggtggccaccgcgacgtacccgatccagttgctctccctgcacctgcgcgcgcgcgacgcggaccggaggatgagcggctccggcacggcgacgcacgacgtcgcgtacacgaacctggcgacgcggtacgccgcggagtggcccggcagctgcgcccgctcgaagaagcggcgcgcggcgaacctcgagaggcccgcgtgcggcgagagcttctcgtggttgaaggcgtcgtacgtcgcctgcgccatctcgccgtagcggatgacggtgcggcggaggtcgaggtcgaacgggtcaaggaggccgtcccagtcgctctcaccatggagctccttccacctccgggccgtgccgtcaccaagccattgttgcgacgacatgaccgatcgactagtaggtcacagccacacaattgacactggcacactgcaacctagcacccatttatacagcagcggcaatggttgacatggtgccaatctttctcgagcgttcttgcgctcgtgggaataatgacgaacactcacagtgcatgccaatggcatgagcatgacatgtcgatgatgtagatgcatgatgacatgagcagatatgcttcgtgtgtaactgcatgccctaactgggaaagaagatcaaatggtagaagagatagcaagaagcacgccacagtaacgcgagggtggagtggaaagccatcgaaacggcatgaacgtttgacgtgttcgagctcagaaattcagttacggacatcatcgaacagaatccttgcttcgaggctcgcagagttgcagtgcagattcgcgtcggcggcgagagattcgcgccaatggaggagatgggtctcagtcggcaaagaaacggcacgtcaggaagtgggcccattaatgtgggccttactggtgggccataaatttagatccaaagtgttgtgggcctaattagcttggcggggaatttcgtgaaccataaacgggcctaggcctgaaaattcatttgggctttattggatcgcaactaccattccaaaatagggactctaatcggccatctacaaagccatctgctcaacatgaatttctgaatccaaactgatccatccaaaaacatttcagaactcttgaaagctgcagcaaactttgattagggccagctaaaataaccatgacatatgcagcattcatcctgtaagcacgcactgttgcaattcatgagcgatttggggttgcttaaagtgacgaacacgccaggattaactagttccaccaacctggggtccgatcaatcgaatctctcatcctcaactcgagcatgaagacaaacgctcaagatatcctcccatggcgatcgatagtgctcgatccacctagctatctagcaaatcctttgcgtcgatgcgaatacttcccttggcgactaatttggtggcgttcataccaagcgttccctaccccaaaacgtgagtgatcaaatcaattgcgttagccactgagcttagctctcgactttgcttcttctatcgatggcctttcttactgttcatccttgccgacacgttggtcacacgagaagcatctttctctttgatgatctgaaacttttctcgtgatctgtgactccctgcagatagacaggcatgtcatcagcgattgagatgctgtgaatccttggacacggtacgaattgtttgttcacacaggtttcttgagttcctgtttcaatatcactgtcactgagcttggctgtcatcaagagatcgacaagttttcatgtgtgagctgcagcctgcagaagtgcaagcattgcactgcagaaggctttgcattcgtgctcgtcttcacttgtttgtgtccgaggcgagagagatagcagcagcaggtgcgtgtgatgtggagtcagctttttttccgcaggagcatcaaaagaatacgacatatggtgaacgccatcattttttgtccaaaaacaccaggattttgcatcgatcgtgtgggggcaggatgtgctgctgctcatttggtcagaatgccggaggacaaatgcaggcaggacagatacagttgcccttgatttgggagttctaatcatctcattaactaccattgttaagatcactgacggcgtatttattatactagtacctgcattttttaatggaaccatatgcgagtgtcattaagaagttggagaatggatagcactagcagtagcagcagagcaagtcagggtttgtggacctgatgatagcatcttgctccagtggacacgattattgagatgtacatatgtacaactgagaatatgattagcgcacaagatcggcgatgcaaatgaaatgatgttttagcgaaatt

SEQ ID NO: 32319 - DNA, 7082 bp, Oryza sativa
  unsure (1)..(7082): unsure at all n locations
tgtctcttgaaaactcttgaaagcaaaaggtttgaacaaactggctcaatcagagtagttgtagtacaactgaacaaagaaacaactgtagaaagttatcgtcttttcgagcgtgcatacgaatacaaccattctaacaccaacacacaggttaaaacaagaacctttttctctgtcatctttctcgagttccccacccccgattgcatggagaagagaactagtagtaatagtgtatacactctctgaatgtttgcaagtcattgacatcttctccttgttacctgcatttcttactcttggatttttctcatccatctaagataacacggcaatctgcagttgggaattaaaaaaaaaaaggaaattagagtagctgcttggaattcgagggtggaccctttgtcagattgattcgtggggccgcgatactgtcactgccacactaaacgcagtgactactccctccgaaaaaaaaaatatataaaccctgttttccgtatccaacgtttaaccgttcgttttatttaaaaaaaatatgaaaaaaattaaaaagataaatcacgcataaagtattaatcatgttttaccatctaacaacaataaaaatattaattataaaaaatttcatataaacggacagtctaatcattggcacggaaatccagttttttttttaaaggacggatggagtaccagtgaattaaaagacgtgggcaataaatgagctgagctgagacttgcacgtccataattaaaaaaagaagaagcaaagtgtgggtacacgtgggccacacacacgccactagcacaccagttagccgaggcccagctagccgttggagcgaataggcttgaccaaattgaccccacgttgctgaccgttgcttcgcgccaagttcccttgaaccatagggattttgaaaaaaaacatactacttcctccgtcctaaaatgaagccatttttaatattgacacgggtattaagaaagtaagtgaaaattattagaggaagtgtgtgattggttgaaaagagaaagtaggtgaagaagaatggttgtgattggttgagaggaggaagtaggtgaaaaaatagcttcattttaaaataaaactttgtccttaaaaataccttcctttttggaccggagggaattttgtgtttgccttctttttgttgatgctgcatttgctgcgtggttaaagttcgggagttgcttgcaaatttctgacggtttctatgcgtggctggtgttcgtgcaaatcaaatccgatgtggagaggcagggcgatttcatccggttcctgatcaaggaggtggaaggcgccgcgttcgtcgacatcgaggacgtcgtcaccttcgtcaagtggctcgacgttgagctctcacggctggtgaacttagccagctacatccattcactctcacatgaaacatctgcttaacttgaagctggacatggactgatcgggatgttcaccgtgttgctgcgcaggtggacgagagagcggtgctgaagcacttcgagtggccggagcagaaggcggacgcgctgcgcgaggcggcgttcggctaccgtgatctgaagaagatcgaggaggaggcgtcgtcgttctgtgatgatccacggcagccttgctcttctgccctcaaaaagatgcaggcgctgttcgaaaagtaagctgtcctgcattggcccggcttacttaatgctgatttgagcaatcagctatgtgctagttctggtctgctatttgtgctcatcatctttgatcattggcaggttggagcatggagtgtacagccttgcgcgagtgcgagatggcgcgatgaacaggtaccgcggctatcacatcccatgggaatggatgcaggacacaggaatagttagccaggtaattcagtgtttttcttttcaattgttacgacatggtatctggttttaagtagaacagcatgtagcacgaacatgtacaaataatgtcatttgtgcatgcttgttttggttttttcatgcaccaaaacacgcacaaggatgcgaaaaacattaacacatataagacatacactcgagataacaacaaaaagaatttgggggtaaaatggccaggtctcgggggaccaatgaaaaggctctcaaccatttgctgggatttgcttatttgcagtgtaatgttcatgtgtgccagggggctctcgtgagtctgtttttttgttttgcatgtactggtagcagagaatgttgatcgtatttttaattcgacatttgtttttgctgctaacatggacccattcttgttgttttccactaggaaatggtccaaatgattgtttgaaatttcctgcatatactagtaggtggttcttttacgtagcacatatgatttttatcttgttcaagacattgttcgtcaaagctccttggtagaatggtatatcaacgtaccacctagtgccttgacagacttccagctaaatggcatatatctcattgctggattcggatcagcttaagcagtagtagtgcatgctattggatgcaaatcggatgatccagattgcatgctgtactgtacatagtactgtagcaaaatactgtagcacgaaatactgtagccattactactgtagcgttcgatctgaatcgttgaatgtaaaaatggatggccaaaattatgtgcagtttccccattgctagatgttacaacctcttttctagaacttgctgcaggattgcttctgctgtaactacactacttccatcattgaacaattagtagcatttcaatgacaaattgaccctgatgtgcagatcaaactccagtcagtgaagttagcaatgaaatacctgaggagggtttcctctgagcttgaggccataaaagatggccctgacgaagaggagctgatgcttcaaggtgtccgattcgccttcagagttcaccaggtactcaatcagaacgaattcactaataagtgctcatgcagcactagtgcataggagtactacttatctagtttccattttcttttcacgaacacttatcaactttccgtagctcagtatggtattcaatccttttgttccatgcagtttgcaggtggattcgacggtgacacgatgcgagcatttcaggagctcaaggagaaggcctccacgttccaatcgcaacgggaatgccaaaatcagcatttgcaacagcacaagctcgctggcagaagctgaacgcctgaaacgatgtattatataccactcctttactgtaggagtataggatatatacccaatgtatcaatcaccatggaacaattttctctcaaaagtatttatttctctctcctcttgatctgtactgtggctgggagtccgggagtgaagtattaacaacagttactttcatgaattgtgttcatgtacaagaaagactacaggtgactcccactcttgtgctctaatttctgaagacagaactacagagatcacacagatcagacaaactgcatttgagcaagagcacagctgaaaagagaaaactgaacatttgctcacggagtcatgagtcatggatggagagtctcgcagggcaagctcttggagctagagcttccaaccagcagcttcacactggtcaggtccacggacgccgtggctctgcgcaatatggacttcatgttcctgtcgaggctctgcttcactatcctgtccacggcgttccggcgatccttggccccctcgccgccgtcgtcgcacgacgccgacgacgcgccctccatgcgagggccggagtgcgccctgatcctgtcctgcccttcctccttgaaccactgcaggatcttggccgccctcctctgcgccagggggctcccgaggagggacacctcgaggagcgcctgcacgacgccgaaccggcgcatccgccgccgctgcagccggctgccgtgcgcgagcaccatggcgaggtacgcggcgtgctcctggcaccgcggagcgtcgtgccacgtcatggcctccacgagcgccctcggcgccgcctcgtcctcctccatctcctccctccccgccgcggtcgccgccaggtcgccgaggacggacagcgccgcctccgacgtcttccggtccagggagagcgccaggagcgcgcgcaccgcgccgctcgacgccacgtcgcggacgtgctcgagcttggcgagaggttgtggagcgcgcccaggcacggcagcttcgtgtcggccggcgcgtcgtcggcgctgaggacggcgacgaggaacgggaggagctcggaggaggcgagggggaagtcggtgttggccagggaggagatggagaggaggaggagcgcgagctcctggcttcttgacatgtccttgtcgtccatgagcaatggcagcttttcagaagaccggcctgccaatgtgcaccttgtttctgaaaaccaaaaagcattgctacccattagcagagaacttagatgtcacaactactgaagaatattcagtgcaccgtgaactattgaatacattagaaacagaagtaaaagtcaattacaatataaaagcaaacatgaacatgattaaggtgaaaacaaatgagaaatgctttctcatgtagcaagcactacttctcctgcagttcatgcatcatggtctactagattacacctttgtttcatatgcttccacgggtgtaattgatgttagaaaattcaccattgtggaatatctgatcctacatgatgttgtataggcatatgaggaaaacagaggggaattcagtgtcagtctacatcaccacatgtaaaactgggattccatattcctgagtggaatcacacatacgagaacatgaggtctactttttctacagcactactccctccgtaaaaaaaaaaaaagacaaaccctgggtttacgtgtccaacgtttgaccgtcttatataaattttttttataattagtatttttattgttgttaaaatgataaaatatgacttatactttatgcgtgacttatctttttttttcataatttttttaaataagacgaacgatcaaaagttggacacggaaacccaggtttattattttttttttttggacggagggagtactatacactatcaacgcagtcacatcagtgatgtcacacggctgaatttgcacaccatgaacatgggcggctctatagccatatccacatagaaaatgcccttttatcatgcatgtccacacatgggtctatttagtgttcttttcgtagaagtgattcaaacaacgaaatgaaacacatggttaggcacacttcggtacgattctctcaagaaaacaaggaagataatatgtaagaactatgaagtttggtattgctccaagtcaatcttcagcaaccggcctatgcataatgcatgcacctgccgaatattatatccctgtgctgcctaatactaccaacgaacaatgctgaattttgagtcgtgtaaagttctgacattttgttcctggtcaatgattctgtcatgaagcaatggctttaagggactcaaagaaacaaaagtaggctcaaccacacctaatgcctacagaaactagaatgcaagaaatgatgtggcgtgtgtggctgttgtgcatgttcagatgttgttatggaactattggacaggctagagcagctaatatcactctcaattcagagattgaaagcaattgttgtcagaaatgcttgtaggttgagacatagtaaagctagctagtttcaagcctgaattctctgccagagacttgcagtatgaaagttgtatctggtctttgcatggtccagttgctcttagacattcagatcatggtgaatatgtcagtatcgtggctatagtgcagtctagatacgtggagatgtaacaaccaaaacgtattaaattctacttcttcaagaagagcgtacgggcagttgagtctcaagatcaactttgaacagcaggatcaaggctatgtgcagtaaactagtaaagttccatgctaattttctgctttagaaaaaggtttacatgttaattaacttgaacttgttggaacagcgtagatcatgacaagtttaaaaactaaccgaattctcagcatatacgtttccagagaaggaaagcaggataactcagccaaatgtgccaagttgatcaagaagatcagagcgcggcgtttccttttacagttctactcattgcaagaaccagtaactattcttcgctcatgtttggtccatgctttacttatgacaaaattacgcaaagcgtaattcccactcggatttaatttcagaacaagatcggtttcaacttcatttctctactgtatctctaccctgagaagttgcacttcatttctcagatcgattcacagaacgaaggtgatgctcaaaaaacaggttggcatccgaagcatgaactgaaagtctgaaactgaataacggatggctcaagcaaatcgcaaattcgcaacacacgggaagatatactactgacctgtgtgctcccctggcgagctcaagcagcgcccccgccgcggccatcctcgcgccggcaccacctcccctggcgtcggcgagcatcgagacgagcggcggcacgaccccgagctcggggagcagccgcttcctcccctcgtccgagcgcgccagccttccgacctcccccgcggcctccgccctctcctccgccgtcccgaagctgagccgcttcaccgccgccctcattctcaccgccgccgcggcatcatcgcccgctgcctccatgccgatcgatcgtacgcggccagcctccggtgcatgtgcagctgcgcgctacgagacgagacgagacgacgcagccgtgagacgcgaggtgggttaacgtttttttcgcggcaaaggcgcggggttgggttgggttgggggggcctcggcgtacggtggtttttgggggaaaagtgtgtgggatttgcgtggttccgggcgacgtggagagcacttgggggttggggtcgcggggggttttggggctttgcggggaaannnnnnnnnnnnnnnnnnnnnnnnnnnnnnnnnnnnnnnnnnnn

SEQ ID NO: 32320 - DNA, 547 bp, Oryza sativa
gtacccctatcgttggcggtgacaaggtccacctcttttccgctggcaatgtgcgctcctcctctattaggatgtgtccttcgagatggttgtgttcaatgtccccgcctctcaccgtgactacatccgcgccggcatggtgtcccttgccaaccacaacaacttcgtcgcaggatcctacgaccacaacatcaaattgggggatgcccgcattgggaaaaccttgatgttgtcttctctcgtggcaaattggtggagaatgtgttgtttcggcagttcaacaggatgctagcaatcgttgggctcgtgcgaatcttggcccatcgtattgataccagggagttaaattacaccacttttaataatttaaaggtgaaaatatccatttttacggtggaaaggtaccttggatctttatatgaaaaagtcaaagtggacttactccaaagaatggtcagaatccccagaacccaaccagaaaaccttggaggccattatcggagaaagggattttaaggcttactttacccttaactggaattggtta

SEQ ID NO: 32321 - DNA, 448 bp, Oryza sativa
gggttcatggacgcgaccctcgagcacgccgtcgatgggcgccgggaacgacgccgcggcggcggcgtcctggtcgaccaggaggcggtggagctggagcacggagttgatggcgactgcctcaccgggcgcgacctggaacatccacgggcggagcccgtctagctggtccgcggcgatcccgcggaaggcgaaggggacgctgcaagatctcgcgaactcggcgaggcggaggcccacgtcgcggagctcgtcgcggttgccggcggcgtgggggccgatcccggtgatgcggaggaacggcgggccgccggggcggacggccaaggcctgtatgagcgacggccactggatgccatcggtgagggcgaagtcgatcacgtgcacgctgttgcacccctcgaacgcctcgaggatggcctggttcgtcgcgaggggggcgaacttg

SEQ ID NO: 32322 - DNA, 319 bp, Oryza sativa
aatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaag

SEQ ID NO: 32323 - DNA, 2183 bp, Oryza sativa
ttcttatagaaattaccaagaataatccggaatttatattaaattctccaattctaccactattattaatctattattaaattctaattattttaaattttctaaacttgcctaatctcctctaatttctatttatttttttcttttctttttctctcctcttttctctcttttcttttctttttccttctctttctctcttttcttttctttttccttctctttctctcttttcttttctttttccttctggttctttccctcccggtttctcaccttccttctttcttctttctctccctcggcttctcccttcttctctttctcggctctctctctacccggcggcacggtgataaacaagggggaggggcagcggctcaccgacaccggcggcagcgacgacggcggtggtgacaacggcgcacggcgtggcacactggggcggtggcgcggaggcacgaaagcggcggcacgacagcacgagggcggcggcgcggcggcacggcggcggtggtgcgtggagaaggggagagggagaggaggagggaatggagtggggtggagaagggggaaggggccggggtttttataggggagagagggggaaaagggagagaaggaggggcaggggtgaaacgatggaggcgcggggcgcgaggcggtgaggagacgggcgcgcggcgacgggacgggcgacgcgatggcgcgtggctcggggcggcgacgcgatgggcgggcgacgcgacgggcggcgacgcgacgggcagtgacggggcgtgtgggcgcgcggtgcgactggatggcggcgcggcgcggcagtggttaattgtctgcgcgcatcggctctgggcgcgaggcacgcgcggcatgggagatgggacgggcgtgcggcgaggcaagggcgcggggcgcgaggcgacgacgcgacggtgatgacgatggcgcgcggggctcaaggcggcgacggtgacggcggtggcgcgcggcgctggccgacggcgcgtggcggcaggcggcgctggcgcgtcggcgcaggctcgggcggctaggggcagaggtgggagaggagggggaaggctagggaccgcatcgaacacctacgccataatgaacagtgtattttcctatttatcccgattttagtttatttcccatataaatttgattctataatttctaaatcttgcataaatgaagtttactcaatatttgttttatctcaactaatgaattcatcctagattaatattgctcatattttatttgtataatttatttgaatttttaattagggttaattcttattccatcgcatttaaatttaattgatacgaatatgatcgtgataatattttatttattcctatccacacctaatctttattttaaattgaatttattttaccaatttacttctagggtttattcctaattaaatattctttactcacgattaatgaacttcgaaatcaaatccaaataaaataggcgaataagatcggcatgatgcaattaatttaaaagttttcgaaggtccgtatttttagagttttgcttttattggtcaaattttcagggtgttacaaacctaccccccttaaataaatctcgtcccaagatttcttaccagttttcgaatagatgcgggtattccgtcctcaagaattcttcgctttccaaggtggcttcatcctcagtgtgattactccattgtaccttgtacatatgccacactttgctcctagccctcttttggcttcatccaatatccggaccgggtgttctggatacgtaagatcattgctaatgtgaatctcttccagcggagcttgttcttccggcactcgtaagcatttctttaattgagacacatagaagactgggtgcacatcagcgatattctctggtagctgtaactggtatgcaacttctcctcgtctagccgtgatttgaaaaggtcccacatatcttggcgctagttttcctttgatcttgaaccttttcgttcccctcatcggagaaacctttagataaacgtaatctccttccttaaactccaggttttttcttcgggtgtccgcgtaactcttctgtggtgattgtgccacttttagacggtctcgaatcaggtgaaccttttcttcggcttctttgataatgtcaggtccaaataccgcccg

SEQ ID NO: 32324 - DNA, 6554 bp, Oryza sativa
  unsure (1)..(6554): unsure at all n locations
caaacatctctcccagtctttgctaaaatccaatgcacaagctctcaacatgtcctccagaacctggttggttctctctgtctagccatctgtttgtgggtgataagctgtgcttaacgcagggtaacttcctagggcttcatgtactttttcccagaaatgcgaggtaaactgtgtgcctcgatcagatataatcctcttaggtccaccatgaagacatactatcttggtcatgtataactcggctagcttggcactgctataatttgtcttagcggggatgaatctcgccgtcnnnnnnnnnnnnnnnnnnnnnnnntgttgcggtcttgggcaatccaacaataaaatccatacctatctcatcccatttccattcgggaatcctaagggattgtagcaaacctgccggtctttggtgctcagccttcaccttctggcacacgtcacagagtgctacgtactctgccacatctctcttcatgtagggccaccagtatccttccttcagatcctggtacatcttgttacttccggggtgcaatgaatatgccaattcgtgagcttcctttaggattaatcctctcagcccaccctgttcgggtacataaatcctctttttataccataggacatccttctcgtcggtagaaaattcctttgcaaatcctgcagctagacgttccttcacctctcggatttcctcgttgtccttctggacctcttctatttgggttctcaaaagaggttgaatgtccaaggtgtttatctgtccatgaggtactatatgtaggtttagttaggccatttcctccttaagctcaggagccattccttccgtcctcaaatgattgcaatggctcttccgactcaaagcgtcggccaccacgtttgccttgccggggtgatagtgaacctccaagtcataatccttgattaattccaaccatcgcctttgcctcaagttgagatctgactgggtgaaaatatacttcagactcttgtggtcagtgtagatatcgcaatgatttccaatcagataatgtctccaaatctttagcgcatgaaccacagctgcaagttctaggtcatgggtagggtagtttttctcatgtggtcgcaattgtcgcgatgcataggccacaacctttccgtcctgcgtcagtactcctcctagtccttgccttgatgcatcacaatatataacaaagtctttcctgatgtcagcaagaactaaaataggcgcagaggtcaacttttctttgagctgctcaaagctttcctgacactgttctgaccacacaaacttcttttccttcttgagtagttgtgtcattggtcgggctatcttagagaatccttgaatgaaccttcggtagtatccggccaaacctagaaaactccgaatctcagtcacagatttgggtgccttccattccgtaacggcctcaactttagcaggatccactgctactccaccggctgagattacgtggcctagaaaagcgacttcttttatccagaactcacatttactaaactttgcatataatttatgcttccgaagttcctcgagtaccaatcgcaagtgttccgcatgttcttcctcatctttggagtaaattaaaatatcatcgatgaatactaccacaaatttgtccaagtaatccatgaacactttgttcatgagattcataaagtatgccggggcattggttaaaccaaacgacattacggtgaacacatacaatccatatcttgttgagaacgcggttttgggtatatccctagtcctaattttcaattggtggtatcctgatcgaaggtcaatcttagagaacaccttaggtcctttgagttgatcaaaaagatcatcaatccgtggtagtggatacttgtttttgatagttacttcgttcagtgagcggtagtccacacacattttcatgctaccatctttcttcttgacgaatagcactggggctccccaaggtgacgaaccggggcgtacaaatcccttttcttgcaactctctgatttgctttttaagttcctccaactcattgactggcatccgataaggtctcttggatatgggagcagtactgggtatcagatcaataatgaactctatgtcacgatctggtggcatcctaggtaaatcttctggaaacacatcgggaaatcgttgcactacaggcattcctttcaggggtagcatggtaaatatgcctccggcacgttcggttagtctaggatcttgatccatagttgctctcatatccgatccccagggtgtggtcagggtaacttccctacgtctacagtcgattacccctctgttctttgttaaccaatccataatcaatatgacatctagggtctggggtatcaaaaccataaggttggagggaaacaccacatccctaagatgaataggtacgtctatgcaagcatgactcacaattatctcgcccccaggtgagtgtactatcataggttttctaagtcccactagggttaagttgtgcttttgactagccttcaaagatatgaatgaatgcgatgcaccagaatcgaagaggactttaaccgggacagaattgatagagaacatacccattagtacgccctgatcttcctgggcctcttcagctcgaacatggttcacttgtccgcgtccaaatccgatagtggtcctattagtttgcggagtcttgaatagacctcgtccggcagcaggggtagtagttccacgaacagtcattgcattagcaccagtacggacaggagttttgcgtggatgagggcagttgttggtgtagtgcccatactccccgcaattgaagcagtccacattcttcttggctccaggggcagccagagttggcgtaggggtgcggttctaaatcgcaaccagcctgttgaaattgctaggtgcggcggggcggttggtcgccacaatagggggtttccacccagacgaagtggctcccttgagtcgctgaagcaatccctgaggtgggcgattcatagcaagcctcctcttgcggttgtgctctacagtcctttgatcgttctccagcctaacgaccttgttgattaggctctggaaactctcatgatcttgcccaatcataggtccacgcaactcatcattcagcccttctatgaacttgtcgatcttttcttcttcatctgcgaggtctccaattgcatagcgggcaacctgagtgaatcggttcagatattcctgcaccgttgtgttcccttgtcgcagccttctaaactcgttcttcttcatacgcattaccgcagcaggcacgaagttctcgtggaatgctgcagtgaactcttcccaagtgggttctccagcatcctcttcccgagcttccttgtaagtatcccaccaatcaccagcgggtccctccagttggtttactacgaagatcactttgtcggcttcgcgtacccggacaagggtcagtttcttctctatgatacgtagccaatcttctgcctccataggctcgtctgccatagcgaacgtgggtggcttggtcctcataaactctccaaagctcgatcctccgcggttgctttggttgtttgcaatggcttgcagaagttgggtttgagtagccataactccggccagggtggttaggtcaggtgtctgagtttcttcattgatggttgacgcccgacgtcggctggccatctgtgtaggccgataaagtaagtatcctaattttctaactagctcttatggttttatcccattaagggaattgttttgatgtgaactttgttttgcaagcatggtggaataaactcatttataacacaatagcaataatatcataaataacatcacagaggtccacaaatagtacataaatcatgatgcaattgactgcacacatacgcagtccaaataaggttcgtccaaaagatacatcaactaaccatcaagctactcgtcaatctaggtaagaaaaagggggtgtgtgtgtctcgcatactatccaaaaaccatctgaagcgagatcgaagctgcaataatcctccagtctagtcatccaaccatccgcaggatcctggggcaggtagagggtagtcgctggcacgggcaaacctgagtccccacggctcggaaatagtggcctctggatctggcttgggcttcttgcccgagggtcgggtgctcttgcaggcagtgctaagggtgcgagggcctcggaggaacgtgatgcagggaacgggggtctcatcctatgaaggatcagtgatgtctggctcgatctctggcttggtatcggtcccctctatctcagagtcgacctagatcggagtctccaaactggaacccagctgcggagaaggtgtagagatcagtggagtgtgcacaatctccggcgcaggtggctgtgtcactgtcgggtccaccaagtaaggagctgactcaatagccagcataccaacctctcccaaaagagcgtggaatgctggtgggtacggcgaggtgaggaaaaagtagcggtcatgccctactgctgtggaagtagaagcccctgtggtgctgaccgtggctgctcaaagctgctcctccagctggctgacgtgctcctgactctctctcagctgctcctcaagtgtatccatcatcccgcggcgatcgttgtactgggcagataactgctggaactagtcgccgtggacctggagctgtgccttcagtgagtctatctcactgccccaagcctggtgctcctcttccagctgaagctgctgcgctgtgaggtcagtcacctcggtctctaactctcccacacgcctctgctggtcgtcgatctctaacaaagcctcctcgtaaaagtcgtctactgcctcagcccatcgtgacaatcgggtcactatcgggttgtagcagcaaggtgtgtcctgaactgtgcagaaggagttgctctcctctcgaaacgggtggtgagcaaactcagtactcgccaactcagctaggtggatagagctaagtcggaggaaggcctcccgtgctgcgtcctgcatcgcggtctccagtaagtcgcgacggtggcgtgtcgggaagctgtagtctaactccgaaggaactcgcgtgtgaacctcgacccgaacctcctaaacagatccacactgtctcactcggtagatcggaaatctggggtatcgcagacgcctcatcagccggtgtagctcaatgacgtatccctctaagcggggtacgcccatctcccaggtagcgggtgaatcctaatctgccatctaattttaagaaaaacccaaggtcagctgagagtaaatcttgtttagtgaagaaaatagttaagattaagatgaaaatcgtaccgagttttgtaaacatagtgtttttatttttgaaagtattattaaatgggaatttctcccttggccaacttagaaaaggggtggggcgcctttttggtcttttcctacagtcgtatggctctgataccagctttgtggacccccgtttttataacaggaatcaatcatgtaaatagtaccatttccctggaacaagtagtctggtacacacgaattcatagctgaaataccaagtgcacatacacgagtgtctagtacgaattattacatcataagcccgcaggcatagtcttaaatcatcggaccgagcggtccggaatacattccaaaaacagaagtaggtaaggcagcggagtcaaggcagcggcacgccattgccacaggcaacgaccgtaactaagacctactgagcgccatcgtcttcatcaccctcctggtagtaagcgtagggatcctccgaagcttcatctccgacctctgattaagtttgtatattgcaagggtgagtaccaaccgtactcagcaagccaccacagcaacaatgtatatgacaggggtatttaaaggatggctatggttcttttgcgcaaagcaagttttgtaattcttttcacaagcctaagacctagcacagactgatcaaattttagtagtagtgttcatattaaacaatgacggtattgtccactatccattgtgatcccaaggatagcttcccgccattgagtcgtcatggttttctgaggacgtccacattcccgcctctcaggaagtggctccatcaatatagaaatcatcatgcaatatcccatcccacacaagttaagaatttagagtctagccaagtgtaatacatgtcccggtgctcaataaccgcgagcacggctattcaaatagattaggtttactcacactgtagtggatgtacactttacccgcactccgcgactgcccaacacatgagcctcgtcccaacacatgagacgcgtcacggcaaagcttttcggtaacctcgcattggcagtacccgctccatgaactttacatcctcatgcactctaggcgtacatggtttctagcagtgagagcagttctggcgcacccgggaagggaagactcacacatgcattaagttataattatgtttaaattctctgggctgcaggaat

SEQ ID NO: 32325 - DNA, 1730 bp, Oryza sativa
cattatacaacaaaaatttaaaagaactagtgtcctgcaacaatgaagatcattttcgtctttgctctccttgctattgctgcatgcagcgccacagcgcagtttgatgttttaggtcaaaatattaggcaatatcaggtgcagtcgcctctcctgctacagcaacaggtgcttagcctatataatgagttcgtaaggcagcagtatagcattgcggcaagccccttcttgcaatcagctgtgtttcaactgagaaacaaccaagtcttgcaacagctcaggctggtggcgcaacaatctcactaccaggacattaacgttgtccaggccatagcgcagcagctacacctccagcagtttggcgatctctacattgaccggaatctggctcaagcgcaagcactgttggcttttaacttgccatctacatatggtatctaccctaggtactatagtgcaccgggtagtattaccacccttggcggtgtcttgtactgaattttcacaatattgtagttcggaagtgaaaatataagctcaggtatcatcgtatgtgacatgtgaaacttgaggtgatataaatagaaataaaattatctttcatatttaaatagcttgcctctataaggatatatcctagtgcattgtcgtagctaattaccatgattggtactccacaatttttctgtgcgcttaaatttgattcgaagctacttcgtattttagatataaatggagtgtataaaggatgtccatcattttattccaataagaacaaacacaaaaaacatatgacaaatactaaatccaccacaacaaaatcgtataccatacagaccacgtaaagatgcagcaatcaactttgattctccatccactactaaaacaagcgtatatcaaaggccgcatatgcaacatcattgtgaatatgacaagccaatgtcatgcaaacacgtaacttaatgcaactatgttgtgtcaagcgacatcaagacgggttttcaaaattttaaactttggtacattaacaagtttcatatatagatattaattttaattgaaaatcatctagttgtccatcattcttgacaaaaggaagtgtataataaattcttgagttgagctctcgctcaatttgcatcatggaacaacaacgtaggcataattatttctgtacagaagcaaaacatgcagcggcaacaatgggggtgaaaaccggaaagacggatttgtgatgttctttggtttattctgtcactgtagagtgactataaagaaaatgcacccttcttccaaattcaaaattatgagatgtcgtacttaaggaatgctccaagacattgaggttgttcttgctgacaaactcgttgctttgagtagtttattctagcattgaaagtagatagtctcactgtaaacaaaatggataataaacctcatgtttcagcaaaattataatggtgatctctcgtaaatatctcgaatggtgatattagacttcagtgctaacttaattcttcctacaatcaaatcttcattaccacatcaaagaaacaatacaatgcacctgccgtactataattttgtcattcctgttgaaattttataattcaagatgcatgaggccgcacgaccttaaagttcaacgtggcatgcagtagtgaaataatagcttggtaaacatgataaacatacctagataacagattcaatcctcacgaaacaaacgc

SEQ ID NO: 32326 - DNA, 12480 bp, Oryza sativa
ggatgaatcttgatgggagtccgatggatctcgatgcatggatgtcgatcgcctagcgccgtctattgggtggctgcctgtaccctcgccggcgtacccttccgccgaggcctctgtgtgttccctcatgtgatctatgtatgagtggatggatcgatctcttcttgtggttctacatccatgttcctcctccatgatcaatctgcaaaacgaaagagaaacaaagaaaaggacggagctgtactcgccgccggtgtgctggtgtagatgagaccatgtccgtgtactgcttctctcctcctcattctgcccacagccgccggctggcgcgccgtgtcttctcaccgggcagagggatggctggacgaatgtcgatcgcctggcgccgtctcttggcagagcgcctgttggctgccgccggccgtcagcgcacgcgttggcgtgcccttctgctttgtgttcttgttctacatatgtgtggatggatggatgtgtgttttatgaatgattctccatgccctggctggttagctctcgttggcttttataagcgctgggaaaacttaacggacgggcgcgcatactccggcgccgacgtggctgcacgtgtttgttccgatacctccgggcgacgttgctgcagatcacgctaattcgaatcacctggataagacgaagtttgttggttgggtttatccggcgctagccgcgcacatcagtagcttgcagttgagaaatcccgcgtacgcatgtattctgatacaatcgcatatatacgatgaaaacgcaatgtgtctatgggctgccggcccacgtgcagcttcacatttcaaccgtgtagctagatgttgcttcttaactcatagaaaccacccggtatttctgtacgtatacatgcacgtacggtgaatacatatatagtcacgagcgctcgtttatgagctgctcacatgtcacttaggtctccttgtgcatgcatgcttacgtatagattagctaagcatgtatatatggctgaacacatgtacccatgtatagccatataggaggacatacatatgccagtacgtgcatggctcatgcatcccatgcaattgagcaagctatatacagagtcacatattaatgaatgcgacgatcatagctgctcttttgtttgcttgtcttgataatacaaataatccttggatttataagatcacaaaataccgtcaaacaaatgccccccagcaagtggagtttgcgcaagagaaacgcggtgtgaactcgacttggtgaaccctattttcctaaaattcggctcaattttgcactgctgcctcatcttgattatttaatatagaagggaataaaagaatttagtcccattgaatttagtcccactactaaaacaagcgtatatcaaaggccgcatatgcagcatcattgtgaatatgacaagccaatgtcatgcaaacacatcacttcatgcaactatgttgtttcaagcgacatcaaaacgggttttcaaaattttaaacattggtacattaacaagtttcatatatagatattaatttgaattgaaaatcatctagttgtccatcattcttgacaaaaggaagtgtataataaattcttgagttgagctctcgctcaatttgcatcatggaacaacaacgtaggcataattatttctgtacagaagcaaaacatgcagcggcaacaatgggggtgaaaaccgaaaagacagatttgtgatgttcttttggtttattctgtcactgtagagtgactataaagaaaatgcacccttcttccaaattcaaaattatgtgatgtcgtacttaaggaatgctccaagacattgaggttgttcttgctgacaaactctttgctttgagtagtttattctagcattgaaagtagatagtctcactgcaaacaaaatggataataaacctcatgtttcagcaaaattatattggtgatctctcgtaaatatctcgaatggtgattttaggcttcagcgctaacttaattcttcctacaatcaaatcttcactaccgcatcaacgaaacaataaaatgcacctgccgtactataattttgtcattcctgttgaaattttataattcaagatgcatgaggccgcgcgaccttaaagttcaacgtggcatgcagtagtgaaaaaatagcttagtaaacgtgataaacatccctagataaaagattcaatcctcacgaaacaaacgcataaggtgagcgatgagtcatatcgttatctttcttgcctgctaaccatcatgatggacagaaaagttactttcatgatgacaccaaagcggatttgttggggcacctaatagaacatacatccaaatgacatgactcacttagatcctaataggacatccaagcaaaactaacacactaaagcaaccgatgaggaatcgaaagaaaatccgtgccagcgcatctataaatggacaaactccatgaaaaccctcctcatcgctcgcacaattcaagcattatacaacaaaaatttaaaagaactagtgtcctgcaacaatgaagatcattttcgtctttgctctccttgctattgctgcatgcagcgccactgcgcagtttgatgttttaggtcaaaatattaggcaatatcaggtgcagtcgcctctcctgctacagcaacaggtgcttagcccatataatgagttcgtaaggcagcagtatagcattgcggcaagcaccttcttgcaatcagctgcgtttcaactgagaaacaaccaagtcttgcaacagctcaggctggtggcgcaacaatctcactaccaggacattaacgttgtccaggccatagcgcaccagctacacctccagcagtttggcaatctctacattgaccggaatctggctcaagctcaagcactgttggcttttaacttgccatctacatatggtatctacccttggtcctatagtgcacctggtagcattaccacccttggcggtgtcttgtactgaattttcacaatattgtagttcggaagtgaaaatataagctcaggtatcatcgtatgtgacatgtgaaacttgaggtgatataaatagaaataaaattatctttcatatttaaatagcttgcctctataaggatatatcctagtgcattgtcgtagctaattaccatgattggtactccacaattttactgtgcgcttaaatttgattcgaagctacttcgtattttagatataaatggagtgtataaaggatgtccatcattttattccaataagaacaaacaaaaagcacatatgaaaaatactaaatccaccacaacaaaatcgtataccatacagaccacgtaaagatgcagcaatcaactttgattctccatccacgactaaaacaagcgtatatcaaaggccgcatatgcagcatcattgtgaatatgacaagccaatgtcatggaaacacgttacttcatgcaactatgttgtttcaagcgacatcaagacgggttttcaaaattttaaactttggtacattaacaagtttcatatatagttattaatttcaattgaaaatcatctagtcactactagaaaattgatttttcaagacgttgctctattattttcactggcggaaaaatatgaaaaccgccagcaaacttgtaacgagggggtgaggggcaccgaccgccagcaaaaatgcattttcgctggtggcccatctaatgcggccgccagcgaaaatatgtctatttttgctggcggtcaattaggtgcaccgccagcaaaaatagttaattttcgttggcggtccaatttttcatggcgaccaataaatagaaccgccagtggaaatccaaccaaaagtatctgtcacattaaaacacccacctacccatcctcatcctcttctccacattaaaacaccacacatcccctcctcttcttatccactcctcttctctctcctccctctcctccttcccagcctctccacctgcgacggaggcgacggctctggcggcgacgaccggcgacggcggtggcggctctagaggcgacgaccagcgatggcagcggcggcggctctggcggcgacgaccggcggttccccgcgtcgcccctgccctcccatcccctcctctcccatctgtccgaggggaggaggccgccgccggtggcacaacataggcggcgacggggaggacgtgcagatctgccccggcggtggtgcggggagcacgcagcgcgggaggcggcggctcgtccccggcggcggatggcggcggctcgtccccgtcagcggatggcggcggctcgtccccgtcgacggcggcggctcgtccccggaagcggatggcggcgacaacagcggctcgtccccggcagcggagctgacgacgacgaccgtgaccgtggcgacgacgatgaccgcgacgctgccggcaagcgtgtttttgtgtgttttggttccgtgaccggcagatggcagcggcggtggctcgtcccgatggcttcggcgactagggttctctgtgcttttgtgtgtgttttggtttgtaaggatgtttgttaggttaatctgtgtttgttctgttgatgatgtcaatgttgtatttggattgatgccaatattatgtacatatttgtgatgctctggatttggattgtgtttgaatgatgtttatgtccattttcaaatatggattgttttgaatttggccgagtggggaattttgaatttggggtagggaatttttggcggggtgggttgattttcactggcggttctctttaagcaaccgccagagaaaatgggttttcgcaagcgacactcaactgctagcaaaaatcgtttgtccacttgcgaaaatcgattttcgcaagcggaccgaaaccgttagtgaaaatcgtgtgtccgcttgtgaaaatagattttcgcaagcggaacataaccgccagcgaaaatattagatcttcactggcctttgctttgtggcggctccaaattccgccagcgaaaatctaaaatggccgccacgaaagatggttttcgtagtagtgagttgtccatcattcttgacaaaaggaagtgtataataaattattgagttgagctctcgctcaatttgcatcatggaacaacaacgtacgcataattatttctgtacataagcaaaacatgcagcgccaacaatgggggtgaaaatcggaaagacggatttgtgatgttctttagtttattcagtcactgtagagtgcctataaagaaaatgcacgcttcttccaaattaacaatgggggtgaaaatcggaaagacggatttgtgatgttctttagtttattcagtcactgtagagtgcctataaagaaaatgcacgcttcttccaaattataaattatgagatgtcgtacttaaggaatgctccaagacattgaggttgttcatgttgacaaactcgttgctttgagtagtttattctagcattgaaagtagatagtctcactgcaaacaaaatggataataaacctcatgtttcaaaagtttattccgacaccgaggctgcaaggttggatttggttgagtttgtgattttgattttcttgaggttctggtacttgctatacttctacttgagtgtcaaacttgtgccattctatcctttgttttttgtcaaaatatgtccaaatttctggcaaaattatgtcaaattttgaaacaacattttatccatagtctgtcaaaattgtcatacttgtcagagtttataaaaattgcaagctgcatgtacaaatggaagcaaatacacaattgataaaaaaacagtgtgaaatgtgtaatagtagggaagggtatggatgtctttttgccaaagatttaatatcgtcaacatgtccatccaaaatagttttaaattttagcttcgtttcaaaaataaagggggcaaaaaccataaggactttaactagcaagttctaggaagtaatcatcatcaccgtgtgatagacgaaccggtaatgacgaaatccccattgtttgcgattatcttttgtcatgggtacatatcttatcaccaagacctcctattgtcgctaagatggaccgttagagaatttaatgttgattttatcacgaattcgttacatattaatgaagtcgtcacagggaatcgtcaaaaagcctatatctgttgtagtgcatgcaactagcgagaggacaagctttttgggtatactatgtgatacctcaggatttgttatgagatacatggatgaaaatatgttaaatattatagaaattataaatattaaaatactataaaaaatgatgtgaggatgatcatttaacatacttatatgctaaaccctatgcatcagtacattaaaatacttatgtgaagatcatttaacatacttatatgctaaaccctacgcatcatttaacatcattatatgcttctatctttggcaggacagatatacaagtacagtgatatcgttatttaaatggatgtaattttgtggttcacatggtatatattttactacacatcatcttctaccctataattcaccaactacactcctgtacaatcctcattcatcaaatccgacgatccagaatcatcgaatccaacggctcgagattgtcccacgtctcccctccgtatgcacccctctcccctctctctctctctctctcttgcacaccctcctctcggtcgctcccctcaaccatagccgcctcctcgatccatgccgccgccgcctcgagccacgccaccgccggcgtcaatcatctgcgactccgcgtgaccgcctatgatccaggcaacggagatcctcctcggctcctcgcgccccgacggctgatacactgcggtccgcgcgtcaggcgaagttgggagaggatatcctctgaggggacattggcggcggtgatcctgcacgcttgtacgaatgacttcacagctagaatgactgacgaccacgtccggccaccgtgtacggatgacttcacaccttgaatggatctgctgctgcggtgctgcccaaacaccttgaatagggtgtgtttggtttggggaccaagtgggatgggttagacccatcccagttttttgggatgggatggttccagttgtgtgtttggtttatggtatgaaatggttatagttttttgtttggtagaagggattgaggagggatgggatggacaatttttcacggatgttagggccgtctgctcccagtggctagcttccaggctgccggtgagattagggacgaaggagctcgtcggcgcgagttgaggagctcgtcggcgcgagcggaggaactcgtcggcgcgagcggaggagaggcggaggcgggtcgcggacgagtggcgacggtcgcgaaggtggcggcaggcgcggacgagcggcggcggtcgcggagacgaggcgagcgtggatgagcggcggtggttggtcgcggacgaggcggcggttggtcgcgaaggcggaggtcggacacggacgaggcggcggcggtcgcagaggcggaggtcggacgcggacgaggcggcggcagtcgtggatgtggcatgggcggtcgcggaggtggagggagcaggcggaggaggacagagcggcgccggaggagggagcaagcggaggagggacaggccgcggtcgcggaaaagcagcggccggtcccagaggcgaggcgaggcgcgggcgagcggcggccggtcccggaggcgaggtgaggcgcggacgaacggcggcggtcggtcgcggacaaggcggcggccggtcgcgaaggcgaaggtcggacacggacaaggcggcggcggtcgcggacgagcggcggcggttgcgcggaggaggacggagcggcgctggtggagggagcaggcggaggagggacgagcggctgtggcggcgccgcggcggagccgagcgggaggctgcgggagttgacaccgttctctccgtcgaagtgggatggattggtccggccgattttggtggaccatttcgtcccggatctgagaggaatattcctctccagggaccatcccatcccactcacctctcaaccaaacacccctaaaagtgggttcatcccatccttgcaaccaaacactacctatattgccaggtaacgaatgatttacgcgtcgacattgtccatgtggacatgctgcagtcgaattaatgtagcaacacagagacccagaacagacattgctctgctatatatcctcctgaataggttactgtattagccctttgcactgtacatgcttgtgaaaatgcgcataagcattgtagtaatagatggaattttggtgcacctatcactctgttaagtaatagatggaacttttctgatctgagagttaagttgatttagtttgtgtactttctttctactttggacttttaggcaaaagagaactgtgttaagctgtgtatgtgtcctatatgattttgactgcttattcattcaaaatatccatgttacttgaaacagaaatctgcatgggattagtgatgtttgttgacgtacttctaatattttactctagaaaagtgaagcatacaagaaaatcttactgtttagtaagaattttctgatttgtgctttggtgtatgctgcaatgtaacatatatgcagagagcggaagtcttttattttctctatcacctgatcttttatgttagctacagttctatatatttttttgttggttaggagttgaaagaatgacaacagtgatcgatcatactaggaaatacaaaaatagattaacatggaaacgttgttcatgtgggcatttcattccactgcatgggatggacaactgtttggcctcctctgctgctgttgctatgctgagtttgcgattcatctgctcttggtgcctcaattcctcatgaaccaatttgtctaacaattttgaaatgttgttcaattgatagatcctcctgcaccttcatgtagtatgctcaggacaatttgagattgactactgatcatttttaggaaatagttttgtcattacagatttctgggtagatttgaatatcataaagtgactgtaattactacttgcctaccttttctttgacggataagccaaaacctgatcttggaaaggattcatttagtctttgtgcatccattttcttattatttagtcaatccgcgtcgccaaggaatcatgaccgctgcgagatgaaaattttcattatgtatataagagtagcaaagagaacttggatttgaacgctggtgttatacttctcttgatctggcagttttttatttcttaaaattaatctcattttatatattgtcttttggttgcttaatataaatattaccgtagcgttagtacgggcatgctactagtcagtatataagtaggcttgctatgcctttctaaaataggtacataagttgtttaaaaattacgaagaccccatctcttatagtacctctaattacactggaacttatgcacaccttgaagcaatcttactaactggacacacattcagactagtgtgtttagcagcaagaagttcaagtgcctcccgcatatcaagatccttgtgcaacattccatttggcaacttccaatcgaaatgataaagaaggttagccaaggcaagctctatgttggccagcccaagatttatgccgggacatatcctgcgtctagagccaaatggaagaaactcaaagttattccctttgaattatatattgttggtttcgaacctctctggcatgaattctttggcattctcccaatacttactatccctgcaaattgcccacatattcacaaatattgatgtacccttaggtacatcataacccatgatcttgcttgtctcatggcattttcgagggatcaagaagggcgccgggcaatgtagtctcaaggactcctttatcaccatcttgaaatagctcaattttccaatatcgtcttcagtgatagtgctctttccttgaaaggcttgacgtagcttagcttgtaccttcgccatcactctcagcgacctgatgagctttgccatggtccgggtcagtgttgttgacgatgtatcgctgccacccgcaaaaatgttctgaaatgatatatttttgtaattaattattattcacctgaatttttttatctatttttgcctaaacttgtataataggcatacacatatatgctacacttaactctatttttttcgttactatatactccttccatctatttttgatagtcatatttccaaatctaaaaaataaaatttttgataggcatatttcaatccaacaacctatcaatcttaatgactttctcggatttaatgtgtaactctccattcttccacacaagattgtctgcatgagcatcgagaaatgtaaatattaatgaatcgcttgtttacgaggaatgactagtactatgtttaaatagatgataagtagaattacttatctttggtctgtgtgccaagatgaaatatgactatcaaaagtagatggagggagtatattttcttgtgtaaactttgcttagttcatctcataggaggttttatcccttacttaagactattttttttatctaaaacattatggttttgtatcctaaagatacagaggccaggatgataggatgatagaacttcctgattcttttttaaagaaaaggtttactaatgtttctatatatattttgtagatgtaggttctccgcccatgggcataaccaaggatcgatattgagccagctcggctctgtgcggtttggctcagtaggataataccatacgctttgctgcttaatatatggattaatatatggatgaatacctgttatatattttagaaataataaatgtatatattcaaataatgtgaaaatgatgcagagagtatgatctgacattacttgcatatcaatttctaaacatacaataaaatcataataattattagtggatgatgatgtggtatatttacatgtgatttaaattactttaaataataattgctagtgagtgatgatgtgagacacttatatgattagtttcagtagttagtgcgcattaactttataagtaaaataagacgagctggctcgacacggcacattatccggacaaggcttaagctagtttagctcgcgagttggggggagtagtgggattaagttggctggcgctggagttaagatcgacttggagatggtgaagcagagccgcttggtggcatggagctggagttatatggacattactggcctggcccaccactctgctttaattatctcctgataggctgataccaatgcttgttttcttcgctctattatttgtgccgctaatccatttccctgaattggcctcctgggctgtcttttttatccatatatgcataatataataattactactctctcctttcaaagtccaagtcatatttattttctcaccaagatcaaagatatagttaacccattcatcatacgataaaaccaatgaatatataatcaataagtactaagatgactttttggttttgatcaaaaatttattaattaagttacgtagtgattataaatagaatttagacttttaaaaaaaccaaaaagtaaaatagaaattagatttttggaaggagtgagtacagttacgtgaggcttgcgtaccatcaaaagcacgacgataacttggtttgtaattggaattggcgggccgccttccttctggagcctgagcaggtcgtccagagagcatgacttgctctccaccgccgccgcctgatcgccgccggtgtccgtctccatttggtccttgcgttcctggatgatctgctctatgatgcgctccatcttcttgcggttcgccagcgcgctccgcggccccatcgcgaccatggacgccagcttcgacaacgggaagaggtcggcgatgctgagcccggatgtctggcgtaccatggcgtgcagggcggccaggtactcttcccggtgcctgcaccggctccccacggagcaccggagcacgatgtcgttgatgagcctggctcccatcccggtgaggttcacggcggcacccgatgcggcggcggccgacacgtcgcgcacgagccgcgccacctccacctcgcggacgcgccggaacgagcgcacccgcgccgcggtcaggagctcctgcgtgagcagcttgcgggagctggcgccaccgctcgccgtatggggccggcacgacgtccctgccgccgaagctgaacgcctcggtggcgctggtcaggtggcggtcggcgaacgccaggtcctttctccggaggacctcctgcgcggcctccggcgacgaggcgaccaccgtgggcacctcgccgaaccagatctgcatgacggggccgtgcgccctggccagcttccgcatcacgccgtgcacgctctcgctc

SEQ ID NO: 32327 - DNA, 3838 bp, Oryza sativa
attcctgcagcccacattaatacaacaaaacgtcaaacctgcatccagaaatgaacaatgtaccagacacttctcatagttcaaaataattttttaggcaaaaaattattatttaaagcttgcaagactggtaaatatttattattcttagtaaataatagtaactactccttcctatatggaaaggcaaaaaaaaaaaagatgtaaaggagcttcagcgcatataggggatggatgtaggtacaagagacgggtagagggtttgcttttttattccgttttccaccgctggctgtaggattttgagctgcagccgagatcagctgggttggacagctacggcccaaaatgccacaacaatcagaaccgatcaaccttacatacacctatcaagaattttttatacaactaaatcccattgttgttttgatatggacttcaagaatataaagtatgcccccaataaccacaaactgaacaatgcgctatcagctatggtagtcaggaactagtagtggttccattgacctctaccattggctagatacacaactttgggggtagcctgcagtgtctatagaaggaacattgattactaggaaaacactgtagtgagaacatcttcgatcctgatgcatcctaaccctaacgttcatcggtaaccaggctaataatttgtgcataaagttagatgattattatcagtacatgtaaaaattgaactagctgtttttaatctgacatgaacaggagacagggcattgtgcgtggttggataaatcgacacttttgcacaaccttctgtgcagttctgatcgaccccttatcttcatctgatatatatatatatatatatatatatatatatatatatactatatggcagccttttcttttttactacactattaattgactctcggtatgcaagcagagtactagcatcatcaagcagggtatactggtactcacaggagtaaactccaactttcctgtaagtattttctttgaatatatatgtcatatcttttcaagatgacaagaagggaaaaattagacaaaataatggagaaatggaggaaatttgatggcagtagcatgttcttggaccatggagcaacttaacggtacaaattcgacgattttttttcactccaatgaactaactaacctgacttgccgggaagaaacatttaacttttcacctttttcaccttttcagagatcagtcctctatgtcacagtgctacaataggtccacatatcgaactatccaatatgtaaaccagaaataaatctatcggtccttacaaattctgattcttcaaaggtcacaaaaacaccacaatatatatctagcgagttcgatctatgtcaccactcaccagtgctaggcatagaaaaagggaagcaatttgtagatctaattaacagatcattacaatgctaacaagaaaaagaaagtaattcattaaaacggtgcaagcgatcaatcaactttttcttcaggtccttccttttgcttcaaatacactgcactacgaaatgattaagaaggaaaattacttagcaaattacccgcagaagctcatgaaaggccgtgacatacctgaccactcccaacttgctttagttccaatgcttaagaagggggcatcaaaagaccaaaacaacgctacgaagctggttgatctctcatgacaagcagtttatcgacattaccatcttgcgaagaagacatggtgccatagcattgatacttgagctgcaaaagcttggttcccggtgcctcctacacctaacaggttacaggttcactaaaacagcctacttgattgacctctaggtgtttcttgctgtgtgagagacgtctgagtgtattaaggaaataggatgcctttggttgtaccctccatgttgtccatatatatagaagggtacactttaaggcggaaaagctacaaatatgttgacatttttttttctatatatatatatctttcgatttttggtccattggttttgtcctaagatttgcgctagttgtctagagaaacaaaacacagtgcttacactatagttacatttcaaagatttttttaaaaaacctatcgcctgatttttagatagtactcaatcaaggacctttaattgccttgaatcttcgctttaacatgtataggttgcttttctgggagcattttctcctatgtggccgtaaatgatgtggtttggtggctacactcttgtcattcatacccgttggattgtttaattatgtgaaggctcgatcttggaacaaatcttcattgtagtaccgggcttcattttatattgtcaggaatgcatgctgtggaacatcggcatcaatatatagaattatctgagatgcaaatcactgaaacaatatcagtccgacagcatcaatggttcgcgcgagggtttgacgacttagccaagcgttagcgaagcgtcattctcatagcgaggcgcttcgagttagcgaagcgagtgctaattgggcttcgaggttggctatacgccaaaaaaaactacttttcccggccctggcataaacctagcttctttgaaacaacataggttcacgtaactagctattaaatacgtatatcttttcagtctctaaacaccatcagtgccaacaagctacattcataactttattattaaggcagatgatcgtacgaagcctaaacatcgtaacaaaaaaaaccgtgtttgttatgataaaagatctgatagtagtatttggaaagggatctagcagccaacctatagccagtgaagatggccacacggtgatgttgaagaagaagtctatttttttgggagttaccctattcggaagtcttagacatccgccaagcaattgacgtgatgcatctaactaaggagaaaggaagccattacttgagtcaaaccagctacactctgagcaaggcagagaaggaaagtatgttgaatgctcgaacaacatcaaggtaccgtctagatactctttgaatatgaagggaataataagcatgaaggaaaagaagatcacaaacctaaagtctcatgactgtcacatgtcgatgacaaagctgcttcctgtgatatctcggggtatctttcctgataatgtccggacaataataacaaagcaatgtgcattcctgaatgcaacttcgcagaacattatcgatccagacagattgacaacccttcaaaatgacgtggtgcaatgtctcgttagctttaagatgatcttttcaccatccttcttcaatataatggcgcatcttctatgtcatcttgtcaaagagatcggtattttcggtcctgtatacctacacaaaatgttcactttcgagaggtacatgggcgttctaaagaagtacattcataaccgttctcgtccgcaagcaaccatcgccaagggtatgtaacaaaggaggtcattgagttatgcgtataatttattgaagaccttcgtctaattggggtccccgaatcaagccatgaggggagactacggggaaaggggactcttggaaggaaaacattaatgattgtacaacgatttattctgtaaatcacattttatggttttgcaacaattttcgttggtggctccttacatcgaggagcacttggcagttcttcactccaaaaacataggtatgtccgatgtccagattacacgccatcacattgatatttttcccgcttgattgcgacaacatctcatgagtaacgagacgattgaccaacaactacccttttggcgagggtaccatcttcctcgatctcgacattttaaggatatgagatcgat

SEQ ID NO: 32328 - DNA, 2743 bp, Oryza sativa
ataacaaataagatgcccgtgcatctgtgcaaaattcatttccgatttatattcccaaaatgttctccggtttatattatatcgttatagtgtttgaaacacaacctataatacatgcccgcacgaatgtgcgggcttcgtaccttcctagttaatcttaattagctaatcaagtcaactagcgatcgcattggcattagaaaagcttgtcttctcggcaatcatgctgttcgaactcgacaccgtgatggtggctaaggcgacgtcggcgagtagtgccgcatggggaaggccgtgttccggtcggcgccgtccctactatattgacgtaatcagtcgttgattttctattgaaaaaccattataagtaagtcgtaaatcgaatataatttcatgggttatacatggcattaaaggatgagtgttcttggttatacatggcattgaaggataagtgttcttgggatttcatatttcattgttcgattaattagatcaatagaagtttgataaaaaaaaaacaatctgccaagagtactcatccacatactaatataaatttttaaccaggttttatggattttgatcaactagcaatcactttgtattgtataaactctatgtacgccattctctatatttaaacgatggcaacgatgattcggtattggaatgattacttcattattgatatatatgtgtgtgtgtgtgtgtgtgaactttctgcaatgctgaataactttgttaagattaccaatattagaccaaggttcaaaattctgtaacgaaatttccaaaatttcggaagtttcggttctgtcggacaaccctatgatattatttcggtcgaaattttaatttatttttatttttttgtaaatttgataacattttgttcaaatctttttttaccaaatcttgttcaaaatttccgaaatttcagtacatcggcaccctccgatataaacgctgaaagagaaatattgaaccctgtattagactacattaattagcatcctgggttatctataaaatgactttgatttctgacacaccctttctttttcagtggtaataacattgctgaagacaatgatgatccaggtacatctgcttaagttggcttcattgattggggtacatctgcttaagttgggctgagcagtgccttataaaaggaaacttaccattgccatcattatggtgaatgtcatctggtgcgtagtatgctatgccatctattccatttcccgtggtttacacacagcattggcatgtgccaggacaaggtactgtactgctcctactatatctttgatccatattgactctttttcttgatttgttgattgctaattgaagctttattatgctgctgtggtgttgcctgtcaaaattatagtataatttagggtctggatctacattttagtgatttcaacatgcatatttgcttataaaaagatagtatatttaaaataaggaatttaataattggtgaaatcactggtaatttcgtgtcctttgtattttgtttacatgtcaggattttgccaatttcgaatcctttgctaggttcttggatgaggactaaaccatgtttttagaaacacaacattgttccaactgcatataatgctacactttttggcagtttaaaaacaatagggcaatcattattcatgcatttttgaaacaacatggcagtacaggatgccggttgacaatcattggatagatgatgtttggcatgacctatcaatgggggttcttaactgaatattttgggatttgacgctgcttgctggaaggggtgacactgtcactcaccaaaggaactcatggcgatggtcagaattaggcatctacaattctacatggcaaagccagcatacatggcaaggtattgatctgatcagatttgatgcaacctgtttggaagtcaggcccctttgactttgaggtgcaaattaatcttttgcttgtctcctagcttagaatcgcatatggactgttgctgtttataacttagaggctggccatacaattacttttgtcccctacgaatcaaaccttgagacatctcatcatttgttcatgaagagtagattagtttaagccatccagataggaataagcctgtgcttaactgaagtttcttcagcaagccctccttcggcctgttcagtattggaatggtggtgtcacaagacttcatcagaaaagattcaaagaaaaaggctcaggaccctcttcttgctggtctgctggggaatttggacggaacaaaataatagaaacttcgagaaagagggatggtcaattcaacgaattgtcgacaaattctttttgacgagatcaagcagtggaccagctacagagcaaaagggctggtacagttgtttttttgttagattgtaattttatatagcctctggcttttgttctattttattccctcctatcaaaattcgtacaaaagacagtcatacccatgtttacaagtaccgataatgttggttatacttttttttacaattacacaggagatatattttataaattttggttgaataaattatttttgatagatatagtttccaaactttcaatgtactcctacgatatattttatgaaaaacgtgcattgcacgtgcacgattactagttagtaaactagtacacgagactgtatgtcttcccctacagggattcctatttactgcaatggaaaaaatgctgg

SEQ ID NO: 32329 - DNA, 12265 bp, Oryza sativa
attcctgcagcccggaaaatgtgtcacgatatgattcaagataaatggagggggcataagaaattcacttgaaaaaaaaatcaagttgaaatatgatattgactaagcagcattttgatgaacatctctgggagcatcactgatttcagttcttcctccttttataatgttgcaaatccaacaactattttccaacgcaattacaactttttaatgaaaaattagaaaaaaatagatggcatagggatttctcaaatctttacaagcattacctcacaaagcaaagttatctactccagccaaatgacatgtttgaaactgatttattttaatggtctgataacagtgcctatcatcagggcttttgaaactttttacaagagcttagggcacaacacaacattgcaactccataccatccctatacaagtgcagaaacatccaataaacagatcaagaatgttttgaagaaaaccgtccatgagattgggaaagcttggaagcataagctacctgatgctctttgggcatataggatcgtatataagacgcccattggcatgtcatcataccatgtcatctatgggaagacttgccactagcccgttgagctggagcatagggtgcattgggcgatttggacttgtaacatggatttaggacaagctggatgccaccggcagatttagctatcggaaccagaggaatggagagataaagcttatcacaatgccaagatgtacaaggaacaaaccaaaagatggcatgataggagaatgaaatcaaggagtttgaaccaggaaacaaggtcttgatgttcaactcaagggtaaagctcttcgatcgtggaaaactttggagcaaatgactaggaccatataccgtcgtcgacacttcgccacacggagcggtcatgctgcgcgatgatgaaaacaacgttttttaggtaaatggtcactgtttaaaagttttcttagaacccgtagaggggttggggcaggatttagactgttgaattggtagattttaatgcttattttagagaccaacccaaaatagtttcgagtaagatgcgaaggaattttaataagaggtgattaatgagatgagtagaactctaaagtggtcacttatttttggcacaaatcgaaagtggtactaattttgggccggagggagtaattttgattaattaagttgtattgttttgagttattgtgattattgccaaacccatgatttgctatatcatgttccttcgtaacctaggcatagatttaattgtaaaacattgccatagaagtagatagtaccacaaaaccttatatcaacacacttgttttgtctgtcgtcactttggctttatcatgcaagtaatatgtttatcaatatgtatacgatcaaagtcttgaacgattgcgtgtgctttcgggataccatactaatcaaaccctgtatccccaaacatggctcaactagccaagctacgcccgcttggccactaataggtggagttgggcccacttgtcatccccaacgtcatgcaggccatctcagtctttggccaaaaccctagcacagctggccgcccgattcgcctaacaattaacatttttccataaattaattaaggggaatcgatccattgctcttgctcttcaattccaccacttttctcagcacatcaattgcacactatattgaagtgaagaagaggcgtggcatggatgcgccacaacttcttgtctgaaaagggggctatgttagctagatgagaaggcaagatgacaagcctatttggcatatgccactaatcaactgctaatttcccactctttaatgcaataagtaaagtacagaccgacatgtatttttggctggagcaataggatgatagaaaaccaaacatgtctgagatgggctgtccaattggcaggacaaacatacaagtacaatgagcttgttactttataggatgtaatttgattgagcacctgttaacgaccaaatttggtaagatgtgaaccaggttcaacattaggatcgaggcagattcgatgaagagatcgattcgaagaacagagtatgcatcggctgcgaatgtatcggctggagtgtacatcgactgggatggatcggatagaggatagccgatacagccgatggaggtaatgcagccgattacaatgaagacggtttcaaggctgtttctagaattgttcaaagtgcttcatagggattgccacgatggagaaaaagctctcggtttaggcaattgtatttattaattaggatatcttatataatttccttagagatatgtttgggcaaaagtctgccgcaaagacttatggtatcttagagtttgatagagataagtgtagtgtctggcaaggacatattttgtatctcgggtataaatggagcctgaacccatgtaatcaaacaacacacgttcaatacaatctcggcgcatcgccactcttttactttcgtttactttcgacgagttcttgctttcgggttgagctgcatcagttttgatcttcaactagaggtaaagcttgttatgatactctaatcttgtttatgtaattcgtcgagttatcatatatcctatataatctatgacaatattgttatttaaccttcaatcggccaacatctatcattggaaagcaaccgattaggttaaataccaatgttgccttatattatccaccaccctatgaaacattcaacggcttgattgtctagatattttccttcttttcatacttatagctgcatcagttgagtttgatcttataagtcgtgattagaatctcaatctctaacctgcttttggttaccaattagggtagtatcggagtttcagccgatcttacctgatttaactcttttatatctcatatgcttgattgatatgttaaatccgcccttatgttaagatcttgctgcatttaggtatattaagcttcccgtttgatatattttgcttgctttaatatcttaatatagagtgatatcggagtactagccgatacatgctagatctatctgatcggctatgctatgaatgcttataatctccttgttaatatatatttcgatgtaagtgatttatattgtctcggcatggcgaccgatctatcccaatcacttgatttaaatagatatcaacgaaagcattatatactattgatatctacagccgattgaatagatttagtcctttcttgcctatttatgactgacgatcgattcaaatatgacatcggctcaaagataaatgatacatcaccggcgagtggccgatcagctattatttatggatttaaccgctattttgctgtctttatttcttgttgattgctggatcaaatcaactggcacgctcacgaacctaaaggcaagatttttggacctgcactggagttaagcagatctcctaggcctcatgtttttcgcatcaacaacacctaatacatatattattaagcatgagtacataaataagctctctatatgtttccgcttaggcacataagtttttttgtggaatcacgtaaacctaatatctgatagcacatttgttatgttctttttgaagaggcattatttgttacattggcatttatgagcagcttggagcaatgtgagtaactggacatacattcaggctagtgtgtttagcggcaataagtccaggtgcctcccgcatatcaagatccttgtgcaacattccattgggtagcttccagtcaaaatggtagagcaggttagccaatgcaaactccatgttggccagcccaagattaatgccaggacatattctgtgaccagagccaaatggtagaaactcaaagttactccctttgtattctatattgttgttttcgaacctctctggcttaaactcttctgcatcctcccaatacttactatccctgcatattgcccatgcattcacaaatacagatgtacccttgggtacatcataacccatgatcgtgcatgtctcacggcatttgcgaggagccaagagtggtgctggacaatgtagtctcaaggactcctttattaccatcttgagatagctaagttgggcaaggtcatcttcagtgatggtgttctttccttcaaaggcttgacgcacctcggcttgtgccttggccattactctaggggaacgaatgagttctgccatggtccaggtcagtgttgttgacgatgtatcggtgccccccgcaaaaatatcctgcaataatatttttttaaataactatataacatgattatttttcttaattcatttttacataaacttacacaatatggatctacagtacacatagcttaaagataattctatagcccctacccataatcccattttttaagcagacaataataaattggttaagttaattactatcttacagtactgttgtgtatgctttgctcatttgatctcaatagctcatttttttgtactcgtaaacttgtctcatagtcccactgcatgcatgcatacatgttatgcaggacttctttctcttctcttcatgatggttgctctcccgatatgatatccatttaaaaccaattactttgaaagtttcaaatcatttttttctaaattatttatccaattaataatccgatcacaccattttattacttataatttaacatttacaataatatcttacatgattatatttttgacgtaaataattttgtcgacaaaacgggtgttattttaccacatacaaaaaaattgtttcattacttgaagtcaaatatttcaactcacttcataaaatgtttcaaactaatgtaaaatttaaggagtactaactacaacactggcaacaactacttgaacggtgggtcctaactagtgaaacatcaaaggaaataatatatttgcaaggaccacctttgctttgttttgttgaaatatcattatctatactccttataaatgggagtagtagtgatggtgattctaccaccaccccacactaattcccatattttttttaagaaaaaaaaggacatgtgaggttagcaagtgcaacattatgtggtaacaattgaaactactcccatcaactctacttttgtgtggagttaacaaggttcataaacgcaacattatgtggtaactattgaatcatcacatattacttggtgaaacattcatggattaccacgtgcaatatttgcaaatgaactaataaaatataagtaaatactaattgaaacatctaaataagtcagtgtaaaacattaaaaaatatatatgaactattaaagaaaactaaaaaatcacaagaatatatcatctaaaatcttatagtaattaatctacgtgctacaattaattataggatatatagagatgtgtgatgttggcttaccatcaaaagcacaactataacatcatttgtaattggcatcggtgcgccgccttccttctggagcctgagcaggacgtcgagagagcatgacttgctccccgccgccgccgtcacctgatcgccgctcgccatgtccgcttcaatttggtccctccgttcttgaatgatttgctgtatgacgcgctccatcttgttgcgggtctccagcgccctccgtggcgccgtcgcgaccatggacgcgagcttggacgacgggaagaggtcggcgacgctgagcgagaacgtctggcctaccatgtcgtttagcgcagccagatactcatcgctgtacttggaccggctcccgacggagcaccggagcacgatgtcgttgatcagccttgtgatcatctcggtgaggttcacggccgtgccgggcgctgcagcggcggcggccgacacgtcgcgcacgagccgcgccacctcctcctcgcggatgcgctggaacgagcgcacccgcgccgcggtgagcagctcctgcgtgagcagccggcggaggtggcgccaccgctcgccgtacggcgccagcgcgacgtccctgccgccgaagctgaacgcgtcggtgccgctggtcaggtggcggtcggcgaacgccaggtccttgctcctgaggatctcctgcgcggcctccggcgacgaggcgaccacggtgggcacctcgccgaaccagagctgcatgacggggccgtgctcccgggccagcctccgcatgacactgtgcacgctctcgctcgacgacacgaagtggtggatgctgccgatcagcggcagcgtgcttggccccggcggcagcttaagcctcgacggctttgtgtttgtggcacatgaaatcaccggcagcctgtgcctgtggcagactaccccttggcgcgtggcgagaagcaccatgtcgcccatgtctctagctactgtactacgtacgtgctagatagactactgtggtatgtgcagctttactctacagcattggatcgtgctataaatagccgtgtcattgcgttcttaatatctgccactaatgctggccttattctaaatttacggtcaattaatggaggtgtatactaaagggcagcgtggaaatatatactccctcttccatcccataaaaaacaaatatgatataatttaacttttttatttatagtatttgttttataactgagcaattttctattctaatcatccaattagaacacgctctttctccaaattttagcatgtattaatttagttaaatctgtaatttttgagtgaattaaatcaaacaaggattccgtgcacggtatacagatctcggatactcattaccgtgaaatatccagtgaataaatcaaataagtgaaaacccattaaaaacatatttaatgttctccaaattcatgaaagaaattacttgagaatggcataaagcatgaaatatattcattccaaatctcaagtcgaaactaaatttggttataaaatgacaaattttagatgaatagtgttggttaattaccactacaacagaaacacaaaaatacggcactttaggtgccgaaaattatagattagacacctatagtgcacttttcacccaagagcatgccaccgggatgcctttgggggagaatcagcacaaatgtggtgatgtaggtgccggtttttaaaggagctgccacctatgagtcctagctaggagatataggtgttgatttctaataagaactagcacctattaaattgtcattgttggtggattttaattaaaccgacacttatgtggaagaacaaaatcaccgtcccaccggtccgccaattagtcaatctccttcctcccctcatccttatcctctccgcccttcctattctctcccaccccctcatctttatccacactcccctctttgccagcccctttccatgccaaggcaacccttcctcctgactccaacgccctcccccccttcgtttctcaagcggatccatcaactacaacaaccgcagctcctgcgggcagatctagcggcttccgtgggtggatctagtggaggcaacatctcttgcaggtagatccggtggcggctatggctctctcgcatggaggtggcagtggcggcgatatcctcgacatcccaatgaacaacattggtaggcagaattctcttttgtaattagttctcctctacagtgagtgacaacacaacatctccttggagttggtttctgatgaatatttgatgaaactgttaaccgatatttggttgatatttatatgaattgtgctttcggagatgttattggattaatcgatggtggtatagaggtgatggggagcgactcgattcgagccaatgcatcgaggaagttcccaaatcatgccgcttcgtggtgctggttgaggaatccagtacctatatgggagttccagctagcaccaaagtatgtttacatagtgcactattcgcaagaaaattttgtttttattactcacaaataaagttgtgtatgaagttaaaattcggcgtgaatgtatcctgtgcctagtagagttcaccgtatatatcacgaataatttttttatgaatgtacaaaatgttttaggtctgtttttcgatttcatgatttttaccgtttatgtccctagataaatagcatcgtaaataaacaaattatgtactggtatataccacttaattagatagatagaaataagaaaaactagagttcacctggacaaaagcgatgacacttcttgctagacacatcgctttcttggacgtactctgctctttccagtaatggaaaaggcagcgcagggccgcatggcactgatggcagtagtgaccaaggaaccttcattatctcattttcatttctccttaccgagattgactaaaaatttaaactaacgatgagttttttttcttaatctctgtcctgaaaaatactccctccttccactaatataagggattttgatattttgcttgcactgtttgaccactcgtcttattcagaaaaatttgtacaaatataaaaaatgaaaagttatgcttaaagtactatggataataaagtaattcacaaataaaataaataataattttaatatttttttaataatgcgaatggtcaaacaatgcaattaaaatgtcaaaaccccttatattagtggacggagggagtacatatattaaatatataaattacgatttccattgtaaagtgaaatatctatcactaaaaactgttacgaaaacaagcatagaaaagtcgtttatattattcaacgtttcaatagttccgtttggaaaaaatgtaagaggtatagacgtgcagagaaccgctttctttttccaccgcttggagtaataattccaagtcaatcggcgcgtattcggaaaatatattgatggtctagcacgtacgagaaaattgaacgaagttcgagctgtcattttttttccaaacacgggttaaactgcgcggtgaaatatacacgtgtttaagtcatagatttgtcacatgttgtcgtatttacaactaatttatgatctgacatgcgtgctttgtgcaaatggtcatggagaaacaagagagaaccttttcttcttctctccttttagtcagagattatgttggcggcatctgggaatcctgtgagattctaatctcaatttcttccgaatagtggtgctggaagtcttcttcaatgttgcctagcatatttgcctagcaacgttcctttgaagcatggagaagtttgttcatgagagaagtgtgtagaatgaatgatgccctaggcaagttgttttttattggttacaaactttgtaattttttcaggtgctttccttgtaacctttttcttgtaaatatttttctttttaatgaaaatcacactctgagacaaagccctggcagtaattaaataaaaaaactgatcgaaattaaagctaatcgatcctctaatatacgaaaaggttgcatattaaacaaccctataatagtaatactatcttttctttgaaaacatataaaaattcacccccaacacctcccaccaaaatagtgataagtgggataatattcctaaggtggccagattatttatagtgtgcaatagaatatcggtaatgtaacaccctgaaaatttgaccaataaaagcaaaactctaaaaatacggaccttcgaaaacttttaacttaattgcatcatgccgatcttattcgcctattttatttggatttgtttttgaagttcattaatcgtgagtaaagaatagttaattaggaataaaccctaaaagtaaattggtaaaataaatataatctaaaataaagattaggtgtggatagaaataaataaaatattatcacgatcatattcgtatcaattaaatttaaatgcgatggaataagaattaaccctaattaaaaattcaaataaattatataaataaaatatgagtaatattaatttagggtgaattcattagttgagataacacaaatattgagtaaacttcatttatgcaagatttagaaattataaaatcaaatttatatgggaaataaactaaaatcgggataaataggaaaatacactgttcattatagcgtaggtgttcgatgcggtccctagccttccccctcctctcccacctctgcccctagccgccctgagcccgcgccgacgcgccatcgccgcttgccgccgcatgccgtcgccaagcgtcgcgcgccactgccgtcgccgcgttgagccctgcgcgccatcgtcgtcaccgtcgcgtcgtcgcctcgtgccccacgcccctgcctcgccgcacgcccgtcccatctcccatgccgcgcgccgtcggtgagccgctgcccccccgtttgtcgccatgccgccgggtagagagagagccgagagagagaagaagggagaagccgagggagagaaagaagaaagaaggaaggagagaaaccgggagggagagaaagagaaggaaaaagaaaagaaaagagagaaagagaaggaaaaagaaaagaaaagagagaaaagaggagagaaaaagaaaagaaaaaaataaatagaaattagtgggagattagggaagtttagaaaatttaaaataattagaatttaattatagattaattatagtcgtagaattgcaaaatttaatataaattatggattattcttggtaatttctataagaaatcaattcgcggtagtaatttagatgtaattaataactaaacaaatagatgaattcttatagattattatagattatttttgggtaatgtctataagtaatcgattcacggtaaatattcggatttaattactaggaattttagccgtgtattatatttaatcgtttagtcatagactaaattaaatcgtacaatattataagataattttaggattttgtccgatatttagctcgcgatagaaatttctaacctattatatggatataatgctcgggtagattaaattaaaaacttatggtaacaaaatatttgtatccgcaaaaatagtttaggatgtataaatcgaaattgggtttgccctagttcgcgaatagtaaagttaataaaaaaagaatcgactttcgcattcgacttccatttggatttatttggatttttatttgaattctaaccgaattcaaatcaattttcgcacgtaactatagagcccgagggagttgcggatccaagtgatggccaggacccgcaagactttgagcaaggcaagtcatcactattccttgaacatgttcatcctatttgcaaaattattttgtttacaaataaaattacacgcagtgataaacatcctacttgtgattatgccatgccttgattattgtttacccttaaatccttgtaaccatgatttacgtataagtccctaatcaactatgacaaatgcttagaaatgctactctagatttatgcatactcatatttatcaaaagctatatgcttgggcaattacctttgggaaggtaattgagatgcggcatgtggagacatgagcggcacattgccatgatgttgatgacatgatttgtgaaaggagaaataaaattaaacaactgttttcgactggagcggacggaggatttgggtggtatccggaaaaggctagtaccatccccggtcaattaaggaccgagacatgaagttaagcatgaaacgacccccgtacaaccgcacttctcgtatgggtatagacctagcggaatagatagctgagcggaggcagtatccatgcatagtggtttcttgatgtgtgaggcaggggctctacggtggggcagccattggtagaaccttgaggcgggtgtctacagtggtgtcgccatcggtaggactgccatgagagaatttaaacataattataacttaatgcatgtgtgagtcttcccttcccgggtgcgccagaactcctctcactgcaagaaaccgtttacgcctagagtgcatgaggatgtaaagttcatggagcgggtactgccaatgtgaggttatcgaaaagctttgccgtgacgcgtctcatgtgttgggacgaggctcatgtgttgggcagtcgcggagtgctggtaaagtgtacatccactgcagtgtgaataaaccaaatctagtcgaatagccgtgctagcggttattgagcaccgggacgtgtattacacttggctagactctaaattcttaacttgtgtgggatgggatattgcatgatgatttctatattgatggagccacttcttgagaggcgggaatgtggacgtcctcagaaa

SEQ ID NO: 32330 - DNA, 8619 bp, Oryza sativa
gtgtttattttagcccgttagagatgacgaggttgtgacggttcgtaagccccaagcacaggaaaggccattacagataagaaattctgtagtagtgccatatacactggtggagaaaccgtcgtagtcccggttggtatccccctttagtcccggttgtccaaccgggactacgaatcccagtttgtgttaccactggtgggactaaagatcaatctttagtcccggttcgtgttaccaaccgggactaaagatcggtcagccacgtggccggccaaaccatctttagtcccggtttgtgttaccaaccgggacaaaatatcggtacaccatttttttttatttgcatggccctgtttgctgcatggttgattatatatatacatatatacacatacatatgttacaatacatatatatgcataatatataagcatatatatatatatatatatgtgtgtgtgtgtataaatcatatattacacacatatgtataatttaaagcacttaacgttttatgtgcatatatgttaccaaaatatatattaacactaaagtaatgtgtacatatataaatatatatatacatgcatatatagtacaattcatttgctcggtagctatagctacgacatcgacgtcgacattatgtcagaagaggaaggatcgacgttatgaattgtcgatccgtcgtagtagaattcaccatcgggaataaagacttcttcgttgatgaatcccatcagttgttcttgaacagccgtgataaaatccttgtgtaggagattatccctcatgtgaatacactatcattcgaaaaataatgacgtatcaatatatgaaattaataaacaacttaacaaatcgatacgcaatgaaattttgaatagtttatgtatacatacattgagctctcgtgttgtgcatatttggtttgataggtagtgggcatactcgcatacgtagtagccgcataagttagttccctggtcctgctttgcatactacatgagaaacgatgagagatttaatatactctttatattaactgtaattagagattcaattcaatataattttggatcatgcatgtactcactagaaaatgaaacctccgtccaagtttttctatccaagtcccgcggaccaattgacggaaccgatcccaagccctacatatacagttacatgctatgattaattaattattacctgagatcaacataatagcaatagattccccgcgactttggaatagatggcattatattacctgtctatcagtttgaagaccttgtcaaaaatcttctcctctttattcattgagtcgtacacagtgactctgcatgcgtccaagtcaaagaataacaagacccagtggaatctagaatatgcgtgagatgagatatatatatgaaaatgtacatgctatatgtgtgggaatgaaatttgtttgaatgacaataaaaactcactctgtgttgtacggcagtagtatgtacgtcttgaaatgctgctgcgttaggagatggacgagattgtcctctatgtctttctcgtacttgtcgatcatttcggtgttgattttccgagggtcgatgaacccagtatcgtagaccctccaccgtcggccctttgaatctccattctacaacgatgaaaggaaattgttattgcttacatatatgccaggagctaattattgaacgaaacaaatcgaactcaaagatactcacaaaatccaagcgctcagaagagagacgtcgagggcgtccagctagtatagatcgaagagatccttgaaatggatccagagaacatattctccttgcaagaagtcggggtttctgatcctcgctccgaacatctctctacccttggcgctcatttccatgtaccgttcatggaatttgtacatctgtgtcggtagggactgcagctgttcaggtttgacaagcggtttaccgagttcaaacttgtatgccacatccgccttcgggattggtgcgcctcgaatcagctgatccacagttagaccggtgtctaaaatgaattccgttatgccaaaatcttcgccggtcaccaacggctcgacctcttggtttggttgttctccaagctaagggactggtttggacttcttgtgataggctctctgaagtgttcggtcatagtccaatatctgtaacgcctcgttgtttgttgcggacattcccttgaagaagttcttcacgctcgggtcaaaaggtatcttcttttcaggacactgtcacgcccggaatttctatccaaaattccaaacgcttacatgtgtgttaaaccctcgtccaggaatcaaccgaggcacacaataacaaattgataatagagtacaaattaataactacttaatattcgcaaataataaattattacagaggtagatagttcctctcaaagaataacattctatgcagcggaaaaaaaataaaactataacaaactacggaacagctatggcgactccactccacaggcatcttaaccagaacaagcctaatcctccagatcatcaccttcactgagatactcctcttctaatgaatgaatattgcaagaatgagcatatgacatactcaacaagccacacagcaaatatgcaagtgcacaggataacaaaggatggcataatatagctcatttgcagaaacagcatttaacaaatatttaagagaatatttaaacagttgtataattaatcaatattaaataaacaccatacaacacacccatgttgcataggcccaaccacatttgaacaaccaaccccagttgaacaaattaaacctccaaaccaggaattatccattccaaaccaggagtcaaattaattatcacattattaccattaatgagtagtgtgagactaatcacgaaaaacattgctcaactcacccataaccgcgggtacggctattcgaatagtttaaactctgatcagaggtgtaccactgtacccacaagacacaatcccacaacatgttaccatgcgccttagtaccaccacgatacctcggaaaggaactgtgacaataccccttgcacaacacaactcaccacagtgcaccatacctggatcataatcaccccctctacaaccagaggcatggactccccagcgacccccacggacttctcgccgcttctcagtctggcactccataatgaatcatgctatacaaaaggtaaagccgttgcccacgttggcttgtggttggcacgataaatgtttcacaacagtagctcgcgaaccggtcctttattgtcatgagcacaaccatcaaaaccatatgctcacaacccaccttatccaggttttaattatcaattaattaacatcacacgataaatcatcgtgagctaccacttaacgtaaccataattaataataataattatattatataatttatatttaaaccctttagttagctaatgtttctaagcatggctaagcaaacttacatatagcatttagctgaaccaatccaatatataaggttcatgctaattaaattataacccataggaaaataagatcatcttcggccattaattaactggggaaggttcaccacccgatgacattcgaaaacgatgcataattgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaattaacaaaacagtacaaaaaaagcataaacagtacatgtggatatttttaacatgtagatcttgattttagaaaaatttagcaacttgaaccacctgaaacggatctacggttatttagttatgattttccgaagatttaatctattagaaaaaaaaactggaaaaagaagaagatgatgatgccatgatgacgtcatcaatggccggcccgggttggcgacctcgccggagattggatggtcggctgcgactttggaggacatgtacacgtagaggacgacgagacgaacccgacagtactcaccctcgagccaaacgacgaacgacgacggccggcgacgaagaggacggcggcggcggcttggtcgacggcgacggcggagctccggcggttggctgcgaagggggacgggtggccgagcttccccacggcttggcgcacctaaaggcgatggcggcgagcggcagcgacggcgcaagcggcggcgcggcgcggctgagcggcggccggcgacgacggaggactaggcggcggtggcgcggcggctacggagcacgggaaaggacgggagatggagcaaacgaaagaggaggactagggggtcctatttatagccttggattgaagagatcggactcctcccgcaagaaatcgactcgggaaatcaaaaactcggttttagagataaactcgaaaacgagttcgattcggataaaatacccaacgatttgctccgattcttgagggtaaagatagaggaggatgtggggataaaaacccctcaaaaatccggactaaaagtggagagattggggcggattcggaggcggaaggcggctcggtcggccggctcgggctcggcttgcagccggccggaggttgaaggaggccccgacatgtgggccccacatgtcggcggctcgaggaggagggggcgggcgacgtcggctgggccggcttgggccggttcgcccgcgcgcggagagagaaagatgttgggccaaaaacggcccaacggctttagggaggagttttggaactttttaattaaaataatttgtgaaatgatgtttcatttattaaaaatacttcccttgctcaaacaattcctagaaaaatctagaaaatagaggagcaagtgtagtatttaataaaactttatctagctcatttttttgttgaaaattttcctaaataattagggtttagcttgtaggcttttaaaaaaataatttctaaaaaatgatttaaacaatgcatttttaatttaggcgatttttagggcgtgacagacaccgaggcttgagttacctcttcacttctcctgccacataagcatcaagctcctcttgactgcaatcgtacggtggccccttgtttttggtggcgtcaactctcaccttcttcgttgcccttgtgcgggcaggcggtggagcttggcgagaccttgtcttgggaggtgcaggcggacacggtggaggtggaggagccggaggagatggtgcaggaggacgtggcggaggaaccggaggagatggtgcaggaagagatggcggagccggaggagatggtgcacgagacgccgcttgtcgcctagggaggatgatgtaccgcttgcgccatagtataatggtgtggcttgtgtctcgtagatgcgtctcaccgtctcctcctgggtagtccaactcgaggtcctcgtacgcagcttccactagctcaacttcgaccctcgagtatcctgctggaatcggcctgcagtggtaagtcctggaagggtccgttgggatggccattcccgacgccaccttcacgtgatgagaggttatctattagtaatcaacctaagcagcaacttgcagaatgtacaagtcaaaaatcatcaaactacgagcataccttgattgataagttcttgaagggaatatgcagctcacatggtgtccactgcgtgatctcatcaacggggcaggtggtttcgtcctgggtttgcatggcgtccatgctctgtgatcctacctgccccgttgaggtgcagctgctatgattgcctgatgggctgaccattgcaggaggaatgtacggctggggatcctaggaccaatgtgcggccatacgttcatccaccttccttgccacctcctcttgcatgctgagctcgtagctcaataccctgtactcaagatctgcaatcttcgcctcggtatctctcttgctcctcatccgactcctgtatatgtggatgtcctccttaaatccaatcttccaggggatcacgcctttccctcgtgttcgtcctggatgctcgggagtctgtagggcgagtgacagctcatccttctctctatcgggtcggaatgtgccctgagaagaggctaccactgcgtccgttagttgactggcagcctcgcgtatctgatcgctgaagacaagggagccatcaactaggttaagcgttccaccatgagcatagtaccagaactttgatcgatccgatccggccatttagcggtggccggttcgatacccctctcaatcaaacttgcctccatctcctcccacttcggcattgcgacgctatatcagcctgaccccaagtggtgatggtacttcttggcggcattttctttgtttctagccatcatcgcttgcccttgttgccctgtcttgtaagcaacgaacttgtcccaatgatctcttagctttggaaatacgtcgaagttcggtgttagttccttcaggatgtatttcttgtagagatctcccttgaagctctggaactgttctgccattttcttcagagtccaccgtttcactatgttctccgtacccgcgggtagcgtgaacgtctcgagcattgtggtccacaacatctctttctctgagtccgggacaaagctgtcattatccctgcatgcccatgttctgcgccagtacaccgtgctgacaggcacgttgtccctcacaacccaaccgctgtggcatacaaaattcttggttgcttctgccggggcactaggtcggccgtctttgtccatctcagttatgatgtgccgaccctctatcttcttcgtggcacctcattgtcagtgtgccctcttctgtccggcgaagggatgacttccactagcctcctcctaatagttcccctcctcgttcccctccgcatccctctccacgttcccctcctcgttcaagtactggtttggatcctcattcccctcttcttcgttccagtactggctacttccctctgcgattgtatcgtatagtatatgttcctcatcgcgatcagccatctgtgcatacaaaaaatatttgttaggtctagaggatgtatttgctaaccgtaatattaaaactctactaatcttatattaaatctctaataatcttatattaaaattgtaataatcatatatatatatatatatatatatatatatatatatatatatatatatatatatatatatatatatatatatatatatatgcgctaggtctaacaatcttatattaaatctctaacaatcttatattaaatctctaataatcttatattaaaattgtaataatcatatatgctaagtctaacaatcttatattaaattgctactaatctaatcttaaaattgtaataatcatatatatatgctaagtataacaatcttatattaaatcgctactaatcttatattaaaattgtaataatcatatatatatatatgctaagtctaacaaacttatattaaatcgctataaatcttatattaaaattgtaataatcatatatgctaagtctaacaatcttatattaaatctctaacaatcacttcattacatcacttgcctgcgcgaattccttcgatggctagttaccacttcggcttgagggacgacgacgacatcttctctgcaacattaccaggaaaatgtattagtctaaacgggccaagttacatatataatcatatatgtattaccaggaaaatgtattagtttaaacgtgttcgttctcacacttttagtacaagtgcattcacgttcgtaagcatttcgttcatgttcgtaagcgtttcattcacgttcgtaagcatttcgttcacgctcgttcgcgttcgttaacgtttcgttcacgtccactcgtgtttcgttcacgttcgttaacatctcattcacattcgttcacgttcgttaagcgttcgttcaaggtcgtccacgtatcgttcacattcgttcgggttcgttcgcgttcggtcacgtttcaatcacgttcgttcacgttcggcaatgttgggcgcgcgcggcagtggcgtggtggcgcggcggcggcgtcggggcgccgtgggctggtccagcggcgggcgggcgcggcggcggcgtggcgtcgtggcggcgtggcgagctcgaggcgggggcggcggcgtggtagtggcgacggcaacggcggcggtggcggtcgcgtagaagtcggtcgtcggcggtggcggttgaccgcggtgtggcagtggcgtcggcaacgagctaggcagcggcgatttggagagagagagagatcgagattgagagagagagagagagagagaggtagtggcggctctcacccaagagaggcggcagcggcgtctgcggcggtggcggagagcaccgccaagggacggcgagagaagacgatggcgtcagcgcagggttgccctaggcacggtggcggcgaaggagaagccgagatcgatctcgatggaaaaacatctaagtattggtggagaagacgagggtgtaccgggaatatatataccccagatctttagtcccagttg

SEQ ID NO: 32331 - DNA, 7068 bp, Oryza sativa
tctcaccaaccgggactaaagatcttttcccgctatttccaaattctttttaaacccggttagggttaagaactaggactaaagataatagcagttgtgtcttgaatttcattgcatatgtgtttctaaaatagtaaataatgcattacaattatttaaagtcgaacaattaatgacaaaacctttgaaaattatttgttgtatgtagtagaataagtggataatatataataagcacatgaatgatttaaaattgttaaaaattctaataatcatatataattagcatatgcatgatattaaattgttaaaaattctaattaacatatgtaaatagcacatgcatgattaaaattaatacaaattctaataatcatatataattagcatatcatgatattaaattgttgaaaattctaattaacatatgtaaataccacatgcatgattttaataaaaaaaaatctaataatcatatataattagcagatcatgacattaaattgttgaaaattctataacatatgtaaataccacatgcatgatttaaaattaataaaaaatctaataatcatatataattagcatatcatgataataaattgttgaaaattctaattaacatatgtaaataccacttgcatgatttaaaacttttaaaaattctaataatcatatataactagcatatggatgatttcaatttgacaaaaatttctaataatcatacataatttataaaaaatctaataatcatatataattagcatatcatgataataaattgttgaaaagtctaattaacatatgtaaatacaacgtgcatgatttaaaacttttaaaaattctaataatcatatataactagcctatggatgatttcaatttaactaaaattctaataatcatatataattaataaaaaatctaataattatatataagtagcatatggatgagttcaatttgataaaaattctaataatcatacataattaacatatgccatacaacaactgatttgtatggatattcagtacattcaacatagtttacatcgtgtacacaacaattacgacaatacatcggcggtgacggttgactgcatgtactttctcctcactattgttccttccttgtgattgctacgtgagtaaggagtgtcttcatttgataggaggattctagggtcaatcgtcaccgtgaaagggggttgcgcatcaaactgatcgtaatcctcgtcagtcttttcctctactccgacgatttttctttttcctaggagaaccacgtggcgcttcggctcgttaggccctttgcccttttttcctttgctagacatgtccttgacgtaaaaaacttgcgttacatcattggcaaggacaaaaggttcgtccgagtatccaaccttgttaaggtcaaccgttgtcatcccactgtcatcaatagttacgcctccaccagtcaacctaacccattggcaccgaaacagagggaccttgagatgtccatagtcaagttcccatatgtcctcaatggcaccgtaatatgtgccagttgtaccatcgtgtcccatggcatcgatacgaacaacactattctggtttgtgctcttcatgtcttgggccctcgtgtagaatgcgtacccattgatttcatatctctggaatgtcgcgatcgagccagatggtcccctcgccaggaaggctagttgttggttaatcgtctcgttacccatgagatgttgacgcagccacgtggagaaagtatcaatgtgatgccgtgtaatccatgcatcggacttaccgatgtttctggtgcgaactagagccaagtgctcctcgatgtagggagccaccaatgaagattgttgcagaaccgtgaaatgggctttacgaaataaattgttgtctaccgtcattattgctttccttccgagagtcccctttccccgtagtctcccttcatggcgtgattcaggtaccccgattgggcgaaggtcttcgataaattctatgcagaattcaatgacctcctctgttccataccccttagcgatgcttgcctctggacgagcacggttatgaacatacttcttcagaacgcccatgtacctctcgaaaggaaacatgttgtgtaggtacacaggaccgagaataccgatctctttgacaaggtgacaaagtagatgcgtcattatattgaaaaatgaaggtggaaatatcaactcaaagctgacaagacattgcaccacatcattctacatggcttgtaatctatacggatcgatgaccttctgcgaaattgcgttcatgaaagcacatagctttgttattgttgcccggacattgtctgggaggataccccttattacaactagtaacaggtgtgtcatcaacacgtgatagtcatgagactttagatttgtgaacttcttctccttcgtgcttgttattcgctttatattcgtggagtatccagacggtaccttgatgctctccaaacattcaaacatactttccttctttgccttgctaagagtgtagctggctggactcaagtaatggcttcctttctcctttggttccgggtgaaggtcaccgcgttgttccatatgcttcagatcattaagtgcttccagtgtatctttcgactttccatatacacctaggaagccaagaaggtttacacaaaggttcttagtgaggtgcatcacgtcgattgcgtggcggacgtccaagaattcccaatagggtatgtaacaccctaaaaattcgacgacaaaatctaaactctaaaaatacggaccttcaaaaactttttaaataaagttgcatcatgccgattttgttcgattattttaatgaattttgatttcggagtttataaatcgcgaataatggataattagttaggagtaaaccctaaaaagtaaattgaccaagtaaataattaaagtgcaatttaaaataatatttagtgaggatagaaatgagtaaaatattattacgactatatttgtatcaattaaattgaaaagtgtcggaataagaattaactctaattaaattcaagaaaattatataaaaataaaatatgggttaaattaatcaaggatggacccattggttggaataacacaaatattgagtgaacttcatttgtacaaaattaaggtttatagaatcaattttaaataaataaataggcttaaatcgggtaaatagaaaacggcactattcatcggccgccaggtgttcgacgaggtcccctagcctaaccctgcgccgctgccgcaccgacgccgcgcccgcgccccacgcctcgcgccgcgcaccgccgctaccgccgtcgccttcggccgtcgccgtcgccgctcgcccgtcatgtcgccttgcgccccgtgccgccgctgccgcgctgtcgccgtcgccgtcgcgacccgcctcgcgccgcgcgccaccgctgccgccctgtcaccacccgtcccgtcgcgcgcgcatcccatcacccgccgctgcgccgtgcactgtcgccgtcgccgtcgccgtcgccacgtgccgttgccgtcgccgcctcgagccctacaccgccgtcgccatcgccgtcgcgccgcgccgcgccgtcccatcgccgcgcgtgtcccgtcgccgcacgcgtcgcatcgccgcctcgcgccccgcgctgccgcgccgccgtcgcatcacccccccttcaccgccccctctctctcctctctctcacaccctataaaacccccagccctttttttttcccccacacccatttccccccatctcctccctttttaccacgccaccgccgtagtgccgccgcaccaccgccttcgtgctgccgggccgctgttcccgtgccgccgcgccgccgttcccgtaccccgcaccgccgttccagcgccgccatgccgccactccagcgccgccgtgcgccaccgtcgctgccgccgtcgtcgccgctgccgccgtcggtgagccgccctccgttcccctcgcgtccaccgccgccaccgctcgggtgggagagagagccgagagagagagagagagagggagaggaaaagagagagccgagagagagagggagaggaaaacagaggccggcagagagagagagagagacaaagagaggaaaagaaaaagagaaaaaaaaagaaagaaaaagaaagggagaaaaagaaaaaggaaataaataggaaattagagggagattagggaagtttagaaaatttaaaataattggaattttataggttaattatagtcatagaattgcaaaatttaatatgaattatggattattcttggcaatttctataagaaatcaattcgcggtaataatttagatgtagttaataactaaacaaatagatgaattcttatggattattatagattatttttgggtaatccctataagtaatcaattcacggtagaaatttggatttaattcctagggattttagccgtgtattatatttaatcatctagtcatagactaaattaaatcatataatatttctaggatttcgtccgatattgagctcgcgatagaaatctctaacctattatatggatataatgctcgggtagattaaattaaaaatttatgacagcaaaacatttatacccgcaaaatagtttgaatcgaaattgggtttgccttagttcgcgaataataaagttaaaataaaggaatcgactttcgcattcgactttcatttggatttatttggattttgtttgaattctaatcgaattcaaattgttctttcacacataattatagagaccgagggagccgtggatccaggtgaaggccaagacccgcaagaccttgagcaaggcaagtcatcactattctttgaacatgttgatcctaattgcgaaattgttttgtttacaaataaaattgcatgcaatgataaacatcctacttgtgattatgccatgccttgattattgtttaccccttattccttcgtaaccatatttacgtatgagtccctagtcaactatgataattgcttagaaatgctattctagaatcatgcatactcatatttatcaaaatgctttatgcttgggcaattacctttgggaaggtaattgagatgcggcatgtggagacatgagcgccacattgccatgatattgatgacatgatttgtgaaaggagaaataaaactaaacaactattttttgactggggcggacggaggatttgggtggtatccggaaaaggctagtgccgtccctggtcaattaaggaccgagccatgaagctaagcatgaaacgacccccgtacgaccgcacttctcgtatgggtatagacctagcggagtacatagctgagtggaggcagtatccatgcatagtggtttcttttaggtgtgtgaatcgacaagcagtctactggcggatgccctgtcaggagggccagaggctgacttgcagtctactggcggatgccctgataggagggcctgagattgacttgtagtttgctggcggatgcccgttacggatggccagagactgacttgataagactacgagaaggaacccaaaagaggacagctgaaatggattgggttcaactaccggatgcaatgttaggaatgcatgtgtgagttttccctcccaggagcgccagaactcctctcactgctagaaatcgtatgacgcctagagtgcatgaggatgtaaagttcatggagcgggtactgccaatgcgaggttatcgaaaagctttgccgtgacgcatctcatgtgttgggacaaggctcatgtgttgggcagtcgcggagtgcgggtaaagtgtacatccactgcagtgtgagtaaaccaaatttattcgaatagccgtgctcgcggttaatgagcatcgggacatgtattacacttggctagactctaaattctttaacttgagtgggatggaatattgcatgataatttttgtgctgatggagccacttcctgagaggcgggaatgtggacgtcctcagaaaatcataacgactcaatggcgggaagctatccttgggatcacaacggatggtggacagaaccgtcattgtttaatatgaacaatggtattaaaacttgattagtctttgctaggtcttagacttgtgaaaagaattacaaaacttgctttgcgcaaatgaaccatagccatcctttgaaatcctctgtcatgtgcatcattgctgtggtggcttgctgagtacggttggtactcacccttgtaaatataaaattaatcagaagcgggagatgaagcttcggaggatccctatgcctactaccaggagggagatgaagacgaaggcgcccagaaggtcttagtacggtcgttgcctgtggcaatggcgagccgctgcctaaattctgctgccttacctatttctgcttttggatgtattccggatcgctcggtctgatgatttaagactatgcctacaggcttatgatgtaataattcgtactagacattcgtgtatgtgtatttggtatttcagctatgaattcgtgtgtaccagactacttgatccagggaaatggtactgtttacacgattgattcctgttataaaaacgggggtccacagggtaactcccaaaatatagagttctttttccacatcgccgcgtgaccatcttcactctctataggctggttgccaggcccctttccaaacactactttaagatctttaactatagcaaacattgttttcccattgcgatgtttaggcttcgtacggtggtccgccttatgttaaaagtgattgcctttcttccgtaccaggtggtttgctgcaaggaatcgacgatgacccatgtacacaaccttcctacagtgcttatgatatgtactttatgtttcatccatacagtgagtgtaagccttgaaccccttgttggactgtccggataggttgctaagtgcatgccaactgttgatggttacgaacagcagcgctcgtaggttaaactcctcctgtttgtcctcgtcccacacgggacactttccttcgtcca

SEQ ID NO: 32332 - DNA, 12582 bp, Oryza sativa
aataccacatcaccttagcaggaattctcttcttcgttagctgcccgtcaacttctcctggatcatctcgtctaatcttgtatcgtagtgctttgcaaacagggcatgcttctaggttctcgtactccttaccacgatataggatacaatcattcggacatgcgtgaatcttctgaacttccagtccaagagggcagactatcttcttagcctcgtacgttgtctcgggcaatttgtttccctccggaagaatgttcttgacgagttttaataaatcgccaaatgccttgtcactaacaccattttttgccttccattgcaagaactccagagtggtatccaactttttgtgcccctgctcgcaaccttggtacaacgacgttctgtggtcctctaacatcttgtccaatttatgagcccccttttcactttcgcaatcctacttggcgtcctgcaacatctgaccaagatcatccgcaacgtcgttaccaacagcatccctttcctccccgcccgtttgatttccttcaaatccagcgtagtgagcaaagtctgaaatattgtcgtcttccacttcatcttcttccatttcaacaataatagcttggcatgaaccccgcatcaaacaagtggaaatgaatagtcctggatacagaatactccttctgattcttacacttattgcatggacaacaaataaaacccatttgcctgttagcttcggccactctcaaaaaataatgcacgtcgtcaataagctctttggaccgctagtcagcgtacatccattgccgatccatctacatgacatgaaaaaaaatcgtacacaaataattattcgtacaataatgatagtcatacaataattataaaataattacaaactctttcaacagtcacacaataatgacatatcattattcatacaaaaattatgaaatattacaacaaataattcttatttactatttataaagttttaaactaatattaatgtgttgtacttattttaatttttcattttagtttgttttctattattcaagataaactttcactatattttccttctcaactattttataaaaccttctttagcaaataaactaaatttctatatattcttccttccccacacaaattttctctctcatcaacttacaacaaaattttggagacaaaaaagtgtgtaaaacatagctccaaatgtaatatgacaaaaaaaacattggaggatgaagttgctaaccttttaggcacctccgatttgtatataatcaccaaaataaattcactagaaattttggcattacctcccctcttttttgaagaaattttgaagcttacttaggctggaggagaaagaagacatatatataggggtgggactttagtcccggttggtgttatgaaccggggctaaagatcgccggggtaacaccaaccggaactaaagttacgatctttagtcccggttggtgttaccaaccgggactaaagatcccggggggcctgacaaaccctgacagcatttgaaccgggacaaaagatgatctttagtccatctgcccgttaccctttttaaccgagactaaagatcatctttagtcccggtttttgttgcaaccgggactattgtggaattaggccgaccgacgaaagatggtttctccaccagtgatacgggataatattgctcatgtgtagaacttgcaaagctgcattattataccgactgaaatgaaacatagagaaatgaccgctagtagctactagctagtatcttagagcagttaatacatagaaaatcagctagcaaatacaagtgaataccatattgctataaggctgtgtttgcaggaggcagttaccaacccaaacactgggcacggaaaatagactgatccattaggacgtgattaattaactatttgttaaatttattttcaaaaatagattaatttaatttttttaagcaactttcgtatataaactttttgcaaaaaaacaccgtttaatagtttgaaaagcgtgtgcacggaaaacgaaggagaggggttgggaaaggaggcatccgaacacaccctaagtatgcaaatctaaatatatgttaacagttcttaccatcaaaactgagtctgcttattatttcaaaagataactactccctccgtctcagaatataagcttttcttagagttgtgcacggttattaagaaagtagttagaattactgaaaactgatctttgcccggatggcaaagatcacattagtcccggttcaaaatcccaatggcacattatgatctttcgttccggttggtaaacaccaaccgggactaaagatgatttttaatctcggatctaaatgttgtcaggcccccactatctttagcccgcacgcctcccctcgcccttatctccttggcacaccacacgcactgcacttctccctcccctcctctcctttccctctctgtcggctgaggtgatggcggggtgtccgcggcagcgggtaggaggcgcccgagatgaggcggcgaggggcgggtggtggcagcaccctcccctcagcaggatcctgcaggaggggcggaggcagttggcgcgcggcacatgaggggagagttagcgggcggtggcggcgccctccccttcgctggatccgacgggagggaggaggcaggcagcgagcaacggcagttggtgaatttttgtgaatttatttagatgtttttctgaatttgtgatgtcaatttgatccgtgatgttcattcgatctgttaatctttgatgtcaatttgatctgtgatgttcgttcgatctgtgaatttattatgtcaatttgagtatgttaattcaatctgtgaatttgtgatgttggagagttcatctcaaaagcaatatgcaaataggaaagaaaacaatgaaaaaaaggaaaaaacaccaaccaggactaaagatagatgttttgccctgattatttcaaccggggctaaagatgcccatctttagccctggattaggcgtcccggttgtatatgcggaactaaaggaggctgtgaaccggagctatatattattggccagaggaagtaatttattgcatgatgatcattgtcgaaacaatattttagcaataacaaaagggggtagcgcaggagacctaaaagtggggagataaggatttagacaggttcatgtcctctcgatgagaggtaataccctactcctgtttggggatttgaatttgccaggtgtgtattgatctgacgatctaaggtgctcatatgcccctagaggcctcctgcccaccttatataggatgggggcaggattacaagatagaaacattaaccaatacggcattggtttcctaaatctattatcaaaccaggactttaggccgttccgtaatatacgatgaaacgtaaaacccaagtcatgatccgttacatatttcatagatataagctatcccttatgactagtgctttaatcatcttcgccatggtctcccgagtacgtacttttatcaaatctgaagactgtggagggctgaaaaataattcaatgtaaacttaggtgcatcgactagatgcacctaataggtgtagccccccgactatgtggttagttgaacaaaccaagcatatagtcaaggagtaaataatccaaccaactgaatggtttttgatagttatagtcaaccaagtgacttgatattaatatatagcatatgcggtgtgaatccatgaataatatgatctgagtgatatatcgactgctttgtaaaatatgatgcgtacaacctaaagttgactacatcattgaaaattcacatagcaaaacagctataaagaatcttgtatgttatgaataaagtaatttccaaaacattgtgcacacaccatgcgcacactgctttaacagatgtacttaagtccctgaaagacacatggtttcaccatacctggaaatatagggcatacgtggttcaaaatccgagtaaactaactcataaaggatttaccaaccacctggaaaatgactgaaatatataatcagcctaagccataatattggtcaataaaaatgcacacttacatggcaaaaaacaacgacatttgtcacaccctaaaaatttaaaatatataaattgttgtttaaatggaattgttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaaatcggcccaaaaccgctctctctctcctcggcccagtccggcccagtccgcagccgcgcgcgcgcgttcggtcgctgacaggtgggtcccgcttgtcggatccatcgtcttcgtcgcgccgccgccgcccgaaaccctagccgagcgccgccgccgtctccttccaaaattcggtcgatcctttccttctctggccgaattgatagaggggaaacaatctccgggatctcctctaccttttcccctttggaaacatcggctaaatcggcttggaaagtgtttgcttcgaggtcaaatcggatcggcttttctctctccgagcccgatctttccttctcgtcgccagtcgccgtgggccttcgccgccgcctcctagcccctttaaaagcttccccggtgtctcctctacccgccgccaccctcgccttcgcctcttgtcgtcggaaacgccctagcgccgtgtgccctagcgccgccgtcgccgccgtcgctccagccgtgcaccgccgtcgttcccgtcatcgccgtcgctcgggaagaccgccgtcgtggtcgccaagtcaccgccgtcctcgtccgccccttcgccgccgccgaagaccgccggagcaccgtcgccgccgtcgacccgatcttttccggcgcttcctcctcgtcgccgtcgccatccgttggtcttccgccgctcctttggtcaccggtgagttcgccgcgtcgcgctctacccgttggtgccctccgttcgtgccgaagcgccgccgttcgccggcgagtgtgcgccgtccgagccgccgagccgccgccgccggtggtgacgtcatcgccgacgtcatcgtggccgtctgccgtgagccgccgtggatccgatcgatctcggccgtccgttttggatcaagtcgatctcggccgtccgttcgcgtgaaccgccgccgtgcgcccggtccaccgcaaaccctagcccgctgacgcaataatcctcctttttcttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgtttttgctcttttctgtttagattccgtcgttttctcccggagaagaatttgaagagttccaaggccagcaaggcaagtcacacagatcccaaacaaccctttgagcatgttgatcctatttaaagctattgtttctattcaactattgcatttattttcgaatgtcattgggtggaattaacctattgtttgttatagcccttttgttcttgattactttattccttgataccttgggttattataacttgactagttgagctttatattggttcaactagatattagatataattgcttagccctgcttagaaacattagctcactattgggataacttatgactcactgttatttaataatggcttaatgatagttcacgatggtcaatcgtgattggttaattaattaatgtgccaactaaaaactgataatggtgggttgtgagcacatggttttgttggtcgtgctcatgacaattaaggaccggttcacgagtttcggttgtgaaacattaaccgtgccagccacaagccagcatgggcaacgtctttatcttttgtatagcatggttcattgcggggcaccagactgagaagtggcggagataagcccacgggggacgctggggagtcaatgccttgtttataagagggtgattatgatccaggaatggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtcttttgtgattagtctcacccttctcaccatagtaaatgatgctttaactggtaataatttgattagctcctggtttggaatggtatattcctggtttggagatagaactgtgcagccgggatggttgttcacaatggttgggcctatgcaacagggtatgttgtatagcgttggattaatattgtttaattacttaacagttttattaaattctcaaatgtttgctaaatgctgcttttgcaaatgaaaccctactatgccattctttgttatcctgtgcacttgcatatttgctgcgtggcttgctgagtatgtcatatactcaccttgcaatcattcatcagaggaagagttctacagtgaagttgatggtgtggaggattaggtgtagccttggtcaagctgcctgtggagtggagccgtctgcgccgtttatcttattttccgctgcttagatcttcattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccaggcgtgacaagttggtatcagagcctccttgaccctaggttatgccaaatggttacccttagaagccctctaaaagtattggaaaagtagaactgttctcctccctttctcttttaattaaaccaaactaatggcacatgcacttcataattttttttagtggttctcattcaaaaatttattccagtgttattagtactgtacatctattactgtactaatggctcatattccagcaaaagttttacaatgtttttttatttaatcctaatgtaattaaataaatttagcaagttgattttataactttcttttatttcttttgaaacctgttgttcaaaagtacaaaatttgtaacctggtttccaactgtttcaacttatcttgcaagcttggtttactttatttacttacctttttactttgattttctaaactttattcaaattaatcccaaaaacttgtgctattaattggataaatgtcttaactccctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaatagaagtgccgagtcaaagtcaccttgaacagtaatagtgaagatattccatcagtgatgttcgaagctggaggaagaaactacatccatgcatgtcaggaggtggcaaggatcaccataggagagctccgtgatcgctatagtgatcagttggccgacactgagtatcgctaccatcctcgccaaccccagggaagtgaccgtggcagttaccttgagactgaaggaattgagaatgatgctaccacgaggcatttggttgagatgctgtgggctatggatgaaagccgtgcggagactgtgttagcggctcaagatcgtgaagaccggaatcgtggtaagatttgcaagttagaagacaaggtggatcgtttggagaaggaactagctgcgttgaagggagaagcaccgccgcagaaggccaggattcgtcttaccgcaaggaagagagctctatttgtccctcgctatcaattggcgccaaaggtccgtgtggtggagaaagaagttgccccaaccctagcggatcctccggtcattatcataagtgatgatgatgaagaagaagaatccaagcgcacccattccaagattgagtgggtatctacccaagatgatgaagacgagccgaacgagccttcaatcgacctccgatgctcggaagaactagagtgactggttaagtcgttgtcttagatcgttgtgttagtttgcttgttttaagtttggttgtgtgtgcctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaggtaattccctgtcctaagtagtttcccccggtttctcttcttgtgccctgtccatgccagatggtgaacactcgcagcaacgggaatggccccaacaaccccaataacaacaacaatgaagggaacccaacccttgctcaagttcttgctcaacagactcagttaatgaacatgatgatgcagcaacttcagaaccagcagaaccagggaaataactatgcacctccccagaacaagttagcagaatttcttcgtgtaaggccgcctattttctctagtaccactaatcctgtcgaagctggtgattggctgcatgccatagagaagaagttggatttgcttcaatgcactgatcaggagaaggtctcatttgcatcacaccagttacatggccctgcctctgaatggtgggatcacttccgcctgaataggactactgctgaacctatcacttggcttgaattcaccgctgcttttcggaagacgcatataccatcgggagtggtgtctctcaagaagaaggaattcaggtcgctcacccagggatctcgctctgttacggagtatctgcacgagttcaatcgtctggctcgttatgctccggaagatgtgcgcaatgatgaagagcgtcaggagaagttcttggaaggacttaatgatgagctttcttacccactcatgactggagattattctgatttccagaagttagtggataaggctattcgtcaggaagacaagtacaaccgcatggagcagaagaaacgccggattgctcaattcaagacacaacaggggaataatcagaagccgcgtcttactttaggaccccagtccatgccacagggaggtttttcatctgttgttcgtccgcagcgtcagttcttcaacaacaatgctggcaacaacatccgcaatcaagctccacgtcctgttgcagctccagcacagcaacaacctgccaagagggagcaaggcagcaagcccgtggtgtgtttcaactgtggagacccaggacattacactgacaagtgtccgaagccccgacgcgtgaaggttgtccctgcccagagcaactctactgtaccagcatcaaaggcccgtgtcaatcatgtcgctgctgcagaagctcaagatgctccagatgtgatttttggtacgtttcttgttaacttagttcctgcaacagtgcttttcgattctggtgctacacattcattcttatctatgagttttgcgggaaatcatgggatggaagtagaagatcttagacgtcctttaatggttagtaccccaagtaatcaagcactctctctgcaacgtagcccctctgtcagaatagaaattaaaggagtaccatttctggccaatcttatcttgttagaatccaaagaccttgatgtcatcctagggatggactggttagccagacataaaggtgtgatagactgtgccaacagaaaagtaactctcaccagcaatgatggacgagttgtaactgttcatgcattgtcttctgagtctttaaggtcaagactgaaccagataactttggaagagattcctatagtccgggagtatcccgatgtgtttccagatgatttacctggtatgccgcccaaaagggatatagagttcagaatagatttggtacctggaacaactccgatccataagagaccttatagaatggcagccaatgagttggcagaagttaagaggcaagtagacgatttgcttcagaaaggatacatcagaccgagttcatcaccatggggagctccggttatttttgtggaaaagaaagatcatacccagaggatgtgtgtggactatcgtgccctaaatgatgtgactatcaagaataaatatccactacccagaattgatgatttgtttgatcagcttaaaggtgccactgttttctctaagatcgatcttcgatcagggtatcaccagttgagaatcaaagaggaagatatacctaagacagcttttaccactaggtatgggttgttcgaatgtactgttatgtcttttggacttaccaatgcccccactttcttcatgaacttgatgaataaggtgtttatggaatacctagacaagttcgtggtggtctttattgatgatattcttatctactcccgaaccaaagaagagcatgaagaacatcttcgccttgcactagaaaagttacgagaacatcaactgtatgctaagtttagcaagtgtgaattttggttgtctgaagtgaagttccttggtcacgtcatctcagcgggaggagttgccgtcgatcctagtaatgtggaatccgtaaccaactggaaacaaccaaagacagtttcagagattcgcagtttcttaggcctcgcaggatattatcggaggtttatagagaatttttccaagattgctaagcccatgacacgactgcttcagaaagatgtgaagtacaagtggtcggaagaatgtgagcagggttttcaagagttgaagaatcgcttgatatcagctcctattttgattttgtccgatccaaagaagggttttcaagtgtattgcgatgcatccaaacttgggttaggttgtgttctgatgcaagatgagaaggtggttgcctatgcatctcgtcagtgacatccgcatgagaagaactaccctactcatgattttgaattagctgcagtagttcatgcgttgaagatttggcgtcattatcttttcggtactcgtacagaggtgtacaccgatcacaagagtttaaagtatatctttactcagccggatctgaacatgagacaaaggagatggttggaattaattaaggattatgacatgggaattcattatcacccggaaaaggctaatgttgtagcagacgctcttagcagaaaaggctattgcaatgttacggaaggacgacagttgcctttggagttatgcaaggaatttgaaagattaaatttgggaattgtcagtagaggtttcgttgcagccttagaagcgaagcccactctaattgatcaagttagagaagcccaaattaatgatcctgatattcaagaaatcaagaagaatatgagaagaggaaaagctatcggtttcttggaggatgagcaaggaactgtatggttgggcgagagaatctgtgtccccgacaacaaagatttaaaagatgcaattctgaaagaagctcatgatactttatactccattcaccctggtagtactaagatgtactaggatctcaaggaaagattttggtgggcaagtatgaagcgtgaaatcgcagagtacgtagcagtatgtgatgtttgtcagcgagtcaaggcagaacatcagaaacctgccggtttgttgcagcctttgaagattcctgaatggaaatgggaagaaatcggcatggattttatcactggtctacccagaacgtcatcaggccatgactctatttgggtgatagtcgacagacttaccaaagtggcccattttattccgataaaaacaacctattccggaagtcggttggcggaattgtatatggccaggattgtatgtttgcatggcgtccctaagaaaatagtgtctgatcgaggcagtcagtttacttcaaatttttggaagaagcttcaggaagagatgggttctaagctgaactttagtactgcttatcatccgcaaacagatggacaaactgaaagggtgaatcagattttggaagacatgttgagagcttgtgctttagatttcggtggaagttgggataagaatctaccttatgcagaattttcatacaacaacagttatcaatctagtcttcagatggctccttacgaagcactgtatggtcggaagtgccgcactccgcttctgtgggatcaaacgggagaacgtcaggttttcgggacggatatcctaagggaagtagaagaaaaggtgaaaatcattcaagaaagattgcg

SEQ ID NO: 32333 - DNA, 678 bp, Oryza sativa
gacccgatcttttccgccgcttcctcctcgtcgccgtcgccgtccgttggtcttccgccgctcctttggtcaccggtgagttcgccgcgtcgcgctctacccgttggtgccctccgttcgtgccgaagcgccgccgttcgccggcgagtgtgcgccgtccgagccgccgagccgctgccgccggtggtgacgtcatcgccgacgtcatcgtggccgtctgccgtgagccgccgtggaccggatcgatctcggccgtccgttttggatcaagtcgatctcggccgtccgttcgcgtgaaccgccgccgtgcgcccggtccaccgcaaaccctagcccgctaacgcaataatccaccttttccttttcaaaaataattcattattgcgtcataattcaattaaaatcaatttaagtgttttaatccgatttaatcttaaaaaatttataactaattcatcttagctccgatttagttggttcaagtctctaaatttttctaaaattgagatctacatgttaaaaatatccacatgtactgttcattcttgtttatgtgctgttttggtgtttttgctcttttctgtttagattccgtcgtttccggagagtccgttttcgccggagaagaatttgaagagttcccaggccagcaaggcaagtcacacagatcccaaacaa

SEQ ID NO: 32334 - DNA, 5174 bp, Oryza sativa
  unsure (1)..(5174): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgagaattacagtatctaatttcttggaacaaatttctctaaaaagctacatagctcaattatagcctcacaaacattagcaggcagaactccacgaatagaaagtggaaggtatctgtgtaaaaatacatgacaatcatgacacttcatccctgatattttagcttttgttgcatccacatagtgtgaaatttttgaagagtatccatctggcacttttatttctctaaggaactcacaaaatgctttcttctcagctagtgtcattgtatagcatgcaggacgaaataagaacttcccatcaccagttggaggtgcatgaagttcatgtcgtattttcatgagttccaaatcaaaccgggatttaatattgtcctttgtcttcccatccagatttaacaaggtacccacaatactatcgcaaacattcttttcaatgtgcatgacatctagattatgtcttatcgataacgtactccaatatggcagctggaaaaatatactttttttttcttccaaactccatacaatgtgcttgagcgttttctcttattgttatgtttcccaaatttcacctgaatacataaagtgatgtcaataataatacactactcatattcttatactctataaagtaataacaaataaggcatagaatagcaaatagtataataatttactttcagattgaccagataggatctactatcattctgtacgcaaaattccccgagatctcaatggcagactatcagtgtgtaatgacacaagttgagcgacagtacaatgtaagacgccacaaactgtacaagacctattgcacaacaaaacagtgccctagtcatgttgcgccagaggactggcagtggttgattgataacttatggagtgatgagcagttccaggtacttgtttaattttctttgcaatacaatatgattcataattcattattcttatgagattattatgttttttagaaacggagcaaacaaaattccattaatagatcaaagcaagagatgaaatcacatgttggaacaaagtctatagtgcaaatagcacatgaactggtaagggatattgtcattcacttatatctttaaactatatgtttgacatgtatatatataaattataaggcttcttttgtatgtgatataattgcagagaaatccagtgacaggtgaatggactagtgctatagatgtttggaaggcaacatatttgaagaatggaacatggtctgtttctaatggcgaagaaattctggtaaacaaaaatgtctgttacctacattttactgcatgagtttttttaatatggacttacatattttcttttatttgtttagaacaatctgcagacaacagctgaaacaaactatgaaaggattgcagctgctaaaatcccaatggttgaactctttgcattagtccttggcagaaagccaaaccactcgcgtggagttggtattagtgcaatcaatgagggagctcaagagaggtacaaagttcatgcacaagcagaagctgcccaacagcaagccaatgatgcacatcaacaagctgctgttttgctcgaagaagttcaaaaattgacagtagaaaacttgcaattaaagggcgagttgcagtctcagcgtgaagagttgaattctcagaaaagaaccgtagaggaacaaagtggtcacatggagcgtttcttggaccaggaacttgaggaaagaatgaaagcaatgtgggcacgcatgggtggcactggtggtgcttcatcttcaagtgccccaaacaattaagtaagatttcttacgtcatacatgattactaattcaatctaatggtcattcgattaatgttatttttaaattatatgtaggaatttccaagttgacaaagactggcgtcgtggagttgctacaaagttttgtccatctaggcgagcatcctagagtccgtgtcccaagtttcatttgttgcttaggtgttcagttatcaatttagttatggtcttagttgaaatgctctttgtatgagcactttgttatcattcattaataaaggatagtttcctctagtgtgaggaaccctttttaatttaggtgatatttcaattgagttctgaagtgctctattccaagcatactgtaatcattcatgaataaagaggtgctctgttatgaatgtttaaacttgccattgctctatcgagatttcatcatcagattttgtcattgttcacatgctggatattgtcataaaagacgtgttgtttgtggcaagactttagtcacatatataaaacttgcatctggatatttaattttttagtgataaaagttttccttacagcaataccctttttttctccactgatgcattacttcatatgtgaaaaaggtattgtcacatatacatattagcttggtcactactacatttgtaaagaatgaccagttttcgcaacaaataacacgtcatttcaccacaatatatcttacttcttgtggtttttacttctcaatataaactaatatcttatcacaaaatcccctgtcatatgtgagaaaagttattagcaaaggtatatttgtgatggtgagttatcggtaattagtaatatgtagtgacgggcaaaccaacactaaccgtcgacaatattgtgagaaaaaaattccatcactacacgttcacatatgtgagggcactattgtcactagtatctcctgtaattgtgaccacgataccatctctaatgtactgcttattagttgcgacagtattatcacaaacagagccattatctgtgatgaaaaaaaaatcatcactatgctacttgtgatggcagtagtggtgacaacatagtgacgaccccaaaattcgtcacaagggggtaattgtgatgagaaacagccttttagtgatgaagtttttcatcacaaaagacttgatcccttgtggttgtcctaccaaagatatactccctccgtcccattataagtgtaatggtggttttcaatatccaacgtttgaccgtccatcttatttgaaaaatttataaaataattaaaaagataaagtcacacatcaagtattattttatcatctaataacaataaaaatatcaatcataaaaaaatttttaaataggacggacgatcaaatgttaaatatagaaaaccacaactgtacttataatgggacggagggagtaagtgtgtatttccatggacaacccatctcatacctgttttctttcctatcatacaattcctcactaatacattacctcagatctctaacaggtcatctatgatggcttgaggagactatctcggctctctagtctgatttttcgatgaaggatttgggtgctgctcatcattttttgggcatcactgtcactcgacaacactctgtactgttcctgtctcagcatcagtactgtcgcgtgaaacttgagcgtaccagcactagtacagatccttctatctgtgatggcctctaacatgcctggaaatagcgggccgtcacaaggaagtcatctcaatcgggccaaaaaagtgcccgattgagatatggtcgcatagacatattagatgggcataaaacttaagcccgtcacggatgacacctattaatgacgggctgtagtttaggcccgattaagataacattccatatctcaaacggggctgaagttggggcccatcacagattaccatcatccgtgacgggcacgtagtttaggcccgattgagataacattccatatctcaaacaggccttaagttgggccgtcacagatgaccatcatccgtgacgtgcaccaacttgaggcctgtcacagatgactcatcagtgacggactatatactaatccccggttgacatgacttaatctctatcgggcattaactaaagcccgtcatcgatgagtatttttccattttacatatgaaatgtttatatttgtaagttgaactatagaaaaacaattaacttgcagtataataattcaatttatgagtcaaaataattttacgcgtagtaaatgatatcaaatggaaaagtcatcaacaacaaagttttataactcatcaagatctataacttttattttggtcatttttatttataacattttttgaacagtttgaatttgaatttgaaaatatgacaacttcaaacaacattttcaaatactaaatgatttcaactaaaaaagtaatcaacaacaaagttgaataactcaacaagatctgtatcttttattttggtcatttttctatataacatgttatgaaccatttgaatttaaatttaaaaatatgacaacttcaaacaacattttcaaataataaatgatttcaactgaaaaagttatcaacaacaaagttgaataactcatcatgatctaaaacttttattttggtcatttcttcatctaataaaatgttagtaacattgttcataaattttacatatatatatgtgtcatttcttcatctgataaaatgcgaagaattttgttgttgataattttttcagttgaaatcatttagtatttgaaaatgttatttgaagttgtcatattttcaaattcaaattcaaacggttcaaaaaataatgttatgtagaaaatgatcaaaataaaagttatagatcttgatgagttatataactttattgtggatgactttttcagttgaagtcattcactaacaaaaaattgtattttattttctcaaactttgaatttcaaaattaaaattgtttatatagagtcagatggagaaatgaccaaaataaaaatttcgcacctcgatgagctctacaactttggttttggtgacttttccatttgaaatcatttattaatcctaatttttgtttgaagttgtcaaattttgaaaaaattaaaatttaaattattcaaatgaacttatttgtacaaaggaccgatacaatagttgtagatctcgataagttatacaattttgttgtttatgatttttgatggttgtgtatgtgaatgaatgtatatgaatgagggatggtgtggtgtgacatcctggc

SEQ ID NO: 32335 - DNA, 3809 bp, Oryza sativa
aatgcccatcacagataagggtcatctgtgacgggttatagtttaggcccgattgagataggtcatacgtgacaggctatagtttggctgatcgtctgggtcaaagctatcggtgacgggctttaattatggcccgattgagataggttcatccgtgacgcccgtttgcccgattgagataacttttcacatcagtgacttctagcctgtgacggacgccatgcccgattgagattagggttgccgcccgattgagatgatggtatccgttcttgtatagtatgtctaagactacaagccatgctcttctccagtggataccagtgccgaagtttctacttgtgatacttccactagtatagatccttacatatgtgacgacccctaacatgcttagaattagtgggccgtcacaaggaagtcatcttaatcgggccgaaaaatcgtccgattgagatatgatcgcacatacatgctagatcagcataaaactagagcccgtcacggatgacacttatctgtgacgggccatagtttaggcccgattgaaatatccttcattatctcaatcgggccttaaaagaagcaagtcacagatgatagtcatctgtgacgggcgccaactagaggcccgattgcgataagtttaatgcccgtcacagatgacactcttctttgatgagcttttattaaggccgcgatagagattacttgtatgtccgtcacggttgattgttttagggctgttacagatattggttgcatagtataaatacccccaaccacctagtgtaagtgtatcccactattcactattttggtgggaggccgtagggggccacttttttttctcttttccaagttaaacagaaaattccaaaaagtaatcattgattcagcaatcaagtgagtaatactaatcattaattcagaaatttcatcacttcttactttagcaataccaatcttataagatgtgcctctaattttttttagcaatggatcgaagttggatgtatgcgataactttgaaatttcattttgcggagtacagaaatggcgtgataaattttatgaacgctgtggaggaggataggaaaagaagaaacaatgattacatgtgttgtccatgtgcagattgcaagaatgagaatatgtttgatagtggaggggttgtacacggtcatctgatataaagaggattcatgaagggctatacatgttgggtgaagcatggagagcaagaatcaggaagtggtgcagctacagacaaaagtggtgcgcataatcaggaagatgaagatgagcatgacatatttataccttctccattgggcggtgaaatggttgatgtggatcacgatctggtgcaagacatgttacgtgacgttgagtacccagcccacaatgagagagattgcatgaagttcagcgggttggtcagtaactccgagacgcctctgtatgccggatgcaaagcaaaacacaccaagttgtcagttacattggacctaatgaagctgaaggcaagtagtggatggacaaacaagagttttacagatcttttaggaattttgaaggctatgcttcctgatgagaacacattgcccgagacaacatacgaagcaaagcagattctgtgtccactgaggttagaggtccatataattcacgcttgtccaaacgactgcatattgtaccacaagcaatatgcggacttagatggttgtcctgtctgtaaggcttttcgatacaagcgaaagaaaagtgctgatgaatgcaagaagtcaaagaggtgtggtctggcaaaggttgtgtggtatctacttatcattgatcgtttcaagacaatcttttccaaccccaaggaagcgaagttagtacgttggcacgccacagatagaaggaatgacggtatgcttagagacacagcggattcaatcgaatgggggaatatcgatcgaaaacacaaagactttgctgccgaccctacaaacatgaggatatgtctgtgtacggatggcatgaatcctttaggagacatgagaagtactcacagcacttggctagttcttattgcaaactataacctcccgccatggttgtgctttcaacggaaatatattatgttgtgcttgttaatccaaagtccgaggcaaccccgcaatgatattgatgtatttgttggcagctgttaaatgccgattctataccgccaacatctgcataaagttcatataataaaacatccaacatagtgataggcgcttaatttcacatatttcacaagtgtttgtgtatatttgtatgcaggtgataaaccctaaagttgggaggaaaacaagattaaagtgaggagaaacaagtatccgtacaaggatgggttgtgaacttcatcaaaataccaaagactcagcccaaaactccgagaaatgggcagaggagagtccagggagtccacaggccgaaggccaggccgggagggcccagcccaggttcggccgaaccctcccggtcaccgttgatcctggggtttggcgtggacgctccagatgatctcctaatggcggttgcggggcagttcggacatttccccttctcacaaccatcataactgccctataaaaggagcttcactccttcactctcacacacactttcaagcttgagctgaattataagatgccctattatactatgttgtataatagaataggaagagagtagagtagaagaagtcggaagaattccggagttgttggtaatcttctctcatttctttttttctgttcattactctgatttcaatataatatttttcttgagtaatttagatttatcttgtgagaattatctcttggttagtttctaaatagcgtacgggattattgttcactataatcaactgaaatatagtgattactttggtgagttataaacactaaagtagatattaattgcttagacgtagtgtttatgtaattgttatccagtaattgctccgtatcccacagtacgtttgaggtaggtgtagaggtggtgatagccctcgagatcacttaagtcctccctgtccaggtacgtagtagagcgacatctgggaacagcggattgccagtgcctgaagtattgtgttaggattaaatttaagctttccctagacactgtttctcaccagtgaatcctctctatcctggccaatcctttgcttggtgtccttggatgaaccggagaaagaactgaccacacacgttcccttggattcgataccctttggaatactccgtgggggaagtgctacatcggtatatctgtgcgcatgcagattttatctgtgatcgtaagaattaccaataagcatttctggcgccgttgtcggggaatggttgctgatcatttcagaacccagttcatcctcgtatttctttttcactttttattctacctttacccctgctacccagagaagtattcctgttaaattcttctcgactatagagcaacctctctttgagctgtctgcttctaggggcgaattctataagccacctccttcatcggagcgcatttatacaactggctatgaaattcgctctgaactaatcagcatggatagggaaaatcctttttctggttttgatttagaaaatccctaccatcatctgcgagactttgagcaagtctgctcatgccttaagattcgtggcatgagacaagaaacttgttaacagtgaaatttggtaagcccggagtaatcatcggcttagagtcagtatcggcttcgaagtcctgagattagccgatgagtg

SEQ ID NO: 32336 - DNA, 3076 bp, Oryza sativa
agcttagacatctaccaccgtaaaaactcaatcaacggcttgattgtctagatattatgtttcttttcatacttagtgttgcatcagttatgttttatctactaagtcgtgcttagaaccataatctctagcctgcttctagattgccaataagggtttcatcggggtttcatccggtcagttatttagacgttgcatcggctcataaggattgcatatacatagaagttggatttagccgataacaacaaaggtttcactgtttaatctaatcttgtggatttcatgacatcggacctctagccgatgtgtgctttaaccttcggatcgatgcttatttatcatatcactatttgccgattggtttctactggattatattgctatattatattatcatcagtcgattgcctttatatcattatctacattggacatatagccgattgcttaaccctatcgctattggctggtatcggcatcggctattatcggctatcggttggaactactccatcggcttgtcagccgatcggctgttttgatctactatttgcatatcttgtcagttgcaggatcaaactgactggcacgccctcatctcaacaacctttggacctgcactggagctaagcagatctcccaggccagtgtattcgattttttcgtcaacaaaactgtacggtggaaattgtttccgttctcccttcaagagagagcgaagcaatggtacacctctacagtcagatgtgtaaacgctagctgggaaaagttgcgagagagattctgtcttgcatttttcctagatactcgtattactacctttcgagtagaaatccttagtttccagcagatcaaaaacaaatcaatcggtgcggcttggtcaagattcgctaatttagtacagtccggacaaaccctgtttatgtgctattgcaacatttccatacgggcctggataaggagtctgcattctatctggattcattgatttcaaaatgttgctacctattgcaaaattagacatttcctatctatctagattcattgtactatgaagtacaacactccctccgtttcacaatgtaagtcattctagcatttctcacattcatattgatgctaatgacatatatatctgtctagattcattaacataagtatgaatgtgggaaatgttagaatgacttacattatgaacggaggatgtatctaattaatcatataccaggtagtaatattttttataagtaatatatgaaaatggcacttccccacaaagcctatatgtctttaatcgtaatctatatgattaagcgggattgggttaacaaaatggctctcgaacatatcctttagctccaggctattgctgaagccattcttcttgccatggtataggagggtggcggacatgcacaggttggcgatccgctgcacgaacgggaggaacgcgcggtgcttgaagcgtatctggttcatgcttttccacccgtcctcagccattccagcgatcttcgcctcggcgacctctctcgtcaccccgtgctcgttcatgtaacactccacagtgctcgccacatccatcttgtccctcccactctgcatgcatgccaattaatacatatatttatagttagtatttatacatatacatatacatatatatatatatatatatatatatatgccaattaattaatactccatccaaaagtatttaatatttatttatttttctgattcttttttttttgaagagggtcctatatgtcatcttcggatatccaaaacatatatgaataaataaattaaattattaatcagaatccaagtagccatctaaattttcattaattgcatgtagcatatacattttgtcctcattacacgcaggataaattaattactttttggtgataaaagtaatactgctacatctttcgagcactattagaaaaccgattttttatcattgtacccaaaacacaaatatgtcagttagatttagaatcggtactaaaaatattttgcagtacctgttctaaaagtcgaagtctcaaaaacgtttctactttcgattggtgttaccaatccaaccgaagttaaagatggagaaaccaaacccgtactaaagataccggatggtaacaccaacctagaatgtttttacggttttagtacatgttagttaaagaagaaagcatctatatcaaagttagttatgtatagtaggtgagatggtaacacaaatgaggactgaggtgagagaagtcttgagtttgaatcccacatccgacagattattttcatttagtatgcatcaaccagtactaaagatcgagaataaaaataaaggggattttaaaccggtaataaagtggggtgcacataactagaaataccaaaggttgtacagtggcccaccactttgctattgacctttgttattttaagcatgtgtttgtgtgcattcgtgtgttatgtgcatgtgtagtactatgccagtcgtttgcacctctagtgtaatcgcaaaaaataatgtatattaaggacatgagcacgtccagtgtacactaagttcttaataaacaacatgctcggaacattgttcgtaaaatattttcccttttattgaggtgtcggctagccatataatatattctcggtattcaaatatataatattattgactttatttggttcctatggtgcaatttttcaccactaattttctattagactataacgataattaaatgtctaactaaattataatatgggtcaagacactaaattataataatgtaaatgtgcttataaagaaaaagaattatctgcacgaattttatgtttgagactcgaagtttcaaaattttgatcgaataaatttaaaagtgacgcataattagatacggagggagtattatttgtttatgctcaggcacatgatcgatacaagcgaaatcaagatcgtgatattaattaaatgacctactttgtatagtttgtattttcaaaaagtagcgttaaatggcattactttctccgtctcaaaataacaacatttcggaat

SEQ ID NO: 32337 - DNA, 2900 bp, Oryza sativa
  unsure (1)..(2900): unsure at all n locations
ttgctcgatagtatttgaaactgcatgtagccaaaaaaaaaaaaaaggggataagcacaaactagtgatcgaagaagacaattagtgttttctaccttcaggtaggtaaaatgcatgattgtcatcncaggttttaacaagtttattggtccactaaattattaattagttaacatatatattattccactacttgttaagtagtggcaaatttattttatggtgttggattgtgagatatacactaaaattatattccaagaaaacagtacgtggccataagtactttgataaggagctagagactggcgttttaccgctttaatgttgtaagaattacgatatttctcatgtggttccaattcatcctcaaactccctaaagttacttattatgctcagaaaaaatctcttcaggtcctctggtagaagtgaaacgtcactcttgtcccatctgcatataattatatagcacacacaattaatatacgtgtctgcgtatgtgtgcgtgtgcgtgtgctgctttattaattattacttatcgaaacgaaaggcaagaaaagaattgaagtagaccaaacctttgcagagcatcgttaaacttgcgagcctcctctaaagttgcacgcacatcgtatgtatcatcgagcagtgaaaatagcatacacctcttggcgaatatcatacgggcccgtgcgtgctctttttcatagtaggcagcgtatgcacaaaaatagcactcaaccacacgttcacggacgtagtcgagtctaatgtcacttgaaagattctcccaccacctataatatatataatataatatattaattctattttctcgctacaatgattagtaataaaatcatgtggggagaacagcggcgcagactagaaaacttactgacaaatttccttgagttcattttggtgaactttttgtagaatattgaaatcaagcacggctagctccaaaatagagggattgaacattttctcttcagcgctatactcgaagatataatttagcacctctactctcttcatggtccttggtaacggtatctcaagggcacgtgttacttgttcatccaatgggtacgcgaggttgcctctcaataattgtaggtgatgccttgcaaacaatatagcttcttcaagtgctttctcgttgtgagttagaaggtgagctgcgttgtataaacttaacaagcccttcggatcattagttatgtcatcactactaaagctcccatcttcagctttgaatttgttgaattcatctgtgttcagtacagaccataaagatcaatcaaataatttagaataactaatgttgtacatattctgcttagtagacttctcagttctcacaagtcattgaaattatgatataacaaaaagaatggaaattcaagattcgtgtggaacagaataatttcactgaaattttccaatgaaggagtaaaaataatcccacactccaaatacatcatttagtctaagtgtgttattggtatttaattcactgttgcagtatatgtacctggcgagacccaatacccttgtttcctaagtaagcgaaaccgaagggcaacctcgtaaaggtcagagctattgaactcagctctatgaatattttttagaatggtgtcgatctgctcctcaaaatgatgatctattcccaaacgttggagcacatccaccaggttcatttgctttaccacatcatccttgcaaacctcaagcattctacctacctcctcaaccaactgatctactctctcttccatccattcatctgactcctgcaagatacatggaaggacatataggcaggtagttacttttataaacacataacaaattattttgtaaaaagtatcattttgaaacaatcttaaaacaatatttaattttacaacagttgtatgaagagtatttcccctaccattttggtgggggttactgctagccggcagtatcaagattactgcagcgaccatgtggttttaccggaaaaaccgtttggtaagagtgaaattcagtgaggttttaaatactgataagggcatgtggtaaccgcaacaatcttacggtaactgtgcgatgttaagaatccttcactttgtatacgcggcttaaaaaacaacttttcctgcttctagactttccattttcagaggtggctaaaatttgtaaccacctatgatgaagatgaccgatgcagtctccggtaattagaccgtctgtgaaatcatattttgacaagcagtgtcttaagaaaactgcatatgcaaataaaccaattttcatgggtgtttagcctatagtgaaccgtctatgaaaatgctgataaaagtggggtaatttttataggtggtactatctataaaaagctctataaaccaccctttaaaatgggaggaatagtatttaaagaaaaaaatcataagtctttcatacgaagttggataaaaacaaattttatatgaaaattgtagcactagatgagatataaattttgtagttgaaatttttttcatgtgagattgtttaggggtcgaaattttctttagaactcagatagatacctgttctatcaaaattagatcttgacaacacctgcatctttgtagttgcaagttttttccacttgagatcgtttagttggccaaatattcagtacagtctctcagatataattttttattggcgaatcatatggaagtcgaagctttcaaatttcatataaaatgcattttatgtccgattaagttgaaccaaagttatgcaagatcattgcaacatttcttttaatattgggtgatctatattttctgacaaaatttgctttactgtggtcaattacttatgttaacttgtatatagcatgcaaactct

SEQ ID NO: 32338 - DNA, 3000 bp, Oryza sativa
attcctgcagcccgatcatagataatagtttacctcaattaatcataaatgaattttcacatacggattgcttaagtaaccacataggtactaatgaattactgcagatggttctcttaatgaacctccttcaagaatttttttttaaaaaaaacataattcaagagaaaaaaacttttacacaaatgaagttagatgcacataaattttatacgaaatttattgctctcagtgagatctaaaatttttttagttgatagcgcttttttccatttgacattttcatattccctaatatttgttacaagctattagaacgaaataaattttagagttttttgaaaccacctcagatggagacgtgctctccatcaaaattgtagaggtcaacgggataagtttatgtcttttcattagatgccatctgtagtgccaaatatggagcataattttttgaaaggttaagtcaaaataatagcatacaatcacatcgtggttgtcggtagttatatccaactatatacggtaggacgtaacatactagtagtacgtgataaagagagcagattcccgatatggaatctgtgcctatatataaatcgcttatttttggctgtgtttagtttcacgctaaaattaaaagtttaaagaaattggagcgatatagtgaaaaaattgaaagtttgtgtatgtagaaatgttcgatgttatgaaaaagttgaaagtttgaagaaaaaacttttaaatcacgcgtgggtacggtgactgaatgcctgtacgttcgtagggtatggttataggttaccacccgtacgtggtaaaaatggtttacctagctagctaacagtacgaatgcatgcatgcacggacgtacatgaacatgtacatatattgcagtacatactttgggtgatggttggacgttgttgatgaagaagtcaccgaatatcgcagggtggaaagccggcgccatcttggcgtcgggagacggcgacgtcgcggtactactgcacatgcagcgcacggggcgcgcggcggcgtgggaggacgacggcggacgacgacgagcggcggcggctggcgccggagccgcagtagaaacgggcaccagcgagaggaaagccacgtggctcttcatcccgatcgatgataccattgtataccaattaagtgtagtcgttgagatatgtatctctattaataattgtaccaaggcaagtgctttaatacttccaaggcgcgcgcggcgccttttatatataggagctcaaaaccggccggttactaagtactccactactactaatcaagtgaaaggtaattcactaattaaactagttttagccaagtacgtggaattgaagacaagtttgttacagtaggagaattaagtacgtatctcctcagagaatatagttggttaagtcaagccagttagccagatcatatgctacccataattcccttagatcaatcgaccacgtggtaattaactgaatccacgagaggaatgaaattaatattcaaaacaaagacaagtccgggtgtaacggtacgcacgcttttcacggtttttaattatagacaccgttaatttttaaacatatatacgtttgatcattcgtacaaaaataattaattttaataaatttcattgtcatttgggtgctttaagcatgacttgaatttttatgtaattacacaattctttttagtaaaacaaataatcaagcgtatatccaaaatcccatgtgaaatcgtacattaaatatattgaaccagtcttaaaaaaaacaatatattgaacccggtgggagtagtatatacatattttctttgtacataaggaagaagaagtgcatgcactaggtatgcaaattctacaagctaatggtttacttaacttccaacgacttttcatagcaaaaaagcttctaccgtgcagtagcgcactatccatccatccagtcaaaaaaatttcaactttggctgttgacatttaccatggaatatacaggcagtcaaaaggcgtgacagacctccgattgtcgtaaaaacaaaggatggatgagtcctactcctatactcctacgagtctccgataacacacgacaatttttatactagcagatactcccacatgtgctgctagcaggccggcgcagctgcgccagctaattaactcgtgcatcctatcatcgtaaagatactaccattagtactgacgtgtagaataactcgtcggtaccatgcgttttgtcgtgggatatattgattaatgatgttatatattttagaaatgatatatatatatatatgcatgttcaaataatgtaaaaaatggtatatagataatgattcgacattgcttgtatattaaattctaaaaatacaacaaaattataaatggtacgtcatttttgcatgatatttaaaatactttagataataattgctagtgggtgatgatgtggcatacttacatgttaaacttaagtagttagcgtgcatcaactttatagtcttttaattcaaattttaaatcttttaactgcaaaattcgaaaatttcagctctaaatttaaaattttaattttaggtacaaatacagtaaaagaaaagtcatagttggtaccaattataacttgtatgtaacttccgtaattttgaatcgttagatttattacaagatttgtgcatgtgtgataggatttgttctcacgacctccattttacccaaataacatgttatggagatatttttgaaagttacatcaagttaaattatagttacagtgtaattacatgtaagttacattgtaattacactacgattttactttaattacatatgtcatttttttgggaaaacaattgtggacaaaaattattgtcgaaagataactgcgtcacgtcaaaacatgtggttcactcggtgagttgatggcatagtgaaagcaatatattaattgataataaatttttaggggctgcaggaat

SEQ ID NO: 32339 - DNA, 1950 bp, Oryza sativa
tcccccattacatggcaatatggggctatttatagtcttcgtacagactcataccctctagggtttagttagtacagggaaatttatacggatacccttatgatagaggcattagtgaggatacatgttgtcttttgtatttatgggcaatcaggcgatcttcttgggctggcccattaatggcgaaaggcatccatggcctgcagtgcctcccaagtcctcagtcgaagacacctcctacccgggtgaaggcctcctgcttcgctctatggtcttcacccatagtgatggcttggccagatggtgagcttggtggcgaaccattcagttttcatcgttcggcttcgcctaggcgcttcgccccaggcgcaccccttggacttagttaacgccttatggtttcggtggtttcggtaggtcaggtcgaaggtcctcgtggcatgcctccagcaagctcctcactggcaagggtgagtagggagcttcgtccgaccaacattttcgtcagctttgatgggtgatatcatcttcatgttggtcatttcatctccatgccgactgcgtcagctaccatcaatggacaattgtgactacaacagaaggataagctaaatgcttaggggctcatcaacacaagcgcgaggattatatcttcaatttggacttgttccggatacattcaacatgaattcatggtcacgagtcgatttcccgtgctcaacgactggaccactcattattccctatgagggctatctgccgagtatttgagccagtcaggattaaattatcacatcctctttagtacatatcatgagggatagctacttggatcaggagctattcagatgagatgcagttgatctatatcattcgggagatttgttacttgggaccatattaattggcatactctacacgtctaattttaagggtatcggtaggcatattttcgttctaggcctaatatgtctgcagcccatattttcaggtgtggcctatcacgcttttttagggactttggcatcatttttcttaggcaaaagtgcgcgtgatcaagtgcctaataccttaaaatccttttgtacctcagttactcaactttttaggagttggtacaatgcattttaaaatgtgccgaacaatgaagctttatatagttgccccactgaattattatatagtcaaggcattgtttggttttataaagcaattgattggatacaatgttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaatgaagatctaagcagcggaaaataagataaacggcgcagacggctccactccacaggcagcttgaccaaggctacacctaatcctccacaccatcaacttcactgtagaactcttcctctgatgaatgattgcaaggtgagtatatgacatactcagcaagccacgcagcaaatatgcaagtgcacaggataacaaagaatggcatagtagggtttcatttgcaaaagcagcatttagcaaacatttgagaatttaataaaactgttaagtaattaaacaatattaatccaacgctatacaacataccctgttgcatagggcccaaccattgtgaacaaccattcccggctgcacagttctatctccaaaccaggaatataccattccaaaccagaagctaatcaaattattaccagttaaagcatcatttactatggtagaagggtgagcctattcacgaaagccattgttcgacccgcccataccggcgggcacggctattcgaataggcttactctgatcagaggtgtaccactgtacccacaaga

SEQ ID NO: 32340 - DNA, 1247 bp, Oryza sativa
  unsure (1)..(1247): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatgtccagaaaagatccctcctttttccccttttactgagccgatagttcacctgaaacaacaagagaaaatgtgtgaattcgtagcggatatgacgtagctttcagcaagcaacttctcgagtcgccccctgatctcgatgggaatatatatgcacaaaaaagcatatcggggcatagccatagcccacaggtagtctgggcccaattcccatccctagcgggggggtgttcgcggcaacggtgaggcgacggaatttgaaaaaccgaagccccacgaagattccagcgacgagtcagatctgaattgcgagggaaccctagaacaaggacgaaccgcgcccaaaccctagacgcacagcacaaaaacctagccacccactcagaatctcccgcggctcgcgcgtctatacgtacagatccggagcctgagcaatccgcaccacgcgatctaagccctcaccacgaatctatctagtaagaaaaaaaattcaaaaaaaaagttggggaggagagaagtggatggatgcagcaagcggtgcagaggaggggggggggggagaggagaactcactggattggacgggagacgccgccgcgaggggaagagaagatctggagcagccgccgcgtcgaggaaggaggagaggggtaaggcggcgcgcggaggaggaagagagagagagagagaggcggagtggaccgagcctaccgactagataaagaaagagcagagcgcgtggcgtggggggggggatggcccacacggcagtgacagcgtgtggaaccttgctctttgcccaactcaagttgccgacgcctttcttttttttttcacttttcgttttctttcgaaaaaaaaaatttgaaactggggtggtagaatgttggtattcacaggaaccgttggatcgagaacgtgcgataaaaggagacaagcgaacgcatcctgcctcccaactccattccgagttctgattaccagatggatttactgggcaaag

SEQ ID NO: 32341 - DNA, 5773 bp, Oryza sativa
cagtgcgttcgtgcttggggtacaccaccatgattcatgtttccgccaactcttcgtcaaagcttcatccgagtttggtgttaatcaagatcaacaagtcatattagtttgatgataatcaaaagaaatgcgatgtacttgtagcaacgaccaaacgaacaaagacacaaagacaagggcaatattccagtattactaacagcgccaaagtttggacaaacttaacgagtagcaatccagtgtgcaatggagtaactgcaacaacgaaataacatttgacataacttaggaaaggtgctattgccctgaagcaggtcctaactccaaaattttacgagcatttgatgcgcaaacagtcaaacattcaaccatgtttcacaggcttatctcagcaatggccctggacagcaaaaaatctcaccctagcagtccacatctgaaagcagacggcttcagttgcgcctgctgctccaggttgaggaagatgatgaacttgagtatcttgaaggtcgccatgtgcctggaggaccatcttggcgggctgggggagcagcatcgcgagcagggggtgcctcttggcggagcggacgcatatcaggacgtgggcgatcatcccgtgaaccccaacggtcttgctcaggtgccacagcaggtctctggccgccagcactactgccaccatcaccacctcgtttaaacttcgggacatacttaccagcagctggtgcagcagcggcagcagcagcagccggtgcagctaccggctgagctggctgtgcaaccggagcagcatcaggagtgcgtgcaggctcagcagctccagctcctcttcccatgagagcttccattctctgtttttccttcttctcttctagttccctctctctctgcagctgcttggctgcaattgcatccagcttagccttcctctcagtctcttccctctttctcctctcttcctctgcagagaaggtgaaatcattatcaacaatatgtataagctagaatttgatttcattgcatcaggcaaaaaaaaaaagatccgcaagataattatgcacaagcaaatcacactttgatgccaaataacattttaagttttaaagctatccattgtctaagggcttgttcactttgatgccattttcaatcttaccaaattttgttaaagttgcaagaaaagtggctacatttagtttgttgccaaattttggtaactatataagaaatcctgctaaaattttggcaagttgccgaaattttggctatgccaaaatttggtaaggttttttttggcatcaaagtgacaggccctaagtaacacaggtccatactgcagtaaagtcacagtaattcaacaagcaatgttcactaattctcaagaaattccaaaattagctggacgatatatggcagtgtaaattaatctaatctaataaggtaagataagaacaagtatttcaaagcacaaagtcatgaattcttgccttcacgttttctagcttcctcttcctcacggagcctttggaggcgctgctcttctaagttaagatagtacattaacttccgcactgtatccctttcacgcttccttgatgatatcaattgactagtcctttcatccctctctttcttaagacgactaaactcagcttcacgacgttggacaattctttcctggaaaatgttctgcaagcaaaaagggcaatttaaaatatgtgcgaaggagagaagacagctgtctattccctgacaggaacaaatcgcctggtgtattcaaatgtctagtgctcaaatcatgtgaacacacacatagccaaagaagacatgccaatattagattctcagcaagtatagcacatattatatgttaaattaatctgtatctaatcagacctttgcacagataatatactaagtatttcaactgttatgcttggaattgcaaaacatggtttcggaaaaacacaggattaattacagtgggacatttggtccttcaattaactaaaaagaagatgaaatagtgcaagaatatctggtctgaatacagatatgtatttgcttaccttatgctccaacattcgagaaagtctgttcttctcctgcaggtcacctgcatggtgttgcttgctgagctcaatctctctctacaagaagagattaatagtgatttttgtgagcttaagtaatcatatgctattgtaatgtgacaatcaaggaattgtgagaaacaaaccagctgctcttgctcatgaaggattttctctacttcaaggcgtttttgaaaagcttgctcaattagaggtgcctcttcctgcctttttgccctctccaagtaatccatttgcttaccagtcttctgtagttttttctccatctcttggcgctccttaaactgctcattcatagccaattccatcacagcctccttagtaacttcctgcaatgaaaacattcaaagtataaagggcctgtgtggagaaacaaatattaagctgtaattggcttgggatagtacaactttatagttccgacttcggagaagacaatcaattcttaatatgaaacaagagtaggacactacagaatataaagattcaaatatcatctgcgttctgcgttcttgtagtctataatggttagccacaaaacataaaaaacagcatattagcacaccctctactactccactagaatttctgagcagttaagacaaaaaagaatcaatattggactgaacaaacagacataactaataagcatattgatgaaacagaagtcttcacaacaaatataatgccttacacaaaaagaaatatataatgaaatatcgagcaaatataaattgagcaatacattaaacagaaaaaaaaacattatcaacaaataactagtcagcgtaataaataaaatataatgattggaaactaattattctcaccccctgaaggacaggtttttttcctcctctctttgctatctcctttatctgtttctgaagcagttcttctgcctctatcttttctttttcaaccaattgtcgacggatcctctcctgttccctcaattttacatcattgagaagccttatcctttcatcttctgcagatttcttgagaacactcaatctctttttttcttcttccttttcctggaaaagagagaatatgacataagcagaaattcacagagttggccactttgaacagtaccaaatagacaccttttccaatatttggcgctcaagatcttctttgcgtttttcaataattgatttcctcgcaagaagacgcttgtgctcattctccactactgcagcaagactcgttaagttttcaccaagcttggatggcttcttcacaggtggatggataaggctccttgctttatttagagaatcagccaaaacacttaggtgattactgagacaatcagattcaatgtcctacaaacagaaaccagtcagaataaaattgatgtcacaggttaataattaataaaactgaagtcccgaaattgacagcacaagaaccagtactgtctgatatttggcattaaaagcaaacaaactagaacgtattaaaaccaaaagataccaacatcaggcactacatagtcacttgaaaatctaaaaaataaaaaataatataacatagttaaatataatgttgagaatgagaatgcgagttacagctatgtacaattaccagattaccaaaaatgtctacgacagtgacacctagtttaaaatctgaagcaaaataaatcaagcaagaattttcttcagactttcttttttattacaaataacatacaatacactcgatttggcaaatatacctagggctaaatgccagttccataaacccagtggtaaaaacaagccacatgaaccagttagtggcaaaaataagttgacaatattttatcatggaaaacactctgccacaaggatctgctggttccaacacatagcacaaatattgtaacagaggcacaaagaaccatgccctaagtcttagtggtaagacagcatatacaattgagtcaacacatttttgttctacactacaaaggctgtcgaaagtgaatgaaaatagtggttgtcatgtaccaattgtatcttggccatcagttcaaactatggtctctatgaatatttcaactttagaggaaataatttggcgaggataaatatgcataccacaatgaacagaacaaccaacttctatactgatgcttacagggaaataaaacaataaaaaagtaaattccaccaataagaacactgagaaggctaaagtggccaacagacttgaggaactaaaccacataccattttcccaaaatggacagctcctgataaatggttgactttcatagcaacaaaattgtgtttcacggcatcaacagagatcttctcaacaacagaaaagtcaaagaatgggatcattcttgagagcatatcaattttcacagactgaaatatctgggaagcctgaaaaagaacaaaagggtgcataaaccacgtgttaaccaaagaataacgtaaaagatcatgagaaaagagaacttatacttcctgtacagtgtgccattgaacatacctgttgcaacacccttaaagttgttaacttctccaaagcaggaaggtactgtgacagaaaaacttctggaaccaagggagctgatgaaagcttccctccaatctttgaaatcttagatagcagtggctgtgctttggatacgagatccagaggaagaaaatcgtgttccaaaaggttgtataaatctttgacatcttgtgaagcacaggcaatgacacctttggcagcctaaatttataaatatcaagtcaagcaagcacaagaagagaaattcaattatgcatgataaatggagtacaaattactggatacaaccctaccaaccctataatactgacaaaaagaattgaatgaactatccatgtcagctatcccatcgacaactgacgagagtgcaaaactcaacagaatagtttgataaataaaaggacccaggattcagcacataccagctcagaaaaaagagatgctcttgatggctgcaatggtgacaggagatatgtcaggaagataataaataaaattattcaaaatattctttgctttgaaaaagatctggagggctaaccacttctctattctcacgcttggagtcaagggagaagttgacgagattagctatccgcagattacgatctttctcattttcaagctcaagatgagatgcgccatatttatggtcatatggtgacacggcaagtgcagcaagcaaaacagaagaagctattaattgaaggtccttctgagacaagttcttattgtagcttttctgcaagtagaatagcttaagccatgcatatgcatgatacaagtggcaatcagatatccagaatatttcagtcaacttggcataatacacaaccaggacagatggttttggtgttttcttcaccatgctcatcaagccatggatgtcttccacagacctaaaggcctcctgcaagaagcaaagctttacgatcatacagcaaagatgattcacttggcataaaaaaggttaaaaaatataaggaacggacctgccagagagagagctctgtagcaatttttagttgttcaactctagtgtccaggtatagctgtaagctttctggggcagtcagatcaggacgatctcgctggtcacggtatttgttcaagttagcaagatgatttcttattat

SEQ ID NO: 32342 - DNA, 12362 bp, Oryza sativa
ttgttttgaagacactagacgggcagaagcgcagcatcgaggcaatcacgattaagatcattgattgtgtacacaaaatggaacagccagatgaaatgccatgtcatgtgtgaagagtatgtatacaggaataaggggaacacagatagaatagcttacagcatataatgcttcaagctttgaattgtttctcaatatctcaagaactgttctgtatgtttcccagagaaacttgaaccatggtgtgacatgctctctgtctgatcggtccttccctttctccccgctgacatagctgagcatcaaatcctcaggccgcttgtctgcttccagatcttctacatccagggcatcttccagtgcttgcgcctggttccttgcttgctctgctttctcattggaaagctgcatgaagtgttttatcacctcctccaaggatgacacattcacttgctggcagacaatcctgtactgaataaggccatctttcgcaaacctgcccttcctcaggtctacacagagctccacatacttcatcataatcctttcgagtggcttttgccatgacctgtatctttttgaagtgatgagatcatgtaacgcctgtagcgctgcctgcttctgcccaacatgtatcaactctgaagtagagcagagggccatcatcagtaaaaataaaatgttttccgaagtatgtataattgaacacatctaagaactagcacgaacgaatcaacaagtatttctgtaagattgaacgaccagccatggtctgttaatttgtctatgacgggaggaatcaaacaccgctcttttcgaattccatgcttacaaaacagtgaaaactggtcccctaaataaacataacagatccaaaggggactcaccctccgctctcttgagcgcgttctcaggtttcgcgaaggtcgccatggccgcggttggatgtctccggaagcgatctacaccttcatcacagccaaaacaaacagcaaaatcaggaatcaacccaccgattcacctcgaaccacccacaaaaaacaacaccaccaacgctccataacctacagaacaacgaccccccacccccacctcccgaacagatcggaaccgaccgaggaatccaccacggggggaagccaccgtatgatgagagaccgggggctaggaggtggcgacgatacctgtagatcgccggagacgtgcgcggtggacggcgccgtacggccgtccgaggcgaaggcggcggcggcgatctgggtggaggggatgggaatggggggtggaagcgtaggagagtggaggcggcggcggcgcgggggtgaggggtttattagggttgcgagggtccaagtgaaatacgacgcggcccgcttccgggggttattcctgacgacgtggagtgatctctagccgtcggtttgtggggttgggcctcttctggccgtccgatctcgtgggaggagtccttcgggtttccttatttttttcgcctgcacacgaggacaagcttggcccagttcgacaagttcggccacttaatgggcctactttcaatagtactagtcgtctacaagcccaagaaatcttgatgggccttttcctaacaacaaataaaagaccaaaaaaaaagagaggaaattttgctagactataaaatgaacctgagcactcaaagaaagttaggctcatctcctgtaaaaagaaaaaaaacatgataatatcgtgtttatttagtgctcaattggttaagctacgataataagctatacaaaaataaacgaaaacctaaaatgattttgggcagcaccttcttatttctactcttagcgggttaaatagaaaactatgaaaaataactggattaattcaaaactattttttataatttaaatttttcgacatgtttcgtcatgtggctgagttagaatgcacatgagccagttttgcatactttatactagtgtacttaagtcagtcaaaatgtttttttttaacacctatcaagattttcagaatgatgagtagatttgagatactgacctcttgcattgcttcaaaagcaaaaaagaactcttgcattgctgaagagcgaataaataaacagataaattaacatttctcttaggattccatctccttgattgccgtcacaagcactgaacacaagaggcagagatttgggaatatatggaggggccaaatgccagatcctcagattttagttaggttggttgaatgcaagctggatccgtcgtcgtattctcttagcaacacgcacatcttaatgctgtataatctatttgtttgtttaatcttttgcttgcctagagcagcagaataatagtaaaaaatgcactgtgtttagttataaaatactcctacatctttattttcttttttgctaacacaaacatgtcagctctcaaacacccaatacttttgaagttgataaaatttataaaccttgattaatttcagagtcaaactgaataatgtgaagcatcaggattaaccccctcgctttgtggactgttaaactgcagagcatcaactaatcactaatgctgcaatctgcagacatataccttcagaactctgccattgacacttcagctgcaaatactattatgtttatcactcaattgacccatcaattcagctggcttactctgtaaagaaagaaagaatgaaagaaagcataatagtttttagttcagtttgtggcttccaactcaatgcttgctagcttagcaaaagtggtcgttggtgtcgggcactgccagaatgtgtccatatcctaagcagcagcctgcaaaaccaagtttatctttttccccaaaaggctagataattattaacatcctgcttaagcgagcgttaacacctggatggaattagcatatatatataatcatctcgaccgtatgctagttaagaacagtgacatctcaccaaaagactctcgtcaatccgctagttattagcttgatgccactaatcttgttcctgctgcatgccaacctgtcttgacggcccctctcgctgccacgttttaagcatccaaactgcggtcatatggccatttttgatcggttgatcctagctaagtcgtagataattaaatcggattagcattagataatcaagcaagctgctcctaaccccttacacagcacactaatcatttgcttgtcttcttccctgcactaccaaccaatatgcaacttgtgcctcctgcatatagaccatctcctccattgcttcttcatcaccatctcattctcattctcttctctctctagttctcatggggatcacgccgtcgtgcataccgctggctccggtggcgggcggctcgtcgtcgacggcgtgcaagatcatccacgtcgatggcacggtgacgcggctcgcgcggccggtgagggcgtcggaactgatggtggactacccggggcagttcgtgtgcgactccggccgcctcgccgtcggctgccgggtgcccggcgtggcggcggacgagctcctcgagccgcggcgcgcctacttcctgctgcccatggacatgctctactccgtgctcaccgacgaggagatggccgcgctctccagcttccacgccgccaccgcggcctcctcgtcgtggaagaggatcgccaccggcggcggtcgccgccgcgatgggagccacggtggccggatcagcgagccgacggatcacgaaggcgacgacggaagcgacgatggcgccaggttctttccggtgctcagcctgcagctccacgccgcgccggacgccgccgccgccgccgccgccggagtcaagccgagcggcggcggcggcggcgtgaggcggcaccggtcgtggcatccgaggctggaggccatcgacgaggtgccgtgcaccggcggttgatcgccggagacgtaagcggattgcttttgctagtgttaggcagctagcttgagctggctctcgagtgtacattagctagctctagctatttttttcccttatctttttcttcttcttttttccttttattttttttcttctgtaaagttcaatttttttggcctataattgtttgggattttgtcaccagaaagcaaaatgccctgggtatgtgttccccaaaatctacttctcaattttgataaatacgccaatgacactgcttttttttcagcattttttagagaaatatgcaagatgtcgcccccacaaaaagaaagaagaaagagaatgatccttaaatgtgattgattgcgtcatgagtggggtactatactataacaacttgagctgagcagccggcacacaggctgtagagaacaaggtgatatgctgtatatgaagagggagttggagctgtatgctactctgcacctgcaggatactcacagataatctctgtgtgtgaccgggcatcagctgtacataggagcaacttgcagggaaaacaacaaagggagggagcaagtttcaagggccccttttatttgcatgcaccacaccatgtttctttcaagcaaacaatgagatatcattagatatgccagtgcattgtatactagctctctgtgatcatgtagaaaaaaatcagagctaattaattagtattagaattttcagtcaattcagaggaagggcctctgggtgtagatttttcagatagtttctgctttgatttggtaaattccaaactgccgtatttgaaacggggacaatttcgtcggacgactttgaaatttccggcggatccatgatgatttttactcattcttaaggctctcatagtttgtcttttggcttatcaggcgcaacaaaaatttaaaatttaaaacttaatttcagggttgatggtgtgattttttatcgtagtttatttttagcattagcttttaaaatcactaaagaacataaatataaccctctaaaaaaggaacgtaaatataaaattttaacccataaattatgttttaattaattcgtttatattatctttttcacggcttattaatgaacgatctaaccttaaaactcggcccggtccactaataaaaaatcagcccaagccccaacgaccaacggccttccttccgatcaacagccgacgcttcccgcgaaatccggcctgcaccgttataccttacctggtcccactgtcacatggtccccatccttagttggtcccacaaatcagcgaccaattcccgcccacccgacgcttctcctcggtccccgctgcaaatcccaatcggctctcacaccgacacgtgggccaatcgagccagggccccacctgtcattgacccttcttccaagcccccacccctcggatcattcattcactcgtcgacttttcgtcgtcctccgcgacgacgcgaacaaattgcgacgcgacgcagcggccgggctagggctagggctagggtttgaggtcgggcgcgcgcggcatggcggggatacggtggccgcccgaggacccggagatcttcccgtcgaggatggtgaccggcggcggcggcgggggcgcgggaggaggaccccccgggcccccgggggagatggcctccgacgacgaccggtcggtggcggcggactcgtggtccatcaagagcgactacgggagcaccctcgacgacgagcagcggtacgccgacgccgccgaggtcctcctcgcctcctcctcctcctcctccgccgccgcctccggccccgccgccgccacgacggcgtcggtcgccgccaacccctccggagatttcaggttaagagcgatccgtttctacggtttaattgctttgttgtgcccgtgatctgatttccttgtgttggggggaagaagaggggggcgttctgtcgcgctgtatcatgcgatttagtccaacgatctctcggtaattacattttagtcctcaagagatgatcatttttggtatgcttacctgactcggcgttgtgaatgtcgaacagctttgacaaggacgtgccagactccgccgatatggagccgccgttgctgggcctgccgaattatcatcaggatggttcttatgcagaataccttgctaattttcaagaacggagccacacagatgactggtcagattcttctcttcacctgctgtgcacatatggatagagtgtagatctcctcatcgaatttttgttgtagctttgttcacaacatgatgggaataacaaggaacataactaagttattgcctcactagggaatgcaaaacacgttagcattatagtaatatctaccaacatgtagtttcgataacagccaatgcctatcgagtgttgtcttctagctaaggttgcctggttcccactgcccattggccaaattaaattcagaacttttagacttgtcttttccctatctactagctactatggatggactacttttttttttgcagcaatgttccattttaagggtaaaaaggcagaaaatcttcattttctgcttcaatcattatatcgctggttatgatgaaagtctaacttgtatgcatgtaggtttggcacggagaacatggatgtcctcgtaagctggacgaaaaacttatgttccaacaaggatttgcgtagctgcagtgtactcgacataggaactgggagcggtcgactctcgcaacagcttgcaaagcaagggtatgttgatgaaatggcaatcttccatttgcatttctccaaccaaaggttactttaatgtgaatgctgttattgttgtcaacttcaatgtattggtgttgagatgcctttcttaacgttttctgacagccctgaaatagacttattgtctattcttttgctcttgcgtttgtgctccttctctcttgtgtttgtgttccttctatataattagagtatgaatttggagttgtaaagtttggtaccataaggcaagtataattgatttagttaagcagacctatcaatttcccaatggtctttctatcacatgcttaaaatctggccatctttgtaaattgaagggagatgccctttgataattattcttggaagctgcatctggtttgctgttaagcaaaggatcatgctagcacagtctatgttttctttttctcgaatagctatatgttttgtagattgggagaaacatctctattgacttggagtatttttataaattaggagacattcaactatgtatttcactctgttgaattgttaatgcctcttgacagtactgatatgtccatatacaggttctctgatctgactgggatcgaccacagtgaaggtgcaattgaggttgctcgtaatcttgctatccgtgatgggtttgagcacattaatttcttggtgagttgagcactggaccatttggtgcatatgcctgtatctgtatgcttcacaatttcatgttcttattttgctttaacgtataatgtgcacatccatgaccttctggttgtatcttagataccaaaacaacatctttcaaggttgtacagctaattatcaactcccttgaacaaagagctttaaagcggaaagaggaggaaagagctgattcagcttacatgaatcttgctcttgcaggttgatgatgtgttagagtcaaagttggagaggagatttgaacttgtgatggatgaaggaactctggacacgattgggttgcaccccgatggacctgtaaagaggtaatgcgtgcgaagctgttgatgtatgctttaatccctcatggtaaattatcataaattttgatacaccgcataatatttaggagtgacttggtactctcaattgcttaggttgtttaaactggcatggatcacactgcttgttggtttccatgtgttaaactattttcaatttactccatttcagaatgatgtattggcagtcggttgcagggctggtttctcctggtggcatactggtcagtacttccaccacattcaacccaaatatctttgtgttgcatggtggctcacttgcaacaaaattcgaacagtttactgtggtgaaactatttgctttacatattctacctacggaaattaccaatttaatatctacatatgatgttctgtttaacttttaataatcctgtgtaatctacatggtttcaccattacagtaactatttgaaagccatgtatgtgaagatggcttaggacaaagaatgtgtcaagcctctgatgctactttcacatgtgtttaggtcatcacatcatgtagcagaaccaaggatgagttggtccaggaggtagagagcttcaaccagagaaagctcagtgctatgggctccgaaggtgcgcaggccagtgatactgcggtgttcaagtacatcgaccatgtccaaacgtaccccatcgtggatagttcctgcatcacgaccgttgctttctcgcatagctgaaacatatatgtatgctctctctttttctccctaactttgccatcccagtgtgtatcccctttaccctagttctcttcgggtgatagtctactttgccagataggttattcagttgtaacgttgctttgttatgtcttgaattcttgatggatgtactcttttgaaagcgtgacaagcaacactattacatcagatatgcagaactctgtgctatgaaagctgaatcaacaattcaccaatcgatcaggcaataacgtacatgggttgacgatctgagttgatgatagccatggaatgcctaattgccattctggctctactgttatagacgaaaatgattgcgattgtaaaatgaaaaatgcaagtggatggatccagaaaacgacgtgtatttccttccatttgcaagtaatctgaataataacaaccttttcaatacttatagtgggtagctgaacttgcttgcagtactagagaagctcaagttacagcatcttgggttagttagcgatctgttcctttctcatatgtacagagccactacattcttgcaagggcaccttgaagcgagtggcttcaaactatcttcatttactatgtcacatatggtcaccttcctcttctttttttcttctttttttgaatttttttggcatcgttcttgatcgtgtcagtagattggtaccaggcgtgtctgagaatgaattggctgtgcaggatcggtatctgaataatcctcctcctcttcgctgtctgacgaagtcatatacatttcccgtctttcctgcagggttaagtgatctagatcccagagttatgatccagccaaggaagattgtagcatatactatgaatggttaagatggaggactctgctcaggtgtagacctgctcaagctaactgagcaggattaggactgcatttcactgcacctgaggaggctccaacaatggcagatcatgcagtgatggaattacctgctggcgacgacgacgatggaaggttgccaatgctctcaccatgaccaagattggaaataggattccggcggtcctcaagacaagaagcttttacccccatcagaagtacagacactcagtcaggagcttgatcttcaagataagtgtgataattcttttttgcagtgatgatctaaactcaatttggacatcgatcttaccgagaataaggccaacgagtactccccatccccaccaatcataagaggaagagtgtggcgaagaaccaggagtgacatgaactattcaatcacagggacagaattccatcagaaaggaaacacaagaattagccaggattgaactgggtgatagataattgtcattaaaggatatttatctatccagatgcaaggaatctcacaattatggcgactgttcggcaacacagggtgctgcttctcgtcctaatgggtaagtagtcctcataaccatccatgaagtcgcgctccgatggcaccattgttattatctgggaatcatggagatcttgcctagcaatctcccaatttcctctgtagagggatcagggaaagaaacagaagaaaaatgtaagaatttacagatgctgactagtcaggcacagcaaccaattatcacttaggatccccaagagagtacctgaagttcatcggtatacttccatagtgaaacagttgctgtggggcagtataaccaggcttgaattgctgcagaaagagatatcacatcagaggattagcccatgcatgcttgaacagttttatatgtcctcaaatcgtatcgctatcaaacacatttgtctgtactataaacagttccacaaggctacaaagaatgcatagttgaaccaagatgattttacctgcaaacatatttcgcaaacggtgtcgcctttctcattgcaccaacgctgaatgcatttccggtgcgcatactgcaagggagaagctaagaatttaatatcttgcaaaaattcacctgcataaccaactgaaatacattcatatattacagtatcatttgctagaacaagaagcaacaaacagcaccgaattcagaatgttttactgaactttcaactacatttgaccttgctagataatgtgggtagttgccccactcattgcttgaaggtcacagatagcctcctccatttcccttacttcgaaagaacaccaacaccttattttgttttgtttctcagcaacatcactatcaaataggaaggccaatacgaggcagtgacttccaagttacatcgaggcaaatgcagctgatttttcataacaacttttcttaaatccaggattgacctttttcgcatacttaattagcatgtatgatagtacacaaccaagtgaacctactgcagctaaccccaaccataaatgtcaacaattttcatcctaagtcaactagtgaactactattatctaaaataactagtgaactactcctctagaactagaaatctaaagtgaccacaaagaaaaccatggacaccaattaactaatttatcttctcccactaaaagtggagaccaaaagaccaaattttccatctgaaaaaaggatatatttttcataacggtaacaaatcagaattacagaataaacaattcacaaagccaaggaaaagccataaccttgaggctgccacagcaagcacagggtgcctccatgctggtatcccaatcctcctcttggcaaatcctgcactccaccatcttcctcgccgagccgccatcgccgtcgccgtcgcagcagtagtcgatcgccaccgtctccgcctgcagatcggccacctgcttcctgattgccgcgtccagcgtcgactccgtcagcagccgatccacaagcaatgccagatggtcgcccattaatcctgcaaacaacgcactccatggttcagtcatcgcaatctgcgcagcctgaaacaattcttgctacaatctatgctcctaagagaaaaaaaaaacagtgtaatggccgaggagaacaccaagaatccaaggaggagttcgtcaggtatgtgtgttgcaggagggggatgaaatgcaaccgctgacttttggattttggtaagaactgacaggaaccgattgctccgtgatgataataaccgcaagagatggggagttacttagtaactggaattatctgctagccgatggacaaagttggcccgagcagcaattgcaccaagaacaggcaaaacctacacattctggtttctgagcataacatgatggattggatgaaaatggctttcatcgaatggaagggaaacaagtttactaatcgatgagagctagaacaagagggtggttgctactagcattttacagtaccaagaaagtagtgctgaatcaaagaaacgccatgaaaacaccaccaagaagattaaaaagaaaaacaagagaacaattcacagccaaaaccaagaactcaccaagagagataagagatgcaggaaacacagaaggaaggcgaagtgctgtttccaatggtctggcggcttaatagcaaactaaaaacaacaacaagcaaataaaaaaaggggcaaatctttaccttgtccaggtatcaacagcaaagctccagagaagttgaagcttggaaggatggatttggggttggggttaaggcaagggggggggggggggatttttgggggaggggttaagggaagcaagagatggagtggagggggatgtaacaatggaggccaagccaaggaagaacactctagctcacctcaccttcaactcctcctccttcttccctcaaatttaaattagaagagaggcaaagaaagagagaggggaataagtatcaccaaacaacaacttcactgatactgctcttttgcatgttactttctttctttggaaaagcctcctctccctgattccttctcactttcccaaaggctctctccatttt

SEQ ID NO: 32343 - DNA, 7661 bp, Oryza sativa
tttatacccgagatacataatatgtccttaccggacacgagtcttctatctaacaaactctaagatacacaaaatctttacgacagacttttgcccaaacatatgtctaaggaaattacataaaatatcataattaatagatacaattgcttatttgagagcttatctctatcgtggcaatccttgttaagcacgtcgatcgattctagaagtagtctcacaaccgtctttaagaaaatcggctgtcctctgtccgatccatcttagccgatgcagactccagccgatgcatactctgttcttcgaatctaactcctcgccgaatccgcttcgattccagcactgaacctggtttatatcttacaaattttggtcattaacaacacctcagcgccatgtcaactggcgctgaatgccgtaccaccgtggatgggaggctaagtcagcatgccaacatacattcagcgccatgctatttggcgccgaggtgtctaaattcagcgccacacgatttagcgctgaacaaaagggttagttttgaaataagttttggcggcggttcatttgtaaaaatagtttttgcaaagggtcaagttgtcaaaatctctcaacccccgcgccctctgacaagatactgtagcgtcgaagaactcagatgtgtctcatcatgaatttctgcttgtttttacaagaggttgtttggccttgattccaacactgatatcatttcagagttcagatgagaattgtacaaggagattaattagcggaggattcaaaaactggtatatatctttaggattagaacttgcaccagtgtccgacacaactgtaagaagaattactcttttcaccgtccaaatcttcgggcttcagaatactacagctgcagggttatactccttttttttttcttttgttccagttacgattctgaaatcctttgctattgtcagtccctgattagcagcatatattttaccctgtaatggagtggccaaataaatcatcgtagctggacaacataagactgactgcattgaagatacagatcataagccaaaacgttcaagcagcagcagctagcctgggattgcatcgattgttcttctcttgcatgaaaaatcagtaatcaggaagaatcagaaaacactgcagaatacacatgatctgtgctatgccctcttcattgtgtactgaaaccgaacatctcagcagtcagcagtgatcgaagccaatcaaaacctgcattatactactcccctcttccctaaatgtttaacgccgttgatttttttaaacatatttgaccgctcgtcttattcaaaaacttttgtgaaatatgtaaaaccatttgtagacgtaaaagtatatttaacaataaatcaaataataggaaaaaaattaataattacttaaattttttgaataagacgaacggtcaaacattttttaaaaagtcaacgacgtcaaatattttgggatggagggagcagtatatctcaacatatgacgttctttttaatttcgtttttatcactgcaggtcaacgtccagtatcacttttgcagcagctgggttggcaaacgagccatcgagttttgtctggttttacaagggtcatcttggactcgtaattcatactgaagctccactccagcacaaaacactgaacggatcggaagagtatgtttgttaacattgttgcacaaaaggcagaacaagcttgtttactattttattgttgttagttacactgctgcagatcgatcgtctaatggattagctgtggaatcagaaaaatgataatctaattacatacaaactgcacatcattacatacaaactaagtttaatcaattttaactgatcaaaatcgctcaaaaatggtaacacagccctgtgtactgtacacggtagcttgtcaggtcagaacagaataaacagagccatcatggtttcccagcaagtgagcaaacatcacccaagtgcgttcgtcaagccaaagtggttacctgccaacacaactacaactagaatcctaattatgcagcgctgaagcttttttactaatacaatgatgcagaattccaacaacttctgcaacttgaaatcttgcaacacacgggtgtgaaaacccagacatggtgctcgtcagaattcagatcatgtaaatacttttcacaactagaggagaggtaaggtgaaaaatggtagtaaaggtgttctagcttggagctgaagtgaattggagagttttcctttttgtctgatcttttctgaatatgcttttccggagaacctttccatggatttgctgtctgtatcctagagaaagggcaggacctagatagtcacaaatagaatgattgtatgtcaagctaaagtgatgttcccaactgaaatttaccaaattacttttgacattgaacggccaagaagattggaacccaaaaccaaaatcaaattaggaaaaggaaaagttgacccactcctctcttctcttcagttcttcacaagcaatgaagcaaatactagtaatattacgacaaaaggacatccgaatttggttgtgcgcctgctaacagaggccgaagatgtaaccattattattattattttttaaaaaaaggacattagaattgctgtaagtttactgctgtgcaagtacaacccttacgaccagagctgaaaattgtgcatttttttttctgaaaacctcccgcttgctcaactgcatcaattgacatggttgcaaaatctgttccaacctccagcatagacatcaggctgatctagtgtacaaggaatgtcccccccaccaacagaatatggaaacacacagaacaagacatgtacataagaaagaaacatgtccagctgaacaatcataggggatacagaacattgctcttcatatcatagtggggttttgcccaaattttgtttgccattaggcattagcctttacaactattccctgaaacataccatgtataccacggaaggaagcactcatccacctagatcatctccactgcaaaatggggctttgccccagtgcttcaccttcttcttttcctaactattacaggcaattgctatactagtctgaatgaccatagagactgagctcgtcatggagagcagtctactggggtgatccttgaccctgatggcagctcggacacctcctccctttgggggcggtccgcaaaaagcatcaagaggaggccaagtgttaagccagaggcaatgagagccaggcctgctgagaccaagctgaggtcgcgccatataggagggcagtactgcgaagcgatggagctgaatgtgttgcggacgaacttgcagtcctggagattgagcatgagaggggcataatggtacagagcatagcttacattggcagctaaaacaagctgactgtatatctctggagttatggttctggggccagagcacaaatctgagtcaggaactgtgcatgtatagttcagccatgcctgaaaagaagaaatcattttgttatcaagcaaagcttcacaaatgaccccatctagtaatcctaaaataaaccagatcagcaagagtcatgcatcagagaaaaacttcaattgaagccaacaaattgtgaaattagtaacagaacaatgccaaaacttactgtggttgcattatcgaaggtgacctccctagacttgcactgccgatcagtcaggttcgcatcatagggagaacacaggtaaggcatgaactgcccaggatgtttatgatgtggccttcgatttgaaagagcagatatagccctattaactatgcctacaagaattaccacaacatgtttactctggtacaaggtttgattggttgtgctttcatctacacatggaaggatgttgctgagagctgtctctgcttgaggatgttgtgcccattcatccattgcttcacaggtatcctttgcagcactgttgcagaaagattataatgttggaatactaaacagtgaattgcaacctcataaaaacatatttagttttgggagggatactatcaatgctggttcatagcatatgaacatgggtgacatatcaaatggcaagcaaattcattcttttcaaatgaacacatagcacatatcaaccgacaagcaaattcatcatcgttgagttctacaaaaatgtttctactaaatatgtttgtagctcttatacttttaattaatgaaactgtgggcttacctcctgattcacggtaaaagaagttctgtttgattcatggttccataccaaggagaaaattagaattgtaagacctcctagaattatttcgcatggaaagaaggctattcgtaacctaataatacctgttcaatatcaggaaaatccctagaagaatgaagagagttgccactactgtccagcataaggtaacaaatctgtaaaattcaaaaagtaagtggtaaaaaattactgcactaacatgcccactctaatacacagtactttgtacatggccacaaagcttacacataaactgtacttctttgtccatacagctccaaaactgcaaatgtgaggaataggttgttcaagtagtgagtgttaacacatctgagataacaaaaccaacaaaaagggcatcagtttgactaacagaatgaaattcttaccatatcccaagaatgcaagaacaggcatcaacgcagctatgcaaatcaaagcaactgacctgtagtaaaacaggaattcaaattttcagttgaaggcatagcattactaataatgtgctagcataaatgaatgcaatgccataataaccattttgaattttgattacgcttcttagcaacacagtgccgtcattttgaagaaaagatataggcccacagataaatatactatatagtcacatgaactattattcagtcagtgactttcaaagtcaagaaaccagaggtaaacatggcaagaatagtttgaaacgtacaagttatggagaacttttcttatccttctgtagttttctgatgtcttttgggatatagtatcagccgctttatttaagtccactttcaaattgtcaatttgcccttgtacatctgaaggaagatagagtgctgccacactgattgtctttgcaagcgataagtaatcggtaacattccttagcgtctgaatggtgaaatcagattgattcacaacaaaatcgacagtgctagtagcttcttgtccgaatttactctgtccacaaaagaggataacagatccagccctggtacaaaatgtaacattggtagatattagaaccagtagttatgccatcttagaactcaatagtggcatggagtagaaaactctatttaaaccagcgatatcccaatcagatgaactcaaaaagaaaaggaaaaaatgattattagagagttagcacattacgttaaagtaaatatgaagaccacaagcaacacaaggcgcagtatatctgcatgaaaatcattttctttgtctattcttgatttccaaaagcagcttgcagctacagcaattccaaacgaaataaaccacccagcagcaagaacaaacccagcaattcctgtgaatgaaacagactgaaacaaacttgattcagctaagatgtaggcagaacatgggcattaagcagaacgaagagtataacagttcaatcataattaaaggcataggccagtttaacttcaaactatgccatacatttttcgactgtagagtcagtgttttcctgttctccttagattaccttgtaaacagtatttacacagttcaaagaaagtgagacaacactgtcatatcatactaccgcaaatttctcaatgtttttacatagattttttttggggggatttcacaaataccttaaaaccaaacaaaaaagaatcaagtaagtttatccatgaatggtctataagttgtcctgtaactggctactgtatttggacaagtagaaataaattgtccagactgaatttgtagttcatatatagcctgtactgatctatactatcatattccaacaaccaacataaatactagtatcgtctacttgcatatcatgacatctctaataaactagagcttcaagagtataaaacttttagtgtcttgaattcttgatagcaacacataccgcccaatagtgcttgttagtgatgttccaccctcctccatacatcctaaggtggtcaagaacatccggccgccgcgtcctctcctctgccagaaccagcggatactttgcgatggggccctctgctggccctgccgccgagtccggcatccctttcagaagccccttcgcccatggtcccaagttattcacttctgtagtagcagttcacacaaaaaaggaagaaaaacaaccgtttagtaccagtccagaatactactagctgataatatttaaccataactaccatcaaagttctgcttgcttgtacaaggcaagaagcaaatgaaaattgccacttggttgtaatcttgtacgataagtaaagcatcgagcttcacatttataagcataaattacgaaaatctagattctgtttgcgcatgaaccagtgaacgaaagtgccgcttttacacagaaagatgaaagttctaccactccctaggaagaaatgcttcgtgtgaaccttgtgacttcacgtgtaagtaaagaccgaattgtagccgtcgcagattagagcaccgacatgataattaaatactggtacccagtgtttgacttgttccaaacgagatgagagaatttttactagtggaagcgaatcaccaaaattagcatccctgaactacggggtttaaaaaatcaactaacagacggaaggagatctacccggcaaacgcagtaaaggggaagcaatatggcccgaacgaacgagcaatcaccgccgaatcctccggaacaatagccgctcttttatgcagaaattgagcaaaacaaaagccggatttatttgggcttgattctccgaacaaaatagagcatatccgatatagaaatcgaatgagatgagatcaccctaagacgctgatggtttcgcagacggcgacgaaaaaaattagtaatatctgaacaaaaaagcgcacatactgatactagacaggacaaacgtagcaccggcgcagtggtcctgaacagcagggtgaaatccacccaaaaaacacagctccaatcagtaacaaaatggattgaaacggatgaactcgacctaattaagctactcatccgatccccctccgctcactccactccactccaccgatcgatcgcaagtcgcaacggagagatagaatagaacgagagacgaatcgcaggaccactcgccgcaaaacagctcaagcccacgcacctggcacgctgtcgatccccttggcggcgccgccgagatcggcgagcgtgtcccccgacgccacggccgccgccacgaaggccgcgaccaccaccaccgcagcgcccgcgcccgcgccccttcttcccatcaccgcatctaggttcgtcggcgcgcgcggcgaggtcggggcggcggcggcgcgcgcgcgcgtaacggcgggagtgctagcgcgagtggacgaacacctttcactggactaagcccgcggcgtcggtcggtctcgtct
